United States Patent 11,116,804 (MODULATION OF THE GUT MICROBIOME TO TREAT MENTAL DISORDERS OR DISEASES OF THE CENTRAL NERVOUS SYSTEM) - sequence listing, part 2

SEQ ID NO: 1701 - DNA, 1327 bp, Prevotella sp.
  misc_feature (529)..(529): n is a, c, g, or t
tgagtttgatcctggctcaggatgaacgctagctacaggcttaacacatgcaagtcgagggaccggcgcacgggtgagtaacgcgtatccaacctgcccaccacttggggataaccttgcgaaagtaagactaatacccaatgattaaagtcggtgatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctatgggttgtaaactgcttttataagggaatatgcatgtaccttatgaataaggaccggctaattccgtgccagcagccgcggtaatacggaaggtccgggcgttatccggatttattgggtttaaagggagcgtaggccggagattaagcgtgttgtgaaatgtagacgctcaacntctgcactgcagcgcgaactggtttccttgagtacgcacaaagtgggcggaattcgtggtgtagcggtgaaatgcttagatatcacgaagaactccgattgcgaaggcagctcactggagcgactgacgctgaagctcgaaagtgcgggtatcgaacaggattagataccctggtagtccgcacggtaaacgatggatgcccgctgttggtcggtcagcggccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggatgtcgtcagctcgtgccgtgaggtgtcggcttaagtgccataacgagcgcaacccctctccttagttgccatcagctgggcactctggggacactgccaccgtaaggtggaggaaggtggggatgacgtcaaatcagcacggcccttacgtccggggctacacacgtgttacaatggcaggcagagagacggtcccttgcaaaatggatcaaatccttcctgtctcagttcggatggggtctgcaacccgaccccagaagctggattcgctagtaatcgcgcatcagccatggcgcggtgaatacgtcccgggccttgtacacaccgcccgtcaagccatgaaagccgggggcgcctaaagtccgtgcggcctagggcgaaactggtaattggggctaagtcgtaacaaggtagccgt

SEQ ID NO: 1702 - DNA, 1459 bp, Prevotella sp.
ctcaggatgaacgctagctacaggcttaacacatgcaagtcgcggggcagcatgggggttgcttgcaacccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagctcgacggcggggtaacggcccaccgtggcaacgatcggtaggggttctgagaggaaggtcccccacactggaactgagacacggtccagactcctacgggaggcagcagtgaggaatattggtcaatgggcggaagcctgaaccagccaagtagcgtgcaggatgacggccctatgggttgtaaactgcttttatgcggggataaaggggcccacgtgtgggtttttgcaggtaccgcatgaataaggaccggctaattccgtgccagcagccgcggtaatacggaaggtccgggcgttatccggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttgaggccggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcggatgatgccgggcactctggagatactgccaccgcaaggtgtgaggaaggtggggatgacgtcaaatcagcacggcccttacgtccggggctacacacgtgttacaatggcgcatacagagagtaggtggcatgcgagtgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaag

SEQ ID NO: 1703 - DNA, 1452 bp, Prevotella sp.
aggatgaacgctagctacaggcttaacacatgcaagtcgaggggaaacggcattgagtgcttgcactctttggacgtcgaccggcgcacgggtgagtaacgcgtatccaaccttcccattactgtgggataacctgccgaaaggcagactaataccgcatagtcttcgatgacggcatcagatttgaagtaaagatttatcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttgtatggggataaagttagggacgtgtccctatttgcaggtaccatacgaataaggaccggctaattccgtgccagcagccgcggtaatacggaaggtccaggcgttatccggatttattgggtttaaagggagcgtaggctggagattaagtgtgttgtgaaatgtagacgctcaacgtctgaattgcagcgcatactggttttcttgagtacgcacaacgttggcggaattcgtcgtgtagcggtgaaatgcttagatatgacgaagaactccgattgcgaaggcagctgacgggagcgcaactgacgcttaagctcgaaggtgcgggtatcaaacaggattagataccctggtagtccgcacagtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggcctctgtgaaggtgctgcatggttgtcgtcagctcgtgccgtgaggtgtcggcttaagtgccataacgagcgcaacccctctcttcagttgccatcaggttaagctgggcactctggagacactgccaccgtaaggtgtgaggaaggtggggatgacgtcaaatcagcacggcccttacgtccggggctacacacgtgttacaatggccggtacagagggatggtgtaatgcaaattgcatcaaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaactggtgattgggg

SEQ ID NO: 1704 - DNA, 1458 bp, Prevotella sp.
acgctagctacaggcttaacacatgcaagtcgaggggaaacgacattgaagcttgcttcgatgggcgtcgaccggcgcacgggtgagtaacgcgtatccaacctgcctctgactaagggataacccggcgaaagtcggactaataccttatgaggttttcagcagacatctaatgaaaacgaaagatttatcggtcagtgatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgtggggataaagtgagctacgtgtagtttattgcaggtaccacatgaataaggaccggctaattccgtgccagcagccgcggtaatacggaaggtccaggcgttatccggatttattgggtttaaagggagcgtaggccgtggattaagcgtgttgtgaaatgtagacgctcaacgtctgaattgcagcgcgaactggttcacttgagtatgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgatggatgcccgttgttagttcacttaagaattagcgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgaacgattcagagatgatgaggcccttcggggcgtctgtgaaggtgctgcatggttgtcgtcagctcgtgccgtgaggtgtcggcttaagtgccataacgagcgcaaccccttttttcagttgccatcaggtgatgctgggcactctggagatactgccaccgtaaggtgtgaggaaggtggggatgacgtcaaatcagcacggcccttacgtccggggctacacacgtgttacaatggccggtacagagcgttggttgtatgcaaatacgatctaatccttaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtctgtgaccgcaaggaaacggcctagggcaaaactggtgattggggctaagtcgta

SEQ ID NO: 1705 - DNA, 1479 bp, Prevotella sp.
ggctcaggatgaacgctagctacaggcttaacacatgcaagtcgaggggaaacggcgtttagtgcttgcactgttcggacgtcgaccggcgcacgggtgagtaacgcgtatccaaccttcccataactaagggataacctgccgaaaggcagactaataccttatgtaattcttagatgacatcagaagagaatgaaagatttatcggttatggatggggatgcgtctgattagcttgttggcggggtaacagcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttgtatggggataaagtcaatcacgtgtgattgtttgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgccactgacgcttaagctcgaaggtgcgggtatcgaacaggattagataccctggtagtccgcacagtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggtctctgtgaaggtgctgcatggttgtcgtcagctcgtgccgtgaggtgtcggcttaagtgccataacgagcgcaacccctctcttcagttgccatcaggtaatgctgggcactctggagacactgccaccgtaaggtgtgaggaaggtggggatgacgtcaaatcagcacggcccttacgtccggggctacacacgtgttacaatggccggtacagagggacggtgtaatgcaaattgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtgattggggctaagtcgtaacaaggtaacc

SEQ ID NO: 1706 - DNA, 1451 bp, Prevotella sp.
ttcaggatgaacgctagctacaggcttaacacrtgcaagtcgaggggaaacgacggggaagcttgcttctccggtcgtcgaccggcgcacgggtgagtaacgcgtatccaacctgcctctgaccaagggataacccgtcgaaagtcggactaataccttatgcagtcgtcggaagtcatctgatgacgacgaaagatttcatcggtgagagatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatgcggggataaagtgagggacgtgtccttcattgcaggtaccgcatgaataaggaccggctaattccgtgccagcagccgcggtaatacggaaggtccgggcgttatccggatttattgggtttaaagggagcgtaggccgtggattaagcgtgttgtgaaatgtagacgctcaacgtctgacttgcagcgcgaactggtccacttgagtgtgcacaacgcaggcggaattcgtcgtgtagcggtgaaatgcttagatatgacgaagaaccccgattgcgaaggcagcttgcgggagcacgactgacgctgaagctcgaaagtgcgggtatcgaacaggattagataccctggtagtccgcacggtaaacgatggatgcccgttatcaggctttttagtctggtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagacgtacgattcagagatgaagaggcccttcggggcgtctgtgaaggtgctgcatggttgtcgtcagctcgtgccgtgaggtgtcggcttaagtgccataacgagcgcaacccctattctcggttgccatcgggtaatgccgggcactccgtggagactgccaccgtaagtgtgaggaagtggggacgacgtcaaatcagcacggsccttacgtccggggctacacacgtgttacaatggccggtacagcgagtcggccgcatgcaaatgcggtccaatcctgaaagccggtcccagttcggaccggggtctgcaacccgaccccgcgaagccggattcgctagtaatcgcgcatcagccatggcgcggtgaatacgttcccgggccttgtacacaccgcccgtcaagccatgaaagccgggggtgcctgaagtccgttaccgcgagggtcggcctaaggcaaaaccggtgattg

SEQ ID NO: 1707 - DNA, 1365 bp, Prevotella sp.
  misc_feature (1)..(1): n is a, c, g, or t
  misc_feature (259)..(259): n is a, c, g, or t
ngagtttgatcttggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactgtaactganacacggtccagactcctacgggaggcagcagtgaggaatattggtcaatggacgcaagtctgaaccagccaagtagcgtgaaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttagccattgatactggtagtcttgagtgcagcaggggatgctggaactcgtggtgtagcggtgaaatgcttagatatcacgatgaactccgatcgcgaaggcaggtgtccgggctgactgacgctgaggctcgaaagtgtgggtatcaaacaggattagataccctggtagtccacacagtaaacgatgtatactcgcggtttgcgagtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaaccctttttcttggttgccatcagctgggcactccagggatactgccatcgtaagatggaggaaggtggggatgacgtcaaatcagcacggcccttacgtccggggctacacacgtgttacaatggggggcagaaggtcgctacctggtgacaggatgctaatctcacctctctcagttcggatggagtctgcaacccgactccagaagctggattcgctagtaatcgcgcatcagccatggcgcggtgaatacgttcccgggccttgtacacaccgcccgtcacaccacgaaagtcggaagtacccaaagccggtgggtagccagccgtctaaggtaaagtcgatgattggggtgaagtcgtaacaaggtagccgtatcggaaggtgcggctggaacacctcctt

SEQ ID NO: 1708 - DNA, 1319 bp, Prevotella sp.
  misc_feature (334)..(334): n is a, c, g, or t
gagtttgatcttggctcaggatgaacgctagctacaggcttaacacatgcaagtcgcgggaccggcgcacgggtgagtaacgcttatccaacctgcccttcaccacgggataacccggcgaaagtcggactaataccgtatgttgaaaggcggtgaaggatggggatgcgtccgattagctggacggcggggtaacggcccaccgtggcaacgatcggtaggggttctgagaggaaggtcccccacactggaactgagacacggtccagactcctacgggaggcagcagtgaggaatattggtcaatgggcgtaagcctgaaccagccaagtancgtgcaggatgacggccttatggttgtaaactgcttttatgcggggatatgcaggtaccgcatgaataaggaccggctaattccgtgccagcagccgcggtaatacggaaggtccgggcgttatccggatttattgggtttaaagggagcgtaggccgcgccttaagcgtgttgtgaaatccggttgctcaacatccggcttgcagcgcgaactggggcgcttgagtgcgcagaaagtaggcggaattcgtggtgtagcagtgaaatgcttagatatcacgaggaactccgattgcgaaggcagcctactgtagcgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatgagcacggcccttacgtgggctacacacgtgctacaatggcgtacagagggcgacgaagccgcgaggtggagtgaatctcagtacgtctaagtccggatggagtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggtgaaaccggtgattggggctaagtcgtaacaagg

SEQ ID NO: 1709 - DNA, 1470 bp, Prevotella sp.
agagtttgatcatggctcaggatgaacgctagctacaggcctaacacatgcaagtcgtggggcagcgggtatgcttgttttcaagtatatgccggcgaccggcgcacgggtgagtaacgcgtatccaacctgcccatcacaagggaataacccgtcgaaagtcggcctaatgccctatgtattccgatgaagtcctctgaatcggaataaagcatttgcggtgatggatggggatgcgtctgattagcttgtcggcggggtaacggcccaccgaggcaacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggccctatgggttgtaaactgcttttatacggggataaagtgagggacgcgtccctttttgcaggtaccgtatgaataaggaccggctaattccgtgccagcagccgcggtaatacggaaggtcctggcgttatccggatttattgggtttaaagggagcgcaggctgcactttaagcgtgttgtgaaatgtaccggctcaaccggtaacgtgcagcgcgaactggggtgcttgagtacgaagagggaaggcggaactcgtggtgtagcggtgaaatgcttagatatcacgaggaactccgatcgcgaaggcagctttccgtttcggaactgacgctgaggctcgaaagtgcgggtatcgaacaggattaggtaccctggtagtccgcacggtaaacgatggatgcccgctgtcggcgccttgcgccggcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaatcgcaggaagaacgatacagagatgttgaggtccttcgggactcctgcgaaggtgctgcatggttgtcgtcagctcgtgccgtgaggtgtcggcttaagtgccataacgagcgcaacccctctccccagttgccatcgggtgatgccgggcacttcggggacactgccgccgcaaggtgcgaagaaggccgggatgacgtcaaatcagcacggcccttacgtccggggctacacacgtgttacaatggccggcacagaaggccggtgcggcgcgagccgcatctaatcttgaaaaccggtcttagttcggactggggtctgcaacccgaccccacgaagctggattcgctagtaatcgcgcatcagccacggcgcggtgaatacgttcccgggccttgtacacaccgcccgtcaagccatgaaagccgggggtgcctgaagtccgtgaccgcgaggatcggcctagggcaaaactggtgattgg

SEQ ID NO: 1710 - DNA, 1446 bp, Prevotella sp.
gagtttgattctggctcaggatgaacgctagctacaggcctaacacatgcgagtcgtggggcagcgggtatgcttgttttcaagtatatgccggcgaccggcgcacgggtgagtaacgcgtatccaacctgcccatcacaagggaataacccgtcgaaagtcggcctaatgccctatgtattccgatgaagtcctctgaatcggaataaagcatttgcggtgatggatggggatgcgtctgattagcttgtcggcggggtaacggcccaccgaggcaacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggccctatgggttgtaaactgcttttatacggggataaaagggtgaacgtgttctcctttgcaggtaccgtatgaataaggaccggctaattccgtgccagcagccgcggtaatacggaaggtcctggcgttatccgggtttattgggtttaaagggagcgcaggctgcactttaagcgtgttgttaaatgtgccggctcaaccggtaacgtgcagcgcgaactggggtgcttgagcacgaagagggaaggcggaactcgtggtgtagcggtgaaatgcttagatatcattaggaactccgatcgcgaaggcagctttccgtttcggaactgacgctgaggctcgaaagtgcgggtatcgaacaggattagataccctggtagtccgcacggtaaacgatggatgctcgctgttggatatttttattcagtggctaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgcagctgaacgatccagagatggtgaggcccttcggggcagctgtgaaggtgctgcatggttgtcgtcagctcgtgccgtgaggtgtcggcttaagtgccataacgagcgcaacccctctccgcagttgccatcggttgatgccgggcactctgcggacactgcctccgcaaggagtgaggaaggtggggatgacgtcaaatcagcacggcccttacgtccggggctacacacgtgttacaatggcgcgtacagagtgtcggtgctgtgcaaacagtatctaaccaataaaacgcgtcccagttcggaccggggtctgcaacccgaccccgcgaactggattcgctagtaatcgcgcatcagccatggcgcggtgaatacgttcccgggccttgtacacaccgcccgtcaagccatgaaagccgmgggcgcctgaagtccgtgaccgcaaggatcggc

SEQ ID NO: 1711 - DNA, 1524 bp, Prevotella sp.
gagtttgatyctggctcaggatgaacgctagctacaggcttaacccatgcaagtcgaggggcatcaaattggttgcttgcaaccgatgttgscgaccggcgcacgggtgagtaacgcgtatccaaccttccctttactctggtatagcccagcgaaagttggattaataccggatgttatcgaaagctctcatgagactttgatcaaagattttatcggtaaaggatggggatgcgtctgattaggcagttggcggggtaacggcccaccaaaccgacgatcagtaggggttctgagaggaaggtcccccacattggaactgagacacggtccaaactcctacgggaggcagcagtgaggaatattggtcaatggacgtaagtctgaaccagccaagtagcgtgcaggatgactgccctatgggttgtaaactgcttttatgcggggataaagtcagccacgtgtggttgtttgcaggtaccgcatgaataaggaccggctaattccgtgccagcagccgcggtaatacggaaggtccgggcgttatccggatttattgggtttaaagggagcgtaggctgttggttaagcgtgttgtgaaatgtagatgctcaacatctgaattgcagcgcgaactgtccgacttgagtgcgcggaaagcaggcggaattcgttgtgtagcggtgaaatgcttagatatgacgaagaactccgattgcgaaggcagcttgctgtagcgtaactgacgctgaagctcgaaagtgcgggtatcgaacaggattagataccctggtagtccgcacggtaaacgatggatgctcgctgtgtgcttatttttagtatgcggctaagggaaaccattaagcatcccacctggggagtacgccggcaacggtgaaactcaaaggaattgacgggggcccgcacaagcggaggaacatgtggtttaattcgatgatacgcgaggaaccttacccgggcttgaactgccggtgctggcatgagagatcatgctttccttcgggacactggtggaggtgctgcatggttgtcgtcagctcgtgccgtgaggtgtcggcttaagtgccataacgagcgcaacccctgtcgtcagttgccatcaggtaatgctgggcactctggtgatactgccaccgtaaggtgtgaggaaggtggggatgacgtcaaatcagcacggcccttacgtccggggctacacacgtgttacaatggcgtgtacagcgagtcggtaccgggcaaccggtatccaatcaatataacacgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaacaaggtagccgtaccggaaggtgcggctggaacacctccttc

SEQ ID NO: 1712 - DNA, 1356 bp, Prevotella sp.
gagtttgattctggctcaggatgaacgctagctacaggcctaacacatgcaagtcgtgggaccggcgcacgggtgagtaacgcgtatccaacctgcccatcacaagggaataacccgtcgaaagtcggcctaatgccctatgtgtaaaggcggtgatggatggggatgcgtctgattagcttgtcggcggggtaacggcccaccgaggcgacgatcagtaggggttctgagaggaaggtcccccacattggaactgagacacggtccaaactcctacgggaggcagcagtgaggaatattggtcaatgggcgtgagcctgaaccagccaagtagcgtgcaggatgacggcctatgggttgtaaactgcttttatacggggatatgcaggtaccgtatgaataaggaccggctaattccgtgccagcagccgcggtaatacggaaggtcctggcgttatccggatttattgggtttaaagggagcgcaggctgcactttaagcgtgttgtgaaatgtaccggctcaaccggtaacgtgcagcgcgaactggggtgcttgagtacgaagagggaaagcggaactcgtggtgtagcggtgaaatgcttagatatcacgaggaactccgatcgcgaaggcagctttccgtttcgactgacgctgaggctcgaaagtgcgggtatcgaacagggttagataccctggtagtccgcacggtaaacgatggatgctcgctgttggatattcagtggctaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctccgcagttgccatcggccgggcactctgcggacactgcctccgcaaggaggaggaaggtggggatgacgtcaaatcagcacggcccttacgtccggggctacacacgtgttacaatggcgcgcagagtgtcggtgctgtgcaaacagtatctaatcaatcgcgtcccagttcggacggggtctgcaacccgaccccggaagctggattcgctagtaatcgcgcatcagccatggcgcggtgaatacgttcccgggccttgtacacaccgcccgtcaagccatgaaagccgggggcgcctgaagtccgttcggcctagggcgagaccggtgattggggctaagtcgtaacaaggtagccgtaccggaaggtgcggctggatcacctcctt

SEQ ID NO: 1713 - DNA, 1356 bp, Prevotella sp.
gagtttgattctggctcaggatgaacgctagctacaggcttaacacatgcaagtcgagggaccggcgcacgggtgagtaacgcgtatccaaccttcccattactgtggaataacctgccgaaaggcagactaataccgcatggttaaagtcggtaatggatggggatgcgtctgattagcttgttggcggggtaacggcccaccaaggcgacgatcagtaggggttctgagaggaaggtcccccacatcggaactgagacacggtccaaactcctacgggaggcagcagtgaggaatattggtcaatggacgtaagtctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcaaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggtcttgtacacaccgcccgtcaagccatgaaagccgggggtgcctgaagtccgttcggcctagggcaaaactggtgattggggctaagtcgtaacaaggtagccgtaccggaaggtgcggttggatcacctcctt

SEQ ID NO: 1714 - DNA, 1354 bp, Prevotella sp.
gagtttgatcctggctcaggatgaacgctagctacaggcttaacacatgcaagtcgagggaccggcgaatgggtgagtaacgcgtatccaacctgcccccggctggggtataacccgtcgaaaggcggcctaatcccccatggttaaagccggccggggatggggatgcgtccgattagcttgctggtgaggtaacggctcaccagggcatcgatcggtaggggttctgagaggaaggtcccccacactggtactgagacacggaccagactcctacgggaggcagcagtgaggaatattggtcaatgggcgcaagcctgaaccagccaagtagcgtgcaggatgaaggcctatgggtcgtaatctgcttttatgtggggatatgcaggtaccacatgaataaggaccggctaattccgtgccagcagccgcggtaatacggaaggtccgggcgttatccggatttattgggtttaaagggagcgtaggccgcctcttaagcgtgttgtgaaaaccgggcgctcaccgtccggcttgcagcgcgaactggggggcttgagtgcgtgcgacgccggcggaattcgtcgtgtagcggtgaaatgcttagatatgacgaggaactccgattgcgaaggcagctggcgagtgcgactgacgctaatgctcgaaggcgcgggtatcgaacaggattagataccctggtagtccgcgctgtaaacgatggatgcccgccgtgggtatttccgcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaattgcgaaggtgctgcatggttgtcgtcagctcgtgccgtgaggtgtcggcttaagtgccataacgagcgcaacccctctccgcagttgccatcggccgggcactctgcggacactgccgccgcaaggtggaggaaggtggggatgacgtcaaatcagcacggcccttacgtccggggctacacacgtgttacaatggccggcagagagttgcgcgcgcaagcgttgccaatccctccggcctcagttcggatggggtctgcaacccgaccccagaagctggattcgctagtaatcgcgcatcagccatggcgcggtgaatacgttcccgggccttgtacacaccgcccgtcaagccatgaaagctgggggcgcctgaagtccgtgtcggcctagggcgaaaccggtgattggggctaagtcgtaacaaggtagccgtaccggaaggtgcggctggatcacctcctt

SEQ ID NO: 1715 - DNA, 1356 bp, Prevotella sp.
gagtttgattctggctcaggatgaacgctagctacaggcttaacacatgcaagtcgagggaccggcgcacgggtgagtaacgcgtatccaacctacccattactgtgggataacctgccgaaaggcagactaataccgcatggttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacggaagtctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcctgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccagttcggatggggtctgcaacccgaccccagaagctggattcgctagtaatcgcgcatcagccatggcgcggtgaatacgttcccgggccttgtacacaccacccgtcaagccatgaaagccgggggtgcctgaagtccgttcggcctagggcaaaactggtgattggggctaagtcgtaacaaggtagccgtaccggaaggtgcggctggatcacctcctt

SEQ ID NO: 1716 - DNA, 1356 bp, Prevotella sp.
gagtttgatcctggctcaggatgaacgctagctacaggcttaacacatgcaagtcgagggaccggcgcacgggtgagtaacgcgtatccaacctgcctctgactaagggataacccggcgaaagtcggactaataccttatgaggaaagtcggtcagtgatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttatgtggggatatgcaggtaccacatgaataaggaccggctaattccgtgccagcagccgcggtaatacggaaggtccaggcgttatccggatttattgggtttaaagggagcgtaggccgtggattaagcgtgttgtgaaatgtagacgctcaacgtctgaattgcagtgcgaactggttcacttgagtatgcacaacgtaggcggaattcgtcgtgtagcggtgaaatgcttagatatgacgaagaactccgattgcgaaggcagcttacgggagcaactgacgctgaagctcgaaggtgcgggtatcaaacaggattagataccctggtagtccgcacagtaaacgatggatgcccgttgttagttaattagcgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgggcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtaattggggctaagtcgtaacaaggtagccgtaccggaaggtgcggctggatcacctcctt

SEQ ID NO: 1717 - DNA, 1341 bp, Prevotella sp.
gagtttgatcctggctcaggatgaacgctagctacaggcttaacacatgcaagtcgagggaccggcgcacgggtgagtaacgcgtatccaaccttcccattactgtgggataacctgccggaaggcagactaatacctcatagttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgtaagtctgaaccagccaagtagcgtgcaggatgacggcctatgggttgtaaactgcttttgtatggggatatgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgctgaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgttcggcctagggcaaaactggtaattggggctaagtcgtaacaaggtagccgtaccggaaggtgcgg

SEQ ID NO: 1718 - DNA, 1357 bp, Prevotella sp.
gagtttgattctggctcaggatgaacgctagctacaggcttaacacatgcaagtcgcgggaccggcgcacgggtgagtaacgcgtatccaacctgcccttcaccacgggataacccggcgaaagtcggactaataccgtatgttgaaaggcggtgaaggatggggatgcgtccgattagccagacggcggggtaacggcccaccgtggcgacgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggccgcgccttaagcgtgttgtgaaatccgggtgctcaacatccggcttgcagcgcgaactggggcgcttgagtgcgcagaaagtaggcggaattcgtggtgtagcggtgaaatgcttagatatcacgaggaactccgattgcgaaggcagcctactgtagcgactgacgctgatgctcgaaagcgtgggtatcgaacaggattagataccctggtagtccacgcggtaaacgatggatgctcgttgtcggccggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccccgtcttcagttgccatcggccgggcactctggagatactgccaccgcaaggtggaggaaggtggggatgacgtcaaatcagcacggcccttacgtccggggctacacacgtgttacaatggcgcacagagagtcggtggcatgcgagtgccatccaatcctctgcgtctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctagggtgaaaccggtgattggggctaagtcgtaacaaggtagccgtaccggaaggtgcggctggatcacctcctt

SEQ ID NO: 1719 - DNA, 1357 bp, Prevotella sp.
gagtttgattctggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgcaagtctgaaccagccaagtagcgtgcaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttaaccattgaaactggtagtcttgagtgcagacagggatgctggaactcgtggtgtagcggtgaaatgcttagatatcacgatgaactccgatcgcgaaggcaggtgtccgggctgactgacgctgaggctcgaaagtgtgggtatcacacaggattagataccctggtagtccacacagtaaacgatgtatactcgcggtttgcgagtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttttccttggttgccatcagctgggcactccagggaaactgccatcggtaagatggaggaaggtggggatgacgtcgaatcagcacggcccttacgtccggggctacacacgtgttacaatggggggcagaaggtcgctacctggtgacaggatgctaatctgccctctctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagccgtgtcggcctagggtaaaactggtgattggggctaagtcataacaaggtacccgtaccggaaggtgcggctggaacacctcctt

SEQ ID NO: 1720 - DNA, 1518 bp, Prevotella sp.
gagtttgatcctggctcaggatgaacgctagctacaggcttaacacatgcaagtcgaggggcagcatggaagaagcttgcttcttctgatggcgaccggcgcacgggtgcgtaacgcgtatcaaacctgcctcatactcggggatagccttgcgaaagtaagattaatacccgatgttattagttctccgcatggtggactaatcaaagatttatcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgaaagtctgaaccagccaagtagcgtgcaggatgacggccctccgggttgtaaactgctttcagtcgggaataaaaaaagggacgtgtcccttattgtatgtaccttcagaaaaaggaccggctaattccgtgccagcagccgcggtaatacggaaggtccaggcgttatccggatttattgggtttaaagggagcgtaggcggattgttaagtcagcggttaaagggtgtggctcaaccatacattgccgttgaaactggcgatcttgagtgcagacagggatgccggaattcgtggtgtagcggtgaaatgcttagatatcatgaagaactccgatcgcgaaggcaggtgtccgggctgcaactgacgctgaggctcgaaagtgtgggtatcaaacaggattagataccctggtagtccacacagtaaacgatgtatactcgcggtttgcgatagattgtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactaacggtgacgaatctagagatagatttttcttcggacaccgttggaggtgctgcatggttgtcgtcagctcgtgccgtgaggtgtcggcttaagtgccataacgagcgcaacccttctcctcggttgccatcgggtaatgccgggcactccgtggacactgccatcgtaagatgtgaggaaggtggggatgacgtcaaatcagcacggcccttacgtccggggctacacacgtgttacaatggccggtacagagggatggtgtaatgcaaattgcatcatatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaaactggtgattggggctaagtcgtaacaaggtagccgtaccggaaggtgcggctggaacacctcctt

SEQ ID NO: 1721 - DNA, 1265 bp, Prevotella sp.
gctcaggatgaacgctggctacaggcttaacacatgcaagtcgtgggaccggcgcacgggtgagtaacgcgtatccaacctgccccgcggcaagggataatccgcagaaatgcggtctaataccttatgtgtaaagccgccgcgggatggggatgcgtctgattagatagttggcggggcaacggcccgccaagtcgacgatcagtaggggttccgggaggaaagtcccccacattggaactgagacacggtccagactcctacgggaggcagcagtgaggaatattggtcaatgggcgagagcctgaaccagccaagtagcgtgcaggaagacggcctatgggctgtaaactgcttttatgcggggatatgcaggtaccgcatgaataaggaccggctaattccgtgccagcagccgcggtaatacggaaggtccgggcgttatccggatttattgggtttaaagggagcgcaggctgccggctaagcgtgttgtgaaatgcgggggcccaacctccggcgtgcagcgcggactggccggcttgagtacgcacgacgtcggcggaatttgccgtgtagcggtgaaatgctcagatatggcgaagaactccgattgcgaaggcagctgacgggagcgactgacgctcatgctcgaaagtgcgggtatcgaacaggattagataccctggtagtccgcacggtaaacgctggatgcccgctatatgccggtatgtggccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggctcaagtgccataacgagcgcaacccctttctccggttgccatcggccgggcactccggagagactgccgccgcaaggtggaggaaggcggggatgacgtcaaatcagcacggcccttacgtccggggctacacacgtgttacaatgggcggcagcgagctgggcgggcgcaagcccgtccgaatcatgccgccctcagtccggatggggtctgcaacccgaccccagaagctggattcgctagtaatcgcgcatcagccacggcgcggtgaatacgttcccgggccttgtacacaccgcccgtcaagccatgaaagccgggggtgcctgaagtccgtacc

SEQ ID NO: 1722 - DNA, 1262 bp, Prevotella sp.
caggatgaacgctagctacaggcctaacacatgcaagtcgagggaccggcgcacgggtgagtaacgcgtatccaacctggcctgaggtaagggataatccgcagaaatgtggtctaataccttatgtgcaaagtcgccttaggatggggatgcgtctgattagatagttggcggggcaacggcccaccaagtcatcgatcagtaggggttctgagaggaaagtcccccacattggaactgagacacggtccagactcctacgggaggcagcagtgaggaatattggtcaatgggcgagagcctgaaccagccaagtagcgtgcaggatgacggcctatgggttgtaaactgcttttatgcgggtatatgcaggtaccgcatgaataaggaccggctaattccgtgccagcagccgcggtaatacggaaggttctggtgttatccggatttattgggttwaaagggagcgcaggctgtcagataagcgtgttgtgaaatgcggttgctcaacatccgcactgcagcgcgaactgtttgacttgagtacgcacgacgttggtggaatttgccgtgtagcggtgaaatgcttagatatggcgaagaactccgattgcgaaggcagctgacgggagcgactgacgctcatgctcgaaagtgcgggtatcgaacaggattagataccctggtagtccgcacggtaaacgctggatgcccgctatatgccggtatgtggccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccttttcttcagttgccatcagctgggccctctggagatactgccgccgtaaggtggaggaaggtggggatgacgtcaaatcagcacggcccttacgtccggggctacacacgtgttacaatgggtggcagcgagcagggttaccgcaaggtatcccgaatcattccgccctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1723 - DNA, 1269 bp, Prevotella sp.
tcctggctcaggatgaacgctagctacaggcttaacacatgcaagtcgagggaccggcgcacgggtgagtaacgcgtatccaaccttcccataactaaggaataccccgtagaaatgcggcctaatcccttatggttaaagtcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcggaagcctgaaccagccaagtagcgtgcaggatgacggcctatgggtcgtaaactgctttttaaggtgaatatgcatgtagccttggaataaggaccggctaattccgtgccagcagccgcggtaatacggaaggtccaggtgttatccggatttattgggtttaaagggagcgtaggccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgactgacgctgaagctcgaaagtgcgggtatcgaacaggattagataccctggtagtccgcacggtaaacgctggatgcccgtttttggctagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctttcttcagttgccatcggccgggcactctgtagatactgccgccgtaaggtggaggaaggtggggatgacgtcaaatcagcacggcccttacgtccggggctacacacgtgttacaatggggggcagcgagcgggatgcccgcaaggtcattcaaatcaatcccccctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtac

SEQ ID NO: 1724 - DNA, 1355 bp, Prevotella sp.
gagtttgattctggctcaggatgaacgctagctacaggcttaacacatgcaagtcgcgggaccggcgcacgggtgagtaacgcgtatccaacctacctattaccacgggataacccggcgaaagtcggactaataccgtatgtgtaaagcggtaatagatggggatgcgtccgattagttagttggcggggtaacggcccaccaagacgtcgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcaagaatatgcaggtattgcatgaataaggaccggctaattccgtgccagcagccgcggtaatacggaaggtccgagcgttatccggatttattgggtttaaagggagcgtaggcggccttttaagcgtgttgtgaaattcagttgctcaacatctgacttgcagcgcgaactggggggcttgagtatgctgaaggtaggcggaattcgtggtgtagcggtgaaatgcttagatatcacgaagaactccgattgcgaaggcagcttactgcagctactgacgctgatgctcgaaagcgtgggtatcgaacaggattagataccctggtagtccacgcggtaaacgatggatgctcgttgttggtatatcagtgaccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaactgcggaggtgctgcatggttgtcgtcagctcgtgccgtgaggtgtcggcttaagtgccataacgagcgcaacccctttttatagttgccatcggccgggcactctgtagatactgccgccgaaggtggaggaaggcggggatgacgtcaaatcatcacggcccttacgtccggggctacacacgtgttacaatggcgcgcagcgagttggtgttatgtgagtagcatctaatcctgcgcgcctcagttcggatggggtctgcaacccgaccccagaagctggattcgctagtaatcgcgcatcagccatggcgcggtgaatacgttcccgggccttgtacacaccgcccgtcaagccatgaaagccgggggcgcctgaagtccgtgtcggcctaaggtgaaaccggtgattggggctaagtcgtaacaaggtagccgtaccggaaggtgcggctggatcacctcctt

SEQ ID NO: 1725 - DNA, 1356 bp, Prevotella sp.
gagtttgattctggctcaggatgaacgctagctacaggcttaacacatgcaagtcgagggaccggcgcacgggtgcgtaacgcgtatcaaacctgcctcatactcggggatagccttgcgaaagtaagattaatacccgatgttcaaagtcggtatgagatggtgatgcgtccgattaggtagtaggcggggtaacggcccacctagccttcgatcggtaggggttctgagaggaaggtcccccacactggaactgagacacggtccagactcctacgggaggcagcagtgaggaatattggtcaatggacgaaagtctgaaccagccaagtagcgtgcaggatgacggcctctgggttgtaaactgcttttagttgggaatatgtatgtaccttcagaaaaaggaccggctaattccgtgccagcagccgcggtaatacggaaggtccaggcgttatccggatttattgggtttaaagggagcgtaggcggattattaagtcagtggtgaaagacggtggctcaaccatcgttagccattgaaactggtagtcttgagtgcagacagggatgctggaactcgtggtgtagcggtgaaatgcttagatatcacgatgaactccgatcgcgaaggcaggtgtccgggctgactgacgctgaggctcgaaagtgtgggtatcaaacaggattagataccctggtagtccacacagtaaacgatgtatactcgcggtttgcgtgtaagccgccaagcgaaagcattaagtataccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttttccttggttgccatcagctgggcactccagggatactgccatcgtaagatggaggaaggtggggatgacgtcaaatcagcacggcccttacgtccggggctacacacgtgttacaatggggggcagaaggtcgctacctggtgacaggatgctaatctcacctctctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagccgtgtcggcctagggtaaaactggtgattggggctaagtcgtaacaaggtagccgtaccggaaggtgcggctggatcacctcctt

SEQ ID NO: 1726 - DNA, 1285 bp, Prevotella sp.
gatgaacgctagctacaggcttaacacatgcaagtcgagggaccggcgcacgggtgagtatcgcgtatccaaccttcccattactgtgggataacctgccgaaaggcagactaataccgcatggttaaagtcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatggacgtaagtctgaaccagccaagtagcgtgcaggatgacggcctatgggttgtaaactgcttttacaggggaatatgcatgtaccctgcgaataaggaccggctaattccgtgccagcagccgcggtaatacggaaggtcctggtgttatccggatttattgggtttaaagggagcgtaggccgtagattaagtgtgttgtgaaatgtagtcgcccaacgtctgccttgcagcgcaaactggtttacttgagtacgcacaacgcaggcggaattcgtcgtgtagcggtgaaatgcttagatatgatgaagaactcctattgcgaaggcagcttgcgggagcgactgacgctgaggctcgaaagtgcgggtatcgaacaggattagataccctggtagtccgcacggtaaacgatggatgcccgtttttggctagccagagaccaagcgaaagcattaagcatcccacctggggagtacgccggcaacggtgaaactcaaaggaattgacgggggcccgcacaagcggaggacatgtggttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccggttcggatggggtctgcaacccgaccccagaagctggattcgctagtaatcgcgcatcagccatggcgcggtgaatacgttcccgggccttgtacacaccgcccgtcaagccatgaaagccgggggtgcctgaagttcgtagcgacctagggcaaaactggtgatgggggc

SEQ ID NO: 1727 - DNA, 1508 bp, Prevotella sp.
agagtttgatcctggctcaggatgaacgctagctacaggcttaacacatgcaagtcgaggggaaacgggggaatagcttgctattctttgtcgtcgaccggcgcacgggtgagtaacgcgtatccaaccttcccataactaaggaataccccgtagaaatgcggcctaatcccttatggtctcttatgcctgtcatgggaataagagtaaagatttatcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcgtaagcctgaaccagccaagtagcgtgcaggatgacggccctatgggttgtaaactgctttttaaggtgaataaagaggggcacgcgtgccctgttgcatgtagccttggaataaggaccggctaattccgtgccagcagccgcggtaatacggaaggtccgggtgttatccggatttattgggtttaaagggagcgtagsccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgcaactgacgctgaagctcgaaagtgcgggtatcgaacaggattagataccctggtagtccgcacggtaaacgctggatgcccgtttttggcttattttaagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgccagagacggctccagagatggagcttcccttcggggctctggtgaaggtgctgcatggttgtcgtcagctcgtgccgtgaggtgtcggcttaagtgccataacgagcgcaacccctttcttcagttgccatcgggtaatgccgggcactctgtagatactgccgccgtaaggtgtgaggaaggtggggatgacgtcaaatcagcacggcccttacgtccggggctacacacgtgttacaatggtcggagcagcaggaagctacctggcgacaggatgctgatcccgaaacccggcctcagttcggactggagtctgcaacccgactccacgaagccggattcgctagtaatcgcgcatcagccatggcgcggtgaatacgttcccgggccttgtacacaccgcccgtcaagccatgaaagccgggggtgcctgaaagccgtgaccgcgagggtcggcctagggtaaaaccggtgattggggctaagtcgtaacaaggtagccgtaccggaaggtgc

SEQ ID NO: 1728 - DNA, 1533 bp, Prevotella sp.
ttacaatgtagagtttgatcctggctcaggatgaacgctagctacaggcttaacacatgcaagtcgaggggcagcatgttggttgcttgcaaccaatgatggcgaccggcgcacgggtgagtaacgcgtatccaacctacccaatactcaggcataacccgttgaaagacggactaattcctgatggtatgtatttttctcatgatttatacattaaagaacttcggtattggatggggatgcgtctgattagtttgttggtgaggtaacggctcaccaaggcatcgatcagtaggggttctgagaggaaggtcccccacattggaactgagacacggtccaaactcctacgggaggcagcagtgaggaatattggtcaatggatgaaaatctgaaccagccaagtagcgtgcaggatgacggccctatgggttgtaaactgcttttatgtgagaataaagttaggtatgtatacttatttgcatgtatcacatgaataaggaccggctaattccgtgccagcagccgcggtaatacggaaggtccaggcgttatccggatttattgggtttaaagggtgcgtaggccgtttgataagcgtgctgtgaaatatagtggctcaacctctatcgtgcagcgcgaactgtcgaacttgagtgcgtagtaggtaggcggaattcgtggtgtagcggtgaaatgcttagatatcacgaagaactccgattgcgaaggcagcttaccgtaacgttactgacgcttaagcacgaaggtgcgggtatcgaacaggattagataccctggtagtccgcacagtaaacgatggatgctcgctgttggccttttatggtcagtggcttagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcagctgaacgattcagagatgatgaggcccttcggggcagctgtggaggtgctgcatggttgtcgtcagctcgtgccgtgaggtgtcggcttaagtgccataacgagcgcaaccccttttcttagttgccatcaggtaatgctgggcactctgggaatactgccaccgtaaggtgtgaggaaggtggggatgacgtcaaatcagcacggcccttacgtccggggctacacacgtgttacaatggcgcatacagaatgttggtttcatgcaaatgagatctaatcttcaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctaaagtccgtgaccgcaagggtcggcctagggtgaaactggtgattggggctaagtcgtaacaaggtagccgtaccggaaggtgcggctggaacacctcctttct

SEQ ID NO: 1729 - DNA, 1209 bp, Prevotella sp.
gatgaacgctagctacaggcttaacacatgcaagtcgaggggaaacgggagaatagcttgctattctttgtcgtcgaccggcgcacgggtgagtaacgcgtatccaaccttcccatagctaaggaataccccgtagaaatgcggcctaatcccttatggtctcttatacctgacatcggaataagagtaaagatttatcggttatggatggggatgcgtctgattagcttgctggcggggtaacggcccaccagggcatcgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggtgtgtaaactgctttttaaggtgaataaagaagggcacgtgtgccctgttgcatgtagccttggaataaggaccggctaattccgtgccagcagccgcggtaatacggaaggtccaggtgttatccggatttattgggtttaaagggagcgtaggccgcaggttaagtgtgttgtgaaaagcagtcgcccaacgtctgccttgcagcgcaaactgtcctgcttgagtgcgcacaacgcaggcggaattcgtcgtgtagcggtgaaatgcttagatatgacgaagaactccgattgcgaaggcagcttgcgggagcgcaactgacgctgaagctcgaaagtgcgggtatcgaacaggattagataccctggtagtccgcacggtaaacgctggatgcccgtttttggcttattttaagtcagagaccaagcgaaagcattaagcatcccacctggggagtacgccggcaacggtgaaactcaaaggaattgacgggggcccgcacaagcggaggaacatgtggtttaattcgatgatacgcgaggaaccttacccggggcttgaattgccagagacggctccagagatggagcttcccttcgggggctctggtgacggtgctgcatgggttgtcgtcagctcgtgccgtgaggtgtcagcttaagtgccataacgagcgcaccccctttcttcagttgccatcggggtattgccctggcactctgtaaaatccgccgccgatcgggttgaggaagggtgggactacgtcaaatagcaggccctacgtcgggctaacaggttaaa

SEQ ID NO: 1730 - DNA, 1521 bp, Prevotella sp.
agagtttgatcctggctcaggatgaacgctagctacaggcttaacacatgcaagtcgaggggaaacgacattgaaagcttgcttttaatgggcgtcgaccggcgcacgggtgcgtaacgcgtatcgaacctgccctttactcagggatagccttgcgaaagtaagattaatacctgatagtgttgtgatgaggcatcttgttgcaactaaagatttattggtaaaggatggcgatgcgtctgattaggtagtaggcggggtaacggcccacctagccgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctctgggttgtaaactgcttttagttgggaacaaaaaaggcgacgtgtcgcctctggagtgtaccatcagaaaaaggaccggctaattccgtgccagcagccgcggtaatacggaaggtccaggcgttatccggatttattgggtttaaagggagcgtaggcggacgattaagtcagctgtgaaagtttgcggctcaaccgtaaaattgcagttgaaactggttgtcttgagtgcacgcagggatgttggaattcatggtgtagcggtgaaatgcttagatatcatgaagaactccgatcgcgaaggcatatgtccggagtgcaactgacgctgaggctcgaaagtgcgggtatcgaacaggattagataccctggtagtccgcacagtaaacgatgaatactcgcagtatgcgatatagtgtatgctgccaagtgaaaacgttaagtattccacctggggagtacgccggcaacggtgaaactcaaaggaattgacgggggcccgcacaagcggaggaacatgtggtttaattcgatgatacgcgaggaaccttacccgggcttgaactaagcaggaagatgggcagagaggcctgttgtcttcggacctgcttggaggtgctgcatggttgtcgtcagctcgtgccgtgaggtgtcggcttaagtgccataacgagcgcaacccttctccacgtttgccatcaggtagagctgggcactccgtggatactgccatcgtaagatgtgaggaaggtggggatgacgtcaaatcagcacggcccttacgtccggggctacacacgtgttacaatggccggtacagagggaagccaccaggcgactgggcgctgatccattaaaaccggtctcagttcggactggagtctgcaacccgactccacgaagctggattcgctagtaatcgcgcatcagccatggcgcggtgaatacgttcccgggccttgtacacaccgcccgtcaagccatgaaagccgggggtgcctgaaagctgtgaccgtaaggggcggcctagggtaaaaccggtgattggggctaagtcgtaacaaggtagccgtaccggaaggtgcggctggaacacct

SEQ ID NO: 1731 - DNA, 1505 bp, Prevotella sp.
gagtttgatcctggctcaggatgaacgctagctacaggcttaacacatgcaagtcgaggggaaacggcatttagtgcttgcaccgaatggacgtcgaccggcacacgggtgagtaacgcgtatccaaccttcccacaactaagggataacctgccgaaaggcagactaataccttatgtaatcctttgatggcatcagataaggataaaagatttatcggtaaaggatggggatgcgtctgattagcttgttggtgaggtaaaggctcaccaaggcgacgatcagtaggggttctgagaggaaggtcccccacattggaactgagacacggtccaaactcttacgggaggcagcagtgaggaatattggtcaatgggcggaagcctgaaccagccaagtagcgtgcaggaagacggccctatgggttgtaaactgcttttatacgagaataatttgatgcacgtgtgcgttattgcatgtatcgtatgaataaggaccggctaattccgtgccagcagccgcggtaatacggaaggtccaggcgttatccggatttattgggtttaaagggagtgtaggcggtttgttaagcgtgttgtgaaatttaggtgctcaacatttaacttgcagcgcgaactgtcagtcttgagtacacgcaacgtatgcggaattcatggtgtagcggtgaaatgcttagatatcatgaagaactccgattgcgaaggcagcatacgggagtgtaactgacgcttaagctcgaaggtgcgggtatcgaacaggattagataccctggtagtccgcacagtaaacgatggatgcccgctgttagcgcctggcgttagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaattatttagagataaatacgcccttcggggtctctgtgaaggtgctgcatggttgtcgtcagctcgtgccgtgaggtgtcggcttaagtgccataacgagcgcaaccccttttcttagttgccatcaggtaatgctgggcactctgggaacactgccaccgcaaggtgtgaggaaggtggggatgacgtcaaatcagcacggcccttacgtccggggctacacacgtgttacaatggccggtacagagggatggtgtaatgcaaattgcatcaaatcttaaaagccggtcccagttcggactgaggtctgcaacccgacctcacgaagctggattcgctagtaatcgcgcatcagccatggcgcggtgaatacgttcccgggccttgtacacaccgcccgtcaagccatgaaagccgggggtgcctgaagttcgtaaccgtaaggagcgacctagggcaaaactggtaattggggctaagtcgtaacaaggtagccgtaccggaaggtgc

SEQ ID NO: 1732 - DNA, 1534 bp, Prevotella sp.
ttacaatggagagtttgatcctggctcaggatgaacgctagctacaggcttaacacatgcaagtcgcggggcagcatgggggttgcttgcaatccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagctcgacggcggggtaacggcccaccgtggcgacgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatgcggggataaaggagcccacgtgtgggctttttgcaggtaccgcatgaataaggaccggctaattccgtgccagcagccgcggtaatacggaaggtccgggcgttatccggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttgaggccggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcgggttatgccgggcactctggagatactgccaccgcaaggtgtgaggaaggtggggatgacgtcaaatcagcacggcccttacgtccggggctacacacgtgttacaatggcgcatacagagagtaggtggcatgcgaatgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgcggctggaacacctcctttct

SEQ ID NO: 1733 - DNA, 1434 bp, Prevotella sp.
tggcgaccggcgcacgggtgagtaacgcgtatccaacctgcccttcaccacgggataacccggcgaaagtcggactaataccgtatgttgtccattgacggcatccgatttggacgaaaggctttgcggtgaaggatggggatgcgtccgattagctggacggcggggtaacggcccaccgtggctacgatcggtaggggttctgagaggaaggtcccccacactggaactgagacacggtccagactcctacgggaggcagcagtgaggaatattggtcaatgggcgtaagcctgaaccagccaagtagcgtgcaggatgacggccctatgggttgtaaactgcttttatgcggggataaagtggcccacgtgtgggtttttgcaggtaccgcatgaataaggaccggctaattccgtgccagcagccgcggtaatacggaaggtccgggcgttatccggatttattgggtttaaagggagcgtaggccgcgccttaagcgtgttgtgaaatccgggtgctcaacatccggcttgcagcgcgaactggggcgcttgagtgcgctgaaagtaggcggaattcgtggtgtagcggtgaaatgcttagatatcacgaggaactccgattgcgaaggcagcctactgtagcgctactgacgctgatgctcgaaagcgtgggtatcgaacaggattagataccctggtagtccacgcggtaaacgatggatgctcgttgtcggcccttcgggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattcggagacgatgaggcccttcggggccgccgcggaggtgctgcatggttgtcgtcagctcgtgccgtgaggtgtcggcttaagtgccataacgagcgcaacccccgtcttcagttgccatcgggtgatgccgggcactctggagatactgccaccgcaaggtgcgaggaaggtggggatgacgtcaaatcagcacggcccttacgtccggggctacacacgtgttacaatggcgcatacagagagtcggtggcatgcgaatgccatccaatcctcaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgcggctggaacacctcctttct

SEQ ID NO: 1734 - DNA, 1504 bp, Prevotella sp.
gagtttgatcctggctcaggatgaacgctagctacaggcttaacacatgcaagtcgcggggcagcatgttggttgcttgcaaccgatgatggcgaccggcgcacgggtgagtaacgcgtatccaacctacctattaccacgggataacccggcgaaagtcggactaataccgtatgtagtcctccaatggcatcagcagtggactaaaggtttggcggtaatagatggggatgcgtccgattagctagttggtgaggtaatggctccccaaggcttcgatcggtaggggttctgagaggaaggtcccccacactggaactgagacacggtccagactcctacgggaggcagcagtgaggaatattggtcaatggacgagagtctgaaccagccaagtagcgtgcaggatgactgccctatgggttgtaaactgcttttatgcggggataaagtgaggaacgtgttctctattgcaggtaccgcatgaataaggaccggctaattccgtgccagcagccgcggtaatacggaaggttcaggcgttatccggatttattgggtttaaagggagcgtaggccgttttttaagcgtgttgtgaaatgtaccggctcaaccggtgatgtgcagcgcgaactggaagacttgagtgcgtagtaagcaggcggaattcgtggtgtagcggtgaaatgcttagatatcacgaagaactccgatagcgcaggcagcttgctgcatcgcaactgacgctgatgctcgaaagcgtgggtatcaaacaggattagataccctggtagtccacgcggtaaacgatggatgctcgttgtcaggcctttgggtttggtgaccaagtgaaaacgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattcagagatgatgaggtccttcgggactgccgcggaggtgctgcatggttgtcgtcagctcgtgccgtgaggtgtcggcttaagtgccataacgagcgcaaccccttttcttagttgccatcgggtaatgccgggcactctgggaatactgccaccgtaaggtgtgaggaaggtggggatgacgtcaaatcagcacggcccttacgtccggggctacacacgtgttacaatggcgcatacagatagttggttgtgtgcaaacatgatctaatctttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctgaagtccgtgaccgcgagggtcggcctagggtgaaaccggtgattggggctaagtcgtaacaaggtagccgtaccggaaggtgc

SEQ ID NO: 1735 - DNA, 1505 bp, Prevotella sp.
gagtttgatcctggctcaggatgaacgctagctacaggcttaacacatgcaagtcgaggggaaacggcgttgagtgcttgcactcttcggacgtcgaccggcgcacgggtgagtaacgcgtatccaaccttcccatgactgggggataacctgccgaaaggcagactaataccccatggtcttcactgacggcatcatatgtgaagtaaagattcatcggtcatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatgggcgcaagcctgaaccagccaagtagcgtgcaggacgacggccctatgggttgtaaactgcttttgtacggggataaaacggcggacgcgtccgtccttgcaggtaccgtacgaataaggaccggctaattccgtgccagcagccgcggtaatacggaaggtccgggcgttatccggatttattgggtttaaagggagcgtaggccggggattaagtgtgttgtgaaatgtagacgctcaacgtctgacttgcagcgcatactggttcccttgagtacgcacaacgtcggcggaattcgtcgtgtagcggtgaaatgcttagatatgacgaagaactccgattgcgaaggcagctgacgggagcgcaactgacgcttaagctcgaaggtgcgggtatcgaacaggattagataccctggtagtccgcacggtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcaggagaacgatacagagatgttgaggtccttcgggactcctgtgaaggtgctgcatggttgtcgtcagctcgtgccgtgaggtgtcggcttaagtgccataacgagcgcaacccctctcttcagttgccatcaggttatgctgggcactctggagacactgccaccgtaaggtgtgaggaaggtggggatgacgtcaaatcagcacggcccttacgtccggggctacacacgtgttacaatggccggtacagagggacggtgcaacgcaagttgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccggaaggatcggcctagggcaaaactggtgattggggctaagtcgtaacaaggtagccgtaccggaaggtgc

SEQ ID NO: 1736 - DNA, 1386 bp, Prevotella sp.
agagtttgatcctggctcaggatgaacgctggctacaggcttaacacatgcaagtcgtggggaaacgattggaggcgcttgcgcctctgaggcgtcgaccggcgcacgggtgagtaacgcgtatccaacctgccccgcggcaagggataatccgcagaaatgcggtctaataccttatgtgctccgaagaggacatctgattcggagcaaaggcttgccgccgcgggatggggatgcgtctgattagatagtaggcggggtaacggcccacctagtcgtcgatgggtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttatacgggaataaagtttgccacgtgtggcattttgcatgtaccgtaagaaaaaggatcggctaattccgtgccagcagccgcggtaatacggaagatccgagcgttatccggatttattgggtttaaagggagcgtaggcgggaatccaagtcagttgtgaaaccctgcggctcaaccgtagtcgtgcagttgaaactggatttcttgagtgcgcacagggcagacggaatttgtggtgtagcggtgaaatgcttagatatcacgaagaactccgatcgcgaaggcagtctgccggggcgctactgacgctgaggctcgaaagtgcgggtatcaaacaggattagataccctggtagtccgcactgtaaacgatggatacccgtggtcggttttttttattcggtcaccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaattgcagaggaagtcaccggagacggtgatgtctttatagtctctgtgaaggtgctgcatggttgtcgtcagctcgtgccgtgaggtgtcggcttaagtgccataacgagcgcaacccctttttccggttgccatcaggtgatgctgggcactccggagacactgccatcgtaagatgtgaggaaggtggggatgacgtcaaatcagcacggcccttacgtccggggctacacacgtgttacaatggccggtacagaaggcagctcccacgcgagtggttgcgaatcccgaaagccggtcccagttcggactggagtctgcaacccgactccacgaagctggattcgctagtaatcgcgcatcagccacggcgcggtgaatacgttcccgggccttgtac

SEQ ID NO: 1737 - DNA, 1216 bp, Prevotella sp.
gatgaacgctagctacaggcttaacacatgcaagtcgaggggaaacgatgagagagcttgctctctcaggcgtcgaccggcgcacgggtgagtaacgcgtatccaacctgcccattacaggggaataaccttgcgaaagtaagactaatgccccatggtattctcagcagacatctaatgaggattaaagatttatcggtaatggatggggatgcgtctgattagcttgttggcggggtaacggcccaccaaggcaacgatcagtaggggttctgagaggaaggtcccccacattggaactgagacacggtccaaactcctacgggaggcagcagtggggaatattggtcaatggacgagagtctgaaccagccaagtagcgtgcaggatgacggccctatgggttgtaaactgcttttataggggaataaagtgatctacgtgtagtttattgtatgtaccctatgaataaggaccggctaattccgtgccagcagccgcggtaatacggaaggttcgggcgttatccggatttattgggtttaaagggagcgtaggccgtagattaagcgtgttgtgaaatgtagatgctcaacatctgacttgcagcgcgaactggtttactagagtgtgcacaacgtaggcggaattcgtcgtgtagcggtgaaatgcttagatatgacgaagaactccgattgcgaaggcagcttacgggagcacaactgacgctgaagctcgaaggtgcgggtatcaaacaggattagataccctggtagtccgcacagtaaacgctggatgcccgctgttggttcattagagtcagcggccaagcgaaagcattaagcatcccacctggggagtacgccggcaacggtgaaactcaaaggaattgacgggggcccgcacaagcggaggaacatgtggtttaattcgatgatacgcgaggaaccctaccccgggcctgaaattgcagacgaacgcggcagagatgccaagggcccttcggggcgtctgtgaaggtgctgcattggtgtcgtcagctcgtgccgtgaggtgtcggcctaagtgccataacgagcgcaaccccttttcttagttgccatcagggtcatgcctgggcactcatggaaaatccgcccacgataggggtgtaggaacgggtgggaaatacgttcaaatcaccacggcccttacgttcgggggcctacacctgtta

SEQ ID NO: 1738 - DNA, 1211 bp, Prevotella sp.
gatgaacgctggctacaggcttaacacatgcaagtcgaggggaaacggcattgagtgcttgcactgaatggacgtcgaccggcgcacgggtgagtaacgcgtatccaaccttcccgttactgcgggataacctgccgaaaggcagactaataccgcatgttcttcgatgacggcatcagattcgaagcaaagatccgtcggtaacggagggggatgcgtctgattagctggttggcggggcgacggcccaccaaggcgacgatcagtaggggttctgagaggaaggtcccccacattggaactgagacacggtccaactcctacgggaggcagcagtgaggaatattggtcaatgggcggaagcctgaaccagccaagtagcgtgcaggaggacggccctacgggtgtgtaaactgcttttatgcggggataaagtgagggacgcgtccctttttgcaggtaccgcatgaataaggaccggctaattccgtgccagcagccgcggtaatacggaaggtccgggcgttatccggatttattgggtttaaagggagcgtaggccgtggattaagcgtgttgtgaaatgcaggtgctcaacgtctgcactgcagcgcgaactggtccacttgagtgtgcgcaacgcaggcggaattcgtcgtgtagcggtgaaatgcttagatatgacgaagaactccgattgcgaaggcagcttgcgggagcacaactgacgctgaagctcgaaagtgcgggtatcgaacaggattagataccctggtagtccgcacggtaaacgatggatgcccgttgtcaggctgtttcagcctggtgaccaagcgagagcattaagcatcccacctggggagtacgccggcaacggtgaaactcaaaggaattgacgggggcccgcacaagcggaggatcatgtggtttaattcgatgatacgcgaggaacctgacccggggcttgaattgcagacgaacgattcagagatgatgaggcccttcggggcgtctgtgacaggtgctgcatgggttgtcgtcagctcgtgccgtgaggtgtcagcctaaagtgccatagcgagcgccagcccctttcttcagtttgcacagggtgatgcctgggcactctgaaaaccctgccaccgcaagggtgtgaggaagggtggcaatacgtcaaacaccacgaccctacgttcggggcaacacagttt

SEQ ID NO: 1739 - DNA, 1218 bp, Prevotella sp.
gatgaacgctagctacaggcttaacacatgcaagtcgaggggaaacggcgaagggtgcttgcactctccggacgtcgaccggcgcacgggtgagtaacgcgtatccaaccttcccatgaccgggggataacctgccgaaaggcagactaataccccatggccttcactgacggcatcatatgtgaagtaaagattcatcggtcatggatggggatgcgtctgattagcttgttggcggggaaacggcccaccaaggcgacgatcagtaggggttctgagaggaaggtcccccacattggaactgagacacggtccaaactcctacgggaggcagcagtgaggaatattggtcaatgggcgcaagcctgaaccagccaagtagcgtgcaggatgacggccctatgggttgtaaactgcttttgtacggggataaaacggcggacgtgtccgtccttgcaggtaccgtacgaataaggaccggctaattccgtgccagcagccgcggtaatacggaaggtccgggcgttatccggatttattgggtttaaagggagcgtaggccggggattaagtgtgttgtgaaatgtagacgctcaacgtctgacttgcagcgcatactggttcccttgagtacgcacaacgttggcggaattcgtcgtgtagcggtgaaatgcttagatatgacgaagaactccgattgcgaaggcagctgacgggagcgcaactgacgcttaagctcgaaggtgcgggtatcgaacaggattagataccctggtagtccgcacggtaaacgatggatgcccgctgttggtacctggtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccggggcttgaattgcaagagaacgatacaagagatgttgagggtccttcgggactcctgtgaaggtgctgcatggttgtcgtcagctcgtgccgtgaggtgtcggcctaagtgccataccgaggcgcaccccctctcttcagttgcccatcaaggtattgcctggcacctcttggaaacccggtgccacccttaggggtttaggaaagggtggggagttacgttaaattccccacgggcctttactttcgggggcctcacct

SEQ ID NO: 1740 - DNA, 1374 bp, Prevotella sp.
tgcaagtcgcggggcagcatgagggttgcttgcaacctttgatggcgaccggcgcacgggtgagtaacacgtatccaacctactccttacaacggaataacccggcgaaagtcggactaataccgtatgatatcctatgcaggcatctaaytaggattaaaggtttagcggtaagggatggggatgcgtctgattaggcagttggcggggtaacggcccaccaaaccgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttatacggggataaagttagggacgtgtccctatttgcaggtaccgtatgaataaggaccggctaattccgtgccagcagccgcggtaatacggaaggtccgggcgttatccggatttattgggtttaaagggagcgtaggccgtagattaagtgtgttgtgaaatgtagacgctcaacgtctgacttgcagcgcatactggtttacttgagtttgcacaacgttggcggaattcgtcgtgtagcggtgaaatgcttagatatgacgaagaactccgattgcgaaggcagcttgcgggagcaaaactgacgctgaagctcgaaagtgcgggtatcgaacaggattagataccctggtagtccgcacggtaaacgatggatgcccgttgtatggcctttcggctatgtgaccaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaactgtaggygaacgatctagagatagtgaggcccttcggggcgcctacggaggtgctgcatggttgtcgtcagctcgtgccgtgaggtgtcggcttaagtgccataacgagcgcaacccctgttctcagttgccatcgggtgatgccgggcactctgaggatactgcctccgcaaggagtgaggaaggtggggatgacgtcaaatcagcacggcccttacgtccggggctacacacgtgttacaatggccggtacagagcgtcggtcgtatgcaaatacgatctaatctttaaaaccggtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctg

SEQ ID NO: 1741 - DNA, 1227 bp, Prevotella sp.
agtcgagggaccggcgcacgggtgagtaacgcgtatccaacctwcccattactgtgggataacctgccgaaaggcagactaataccgcatrgttaaagtcggtaatggatggggatgcgtctgattagcttgttggcggggtaacggcccaccaaggcaacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctatgggttgtaaactgcttttgtatggggatatgcaggtaccatacgaataaggaccggctaattccgtgccagcagccgcggtaatacggaaggtccgggcgttatccggatttattgggtttaaagggagcgtaggcyggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcgaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggatggtgtaatgcaaattgcatcaaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1742 - DNA, 1273 bp, Prevotella sp.
tgatcctggctcaggatgaacgctagctacaggcttaacacatgcaagtcgcgggaccggcgcacgggtgagtaacgcgtatccaaccttcccattactacggcataccccgttgaaaggcggcctaattccgtatgcagaaagtcggtaatggatggggatgcgtccgattagccagtcggcggggtaacggcccaccgaggcatcgatcggtaggggttctgagaggaaggtcccccacactggaactgagacacggtccagactcctacgggaggcagcagtgaggaatattggtcaatgggcgtaagcctgaaccagccaagtagcgtgcaggatgacggcctatgggttgtaaactgcttttatgcggggatatgcaggtaccgcatgaataaggaccggctaattccgtgccagcagccgcggtaatacggaaggtccgggcgttatccggatttattgggtttaaagggagcgtaggcagttttttaagcgtgctgtgaaatgtaccggctcaaccggtgatgtgcagcgcgaactgggaatcttgagtacgcagtaagcaggcggaattcgtggtgtagcggtgaaatgcttagatatcacgaagaactccgattgcgtaggcagcttgctgtagcgactgacgctgaagctcgaaagtgcgggtatcgaacaggattagataccctggtagtccgcacggtaaacgatggatgcccgctgtcggtcggtcggtggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtggaggtgctgcatggttgtcgtcagctcgtgccgtgaggtgtcggcttaagtgccataacgagcgcaaccccttttttcagttgccatcggccgggcactctgtgaatactgccgccgtaaggtggaggaaggtggggatgacgtcaaatcagcacggcccttacgtccggggstacacacgtgttacaatggcgcgcagcgagtcggccgtatgtaaatacggtccaatccttcgcgcctcagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1743 - DNA, 1274 bp, Prevotella sp.
ttgatcctggctcaggatgaacgctagctacaggcttaacacatgcaagtcgagggaccggcgcacgggtgagtaacgcgtatccaactttcccattactgtggaataacctgccgaaaggcagactaataccgcatagttaaagtcggtaatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggcctatgggttgtaaactgcttttgtatggggatatgcaggtaccatacgaataaggaccggctaattccgtgccagcagccgcggtaatacggaaggtccaggcgttatccggatttattgggtttaaagggagcgtaggccggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgactgacgcttaagctcgaaggtgcgggtatcaaacaggattagataccctggtagtccgcacagtaaacgatggatgcccgctgttggtatatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgtgaaggtgctgcatggttgtcgtcagctcgtgccgtgaggtgtcggcttaagtgccataacgagcgcaacccctctcttcagttgccatcagctgggcactctggagacactgccaccgtaaggtggaggaaggtggggatgacgtcaaatcagcacggcccttacgtccggggctacacacgtgttacaatggccggcagagggacggtgtaatgcaaattgcatccaatcttgccggtcccagttcggatggggtctgcaacccgaccccagaagctggattcgctagtaatcgcgcatcagccatggcgcggtgaatacgttcccgggccttgtacacaccgcccgtcaagccatgaaagccgggggtgcctgaagtccgtacc

SEQ ID NO: 1744 - DNA, 1340 bp, Prevotella sp.
cccctgatggcgaccggcgcacgggtgagtaacgcgtatccaacctgcccttcaccacgggataacccggcgaaagtcggactaataccgtatgttgtccattgacggcatccgatttggacgaaaggcttagcggtgagggatggggatgcgtccgattagcttgacggcggggtaacggcccaccgtggcaacgatcggtaggggttctgagaggaaggtcccccacactggaactgagacacggtccagactcctacgggaggcagcagtgaggaatattggtcaatgggcggaagcctgaaccagccaagtagcgtgcaggatgacggccctatgggttgtaaactgcttttatgcggggataaaggggcccacgtgtgggtttttgcaggtaccgcatgaataaggaccggctaattccgtgccagcagccgcggtaatacggaaggtccgggcgttatccgggatttattgggtttaaagggagcgtaggccgccccttaagcgtgttgtgaaatgcgggtgctcaacatccgacttgcagcgcgaactggggggcttgagtgcgccgaaagtaggcggaattcgtggtgtagcggtgaaatgcttagatatcacgaagaactccgattgcgaaggcagcttactgtagcgcaactgacgctgatgctcgaaagcgtgggtatcgaacaggattagataccctggtagtccacgcggtaaacgatggatgctcgttgtcggcctttatggtcggtgaccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgcggcggaacgattccgagaggatgaggcccttcggggctgccgcggaggtgctgcatggttgtcgtcagctcgtgccgtgaggtgtcggcttaagtgccataacgagcgcaacccccgtcttcagttgccatcgggttatgctgggcactctggagatactgccaccgcaaggtgtgaggaaggtggggacgacgtcaaatcagcacggcccttacgtccggggctacacacgtgttacaatggcgcatacagagagtaggtggcatgcgaatgccatccaatccttaaagtgcgtctcagttcggactggggtctgcaacccgaccccacgaagctggattcgctagtaatcgcgcatcagccatggcgcggtgaatacgttcccgggccttgtacacaccgcccgtcaagccatgaaagccgggggggcggcc

SEQ ID NO: 1745 - DNA, 1433 bp, Prevotella sp.
atgcaagtcgaggggcagcatgatcgaagcttgctttgattgatggcgaccggcgcacgggtgagtaacgcgtatccaaccttccctttagtagaggatagcccggcgaaagtcggattaatactctatattgtatttagaagacatctgaagaataccaaaggtttaccgctaaaggatggggatgcgtctgattaggttgttggcggggtaacggcccaccaagcctacgatcagtaggggttctgagaggaaggtcccccacattggaactgagacacggtccaaactcctacgggaggcagcagtgaggaatattggtcaatggacgaaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaatacggaaggtccaggcgttatccggatttattgggtttaaagggagcgcaggctgatgattaagcgtgacgtgaaatgtagccgctcaacggctgtactgcgtcgcgaactggttatcttgagtgagttcgatgttggcggaattcgtggtgtagcggtgaaatgcttagatatcacgaagaactccgattgcgaaggcagccaacaaggcctttactgacgctaaagctcgaaggtgcgggtatcgaacaggattagataccctggtagtccgcacggtaaacgatggatgcccgctgtttgcgatatactgtgagcggccaagagaaatcgttaagcatcccacctggggagtacgccggcaacggtgaaactcaaaggaattgacgggggcccgcacaagcggaggaacatgtggtttaattcgatgatacgcgaggaaccttacccgggcttgaactgcagcggaaggatacagagatgttgacgccttcggggccgctgtggaggtgctgcatggttgccgtcagctcgtgccgtgaggtgtcggcttaagtgccataacgagcgcaacccttttctttagttgccatcaggtaatgctgggcactctggagatactgccaccgtaaggtgtgaggaaggtggggatgacgtcaaatcagcacggcccttacgtccggggctacacacgtgttacaatgggaggtacagagagctggatgtacgcaagtacgttctaatcctaaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaa

SEQ ID NO: 1746 - DNA, 1433 bp, Prevotella sp.
atgcaagtcgaggggcagcatgatcgaagcttgctttgattgatggcgaccggcgcacgggtgagtaacgcgtatccaaccttccctttagtagaggatagcccggcgaaagtcggattaatactctatgttgtatttagaagacatctgaagaataccaaaggtttaccgctataggatggggatgcgtctgattaggttgttggcggggtaacggcccaccaagcctacgatcagtaggggttctgagaggaaggtcccccacattggaactgagactcggtccaaactcctacgggaggcagcagtgaggaatattggtcaatggacgaaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaatacggaaggtccaggcgttatccggatttattgggtttaaagggagcgcaggctgatgattaagcgtgacgtgaaatgtagccgctcaacggctgaactgcgtcgcgaactggttatcttgagtgagttcgatgttggcggaattcgtggtgtagcggtgaaatgcttagatatcacgaagaactccgattgcgaaggcagccaacaaggcctttactgacgctaaagctcgaaggtgcgggtatcgaacaggattagataccctggtagtccgcacggtaaacgatggatgcccgctgtttgcgatatactgtgagcggccaagagaaatcgttaagcatcccacctggggagtacgccggcaacggtgaaactcaaaggaattgacgggggcccgcacaagcggaggaacatgtggtttaattcgatgatacgcgaggaaccttacccgggcttgaactgcagcggaaggatacagagatgttgacgccttcggggccgctgtggaggtgctgcatggttgtcgtcagctcgtgccgtgaggtgtcggcttaagtgccataacgagcgcaacccttttctttagttgccatcaggtaatgctgggcactctggagatactgccaccgtaaggtgtgaggaaggtggggatgacgtcaaatcagcacggcccttacgtccggggctacacacgtgttacaatgggaggtacagagagctggatgtacgcaagtacgttctaatcctaaaagccttcctcagttcggattggggtctgcaacccgaccccatgaagctggattcgctagtaatcgcgcatcagccatggcgcggtgaatacgttcccgggccttgtacacaccgcccgtcaagccatgaaagccgggggcgcttgaagtccgtgaccgcaaggatcggcctagagcgaaactggtaattggggctaagtcgtaa

SEQ ID NO: 1747 - DNA, 1488 bp, Prevotella stercorea
agagtttgatcctggctcaggatgaacgctagctacaggcttaacacatgcaagtcgaggggcagcatgtcggttgcttgcaaccgatgatggcgaccggcgcacgggtgagtaacgcgtatccaacctacccttgtccatcggataacccgtcgaaaggcggcctaacacgatatgcggttcacagcaggcatctaacgtgaacgaaatgtgaaggagaaggatggggatgcgtctgattagcttgttggcggggtaacggcccaccaaggctacgatcagtaggggttctgagaggaaggtcccccacattggaactgagacacggtccaaactcctacgggaggcagcagtgaggaatattggtcaatggacgagagtctgaaccagccaagtagcgtgcaggatgacggccctatgggttgtaaactgcttttatagggggataaagtgtgccacgtgtggcatattgcaggtaccctatgaataaggaccggctaattccgtgccagcagccgcggtaatacggaaggtccgggcgttatccggatttattgggtttaaagggagcgtaggccgtttggtaagcgtgttgtgaaatgtcggggctcaacctgggcattgcagcgcgaactgccagacttgagtgcgcaggaagtaggcggaattcgtcgtgtagcggtgaaatgcttagatatgacgaagaactccgattgcgaaggcagcctgctgtagcgcaactgacgctgaagctcgaaagcgtgggtatcgaacaggattagataccctggtagtccacgcggtaaacgatggatgctcgctgtttgcgtctgacgtaagcggccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtaggcgaacgattcagagatgatgaggcccttcggggcgcctatggaggtgctgcatggttgtcgtcagctcgtgccgtgaggtgtcggcttaagtgccataacgagcgcaacccttgttcgtagttgccatcgggtgatgccgggcactctgcgaagactgcctccgtaaggagtgaggaaggtggggatgacgtcaaatcagcacggcccttacgtccggggctacacacgtgttacaatggcatgtacagaaagcggggtgtatgcaaatacgctcgaatccctaaaacatgtctcagttcggactggggtctgcaacccgaccccacgaagctggattcgctagtaatcgcgcatcagccatggcgcggtgaatacgttcccgggccttgtacacaccgcccgtcaagccatgaaagccgggggcgcctaaagtccgtgaccgcgagggtcggcctagggtgaaaccggtgattggggctaagtcgtaacaaggtaacc

SEQ ID NO: 1748 - DNA, 1533 bp, Prevotella tannerae
tacaatgtagagtttgatcctggctcaggatgaacgctggctacaggcttaacacatgcaagtcgtggggcagcggatgcttagcttgctaagtatgccggcgaccggcgcacgggtgagtaacgcgtaccgaacctgcccatcacacagggataggcttgcgaaagcaagattaatactgatggtctcagttgtatgcatgtatgattgagtaaagccttcgggcggtgatggatggcggtgcgtcccattaggacgttggcggggtaacggcccaccaatccttcgatgggtaggggttctgagaggaaggtcccccacattggaactgagatacggtccaaactcctacgggaggcagcagtgaggaatattggtcaatgggcgagagcctgaaccagccaagtagcgtgcgggatgaaggcccttgtggtcgtaaaccgcttttatcagtgaataaagtgcaccacgtgtggtgtcattgcaggtagctgaagaaaaaggaccggctaattccgtgccagcagccgcggtaatacggaaggtccgggcgttatccggaattattgggtttaaagggagcgcaggcgggagtataagtcagctgttaaatatcagagcccaactctgttatgcagttgaaactatatttcttgagtacgcacagggatggcggaattcagggtgtagcggtgaaatgcttagatatcctgaagaactccgatcgcgaaggcagccatccggagcgtaactgacgctgaggctcgaaggtgcgggtatcgaacaggattagataccctggtagtccgcacggtaaacgatgaatactcgcagttcggccgtttaggtcgagttgtccagcgaaagcgttaagtattccacctggggagtacgccggcaacggtgaaactcaaaggaattgacgggggcccgcacaagcggaggaacatgtggtttaattcgatgatacgcgaggaaccttacccgggcttgaaccaagagtgcggagtgcagagatgcgctttttcttcggacacttttggaggtgctgcatggttgtcgtcagctcgtgccgtgaggtgtcggcttaagtgccataacgagcgcaacccttttctacgtttgccatcgggtaatgccgggaactccgtggatactgccgccgcaaggcggaggaaggtggggatgacgtcaaatcagcacggcccttacgtccggggctacacacgtgttacaatggtcggagcagcaggaagctacctggcgacaggatgctgatcccaaaacccggcctcagttcggactggagtctgcaacccgactccacgaagccggattcgctagtaatcgcgcatcagccatggcgcggtgaatacgttcccgggccttgtacacaccgcccgtcaagccatgaaagccgggggtgcctgaaagccgtgaccgcgagggtcggcctagggtaaaaccggtgattggggctaagtcgtaacaaggtagccgtaccggaaggtgcggctggaacacctcctttct

SEQ ID NO: 1749 - DNA, 1536 bp, Prevotella timonensis
ttacaatgtagagtttgatcctggctcaggatgaacgctagctacaggcttaacacatgcaagtcgcagggtaacatgaggaaagcttgctttccttgatgacgactggcgcacgggtgagtaacgcgtatccaaccttcccataactacgggataacccgttgaaagacggcctaataccgtatgacatcgtttgctgacatcaaataacgattaaaggtttagcggttatggatggggatgcgtctgattagcttgttggcggggtaacggcccaccaaggcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatgtggggataaagtgcgtgacgtgtcatgcattgcaggtaccacatgaataaggaccggctaattccgtgccagcagccgcggtaatacggaaggtccgggcgttatccggatttattgggtttaaagggagcgtaggctgtctattaagcgtgttgtgaaatttaccggctcaaccggtggcttgcagcgcgaactggtcgacttgagtatgcaggaagtaggcggaattcatggtgtagcggtgaaatgcttagatatcatgacgaactccgattgcgcaggcagcttactgtagcataactgacgctgatgctcgaaagtgcgggtatcaaacaggattagataccctggtagtccgcacggtaaacgatggatgctcgctattcgtcctatttggatgagtggccaagtgaaaacattaagcatcccacctggggagtacgccggcaacggtgaaactcaaaggaattgacgggggcccgcacaagcggaggaacatgtggtttaattcgatgatacgcgaggaaccttacccgggcttgaactgccagcgaacgatacagagatgttgaggcccttcggggcgctggtggaggtgctgcatggttgtcgtcagctcgtgccgtgaggtgtcggcttaagtgccataacgagcgcaacccttttctttagttgccatcaggtgatgctgggcactctatggatactgccaccgtaaggtgtgaggaaggtggggatgacgtcaaatcagcacggcccttacgtccggggctacacacgtgttacaatggggcatacagagtgttggcttaacgcaagtttggtctaatcttcaaagtgtctcccagttcggattggggtctgcaacccgaccccatgaagctggattcgctagtaatcgcgcatcagccatggcgcggtgaatacgttcccgggccttgtacacaccgcccgtcaagccatgaaagctgggggtgcctgaagtccgtaaccgttaaggagcggcctagggcaaaactggtgattggggctaagtcgtaacaaggtagccgtaccggaaggtgcggctggaacacctcctttct

SEQ ID NO: 1750 - DNA, 1531 bp, Prevotella veroralis
tacaatggagagtttgatcctggctcaggatgaacgctagctacaggcttaacacatgcaagtcgaggggaaacggcgttgagtgcttgcactcttcggacgtcgaccggcgcacgggtgagtaacgcgtatccaaccttcccataactaagggataacctgccgaaaggcagactaataccttatgtaattcttagatgacatcagaagagaatgaaagatttatcggttatggatggggatgcgtctgattagcttgttggtggggtaacagcccaccaaggcaacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttgtatggggataaagtcaatcacgtgtgattgtttgcaggtaccatacgaataaggaccggctaattccgtgccagcagccgcggtaatacggaaggttcgggcgttatccggatttattgggtttaaagggagcgtaggccggagattaagtgtgttgtgaaatgtagacgctcaacgtctgacttgcagcgcatactgttttccttgagtacgcacaacgttggcggaattcgtcgtgtagcggtgaaatgcttagatatgacgaagaactccgattgcgaaggcagctgacgggagcgccactgacgcttaagctcgaaggtgcgggtatcgaacaggattagataccctggtagtccgcacagtaaacgatggatgcccgctgttggtacctagtatcagcggctaagcgaaagcattaagcatcccacctggggagtacgccggcaacggtgaaactcaaaggaattgacgggggcccgcacaagcggaggaacatgtggtttaattcgatgatacgcgaggaaccttacccgggcttgaattgcagaggaaggatttagagataatgacgcccttcggggtctctgtgaaggtgctgcatggttgtcgtcagctcgtgccgtgaggtgtcggcttaagtgccataacgagcgcaacccctctcttcagttgccatcaggtgatgctgggcactctggagacactgccaccgtaaggtgtgaggaaggtggggatgacgtcaaatcagcacggcccttacgtccggggctacacacgtgttacaatggccggtacagagggacggtgtaatgcaaattgcatccaatcttgaaagccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcaaggatcggcctagggcaaaactggtgattggggctaagtcgtaacaaggtagccgtaccggaaggtgcggctggaacacctcctt

SEQ ID NO: 1751 - DNA, 1302 bp, Prevotellaceae bacterium
gaacgctagctacaggcttaacacatgcaagtcgagggaccggcgcacgggtgcgtaacgcgtatcgaacctgccctttactcagggatagccttgcgaaagtaagattaatacctgatagttaaagttggtaaaggatggcgatgcgtctgattaggtagtaggcggggtaatggcccacctagccgacgatcagtaggggttctgagaggaaggtcccccacattggaactgagacacggtccaaactcctacgggaggcagcagtgaggaatattggtcaatggacgagagtctgaaccagccaagtagcgtgcaggatgacggcctctgggttgtaaactgcttttagttgggaacaggagtgtaccatcagaaaaaggaccggctaattccgtgccagcagccgcggtaatacggaaggtccaggcgttatccggatttattgggtttaaagggagcgtaggcggacgattaagtcagctgtgaaagtttgcggctcaaccgtaaaattgcagttgaaactggttgtcttgagtgcacgcagggatgttggaattcatggtgtagcggtgaaatgcttagatatcatgaagaactccgatcgcgaaggcatatgtccggagtgactgacgctgaggctcgaaagtgcgggtatcgaacaggattagataccctggtagtccgcacagtaaacgatgaatactcgcagtatgcgtgtatgctgccaagtgaaaacgttaagtattccacctggggagtacgccggcaacggtgaaactcaaaggaattgacgggggcccgcacaagcggaggaacatgtggtttaattcgatgatacgcgaggaaccttacccgggcttgaactatggaggtgctgcatggttgtcgtcagctcgtgccgtgaggtgtcggcttaagtgccataacgagcgcaacccttctccacgtttgccatcagctgggcactccgtggatactgccatcgtaagatggaggaaggtggggatgacgtcaaatcagcacggcccttacgtccggggctacacacgtgttacaatggccggcagagggaagccaccaggcgactgggcgctgatccattccggtctcagttcggatggagtctgcaacccgactccagaagctggattcgctagtaatcgcgcatcagccatggcgcggtgaatacgttcccgggccttgtacacaccgcccgtcaagccatgaaagccgggggtgcctgaaagctgtggcggcctagggtaaaaccggtgattggggctaagtcgtaacaaggta

SEQ ID NO: 1752 - DNA, 1465 bp, Prochlorococcus marinus
ggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgcctactggtgaaacgaatttcgcctgaggatgagctcgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggacgaaggcctctgggctgtaaacctcttttctcaaggaagaagatatgacggtacttgaggaataagccacggctaattccgtgccagcagccgcggtaatacgggagtggcaagcgttatccggaattattgggcgtaaagcgtccgcaggcggcttttcaagtctgctgttaaagcgtggagcttaactccatcatggcagtggaaactgaaaggcttgagtatggtaggggcagagggaattcccggtgtagcggtgaaatgcgtagatatcgggaagaacaccagtggcgaaggcgctctgctgggccattactgacgctcatggacgaaagccaggggagcgaaagggattagatacccctgtagtcctggccgtaaacgatgaacactaggtgtcgggggaatcgaccccttcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttagaaatttgagggtgccttcgggaatgcagtgacaggtggtgcatggctgtcgtcagctcgtgtcgtgagatgttgggttaagtcccgcaacgagcgcaacccacgtttttagttgccagcatttagttgggcactctagaaagaccgccggtgataaaccggaggaaggtgtggatgacgtcaagtcatcatgccccttacaccctgggctacacacgtactacaatgctacggacaaagggcagcaaactcgcgagagctagcaaatcccataaaccgtggctcagttcagatcgtaggctgcaactcgcctacgtgaagtaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctaatgactggggtgaagtcgtaacaaggtagccgtaccggaaggtgcggctggatcacctcctaa

SEQ ID NO: 1753 - DNA, 1320 bp, Propionibacteriaceae bacterium
gctggcggcgtgcttaacacatgcaagtcgaacgagtggcgaacgggtgagtaacacgtgagcaacctacccttgacactggaataagcgctcgaaagggcgtctaataccggatattgaaaggcggtcaaggatgggctcgcggcctatcagctagttggtgaggtaacggctcaccaaggcttcgacgggtagccggcctgagagggcgaccggccacactgggactgagatacggcccagactcctacgggaggcagcagtggggaatattgcacaatgggcgcaagcctgatgcagcaacgccgcgtgcgggatgacggccttcgggttgtaaaccgctttcagcaccgacgatgacggtaggtgcagaagaaggaccggccaactacgtgccagcagccgcggtgatacgtagggtccgagcgttgtccggaattattgggcgtaaagagctcgtaggcggtttgtcgcgtcggaagtgaaaactcagggcttaactctgagcctgcttccgatacgggcagactagaggaagttaggggagaacggaattcctggtggagcggtggaatgcgcagatatcaggaggaacaccggtggcgaaggcggttctctgggactcctgacgctgaggagcgaaagcgtggggagcaaacaggcttagataccctggtagtccacgccgtaaacggtgggcactaggtgtgggtcgatccgtgccgtagctaacgcattaagtgccccgcctggggagtacggccgcaaggctaaaactcaaaggaattgacgggggcccgcacaagcggcggagcatgcggattaattcgatgcaacgcgaagaaccttacctgggtttgacatatacaggtggtgcatggctgtcgtcagctcgtgtcgtgagatgttgggttaagtcccgcaacgagcgcaaccctcgtcctatgttgccagcggccggggactcataggagactgccggggtcaactcggaggaaggtggggatgaggtcaagtcatcatgccccttatgtccagggcttcacgcatgctacaatggctggcaaagggctgcgaaaccgcaaggtttagcgaatcccaaccagtctcagttcggatggggtctgcaactcgaccccagaagtcggagtcgctagtaatcgcagatcagcaacgctgcggtgaatacgttcccgggccttgtacacaccgcccgtcaagtcatgaaagtcggcaacacccgaagccggtgcccagggagccgtcgaaggtggggctggtaattaggactaagtcgtaacaaggtagccgtaccggaag

SEQ ID NO: 1754 - DNA, 1522 bp, Propionibacterium acidipropionici
agagtttgatcctggctcaggacgaacgctggcggcgtgcttaacacatgcaagtcgaacggtaaggccctttcgggggtacacgagtggcgaacgggtgagtaacacgtgagtaacctgcccacttcttcgggataacgctaggaaactggtgctaataccggatatgagctttcaccgcatggtgggggttggaaagtgtttgtggtggtggatggactcgcggcctatcagcttgttggtgaggtagtggctcaccaaggcggtgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcaccaggggcgaaggcattcttttggggtgttgacggtacctggagaagaagcaccggctaactacgtgccagcagccgcggtgatacgtagggtgcgagcgttgtccggatttattgggcgtaaagggctcgtaggcggttgatcgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggattggtaacggtcagagatggccgccccccttgtgggccggttcacaggtggtgcatggctgtcgtcagctcgtgtcgtgagatgttgggttaagtcccgcaacgagcgcaaccctcgtccactgttgccagcatttggttggggactcagtggagaccgccggggtcaactcggaggaaggtggggatgacgtcaagtcatcatgccccttatgtccagggcttcacgcatgctacaatggccggtacaaagagtggcgacatcgtgaggtggagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaacacgttctgcgtgggggagtcgtcgaaggtgggactggtaattaggactaagtcgtaacaaggtagccgtaccggaaggtgcggctggatcacct

SEQ ID NO: 1755 - DNA, 1529 bp, Propionibacterium acnes
tttcattggagagtttgatcctggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagcgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttct

SEQ ID NO: 1756 - DNA, 1500 bp, Propionibacterium avidum
tcaggacgaacgctggcggcgtgcttaacacatgcaagtcgaacggaaagggccttcgggggtactcgagtggcgaacgggtgagtaacacgtgagtaacctgcccttgacttcgggataacttcaggaaactggggctaataccggataggaatccttgctgcatggtgggggttggaaagcttcggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcagcaggggcgaacttgtggtgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctgggtagtccacgctgtaaacggtgggtactaggtgtggggtccattccacggattccgtgccgtagctaacgcattaagtaccccgcctggggagtacggccgcaaggtaaaactcaaaggaattgacggggccccgcacaagcggcggagcatgcggattaattcgatgcaacgcgaagaaccttacctgggtttgacatggactgggagtgctcagagatgggtatgcctccttgtggggctggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaacctgtgtgggggagccgtcgaaggtgggactggtaattaggactaagtcgtaacaaggtagccgtaccggaaggtgcggctggatcacctcctttct

SEQ ID NO: 1757 - DNA, 1510 bp, Propionibacterium freudenreichii
agtttgatcctggctcaggacgaacgctggcggcgtgcttaacacatgcaagtcggacggtaaggcccctttcggggggtacacgagtggcgaacgggtgagtaacacgtgaggaacgtgcccttgacttcggtatagctccaggaaactggtggtaatcccgaatatgagcctggcctgcatgggttgggttggaaagctttatgcggtcagggatcgtctcgcggcctatcagcttgttggtggggtaatggcctaccaaggcagcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcatccatgacgaagcgcaagtgacggtagtgggagaagaagcaccggctaactacgtgccagcagccgcggtgatacgtagggtgcgagcgttgtccggaattattgggcgtaaagagcttgtaggcggttgatcacgtcggaagtgaaattccagggcttaactctgggcttgctttcgatacgggttgacttgaggaatgtaggggagaatggaactctcggtggagcggtggaatgcgcagatatcgggaagaacaccagtggcgaaggcggttctctggacatttcctgacgctgagaagcgaaagcgtggggagcaaacaggcttagataccctggtagtccacgccgtaaacggtgggtactaggtgtgggtcccttccacggggtccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgtactggaagcgttcagagatgggcgtgcctttttggctggtacacaggtggtgcatggctgtcgtcagctcgtgtcgtgagatgttgggttaagtcccgcaacgagcgcaaccctcgtccaatgttgccagcagttcggctggggactcattggagaccgccggggccaactcggaggaaggtggggatgaggtcaagtcatcatgccccttatgtccagggcttcacgcatgctacaatggccggtacaaagagttgcgagcctgtgagggtgagcgaatctcagaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttggggggagccgtcgaaggtgggactggtgattaggactaagtcgtaacaaggtagccgtaccggaaggtgcggctggatcacctccttt

SEQ ID NO: 1758 - DNA, 1442 bp, Propionibacterium granulosum
tgatcatggctcaggacgaacgctggcggcgtgcttaacacatgcaagtcgtacggtaaggccctttcgggggtacacgagtggcgaacgggtgagtaacacgtgagtaacctgcccacaactttgggataacgctaggaaactggtgctaatactggatatgtgctcctgctgcatggtgggggttggaaagctccggcggttgtggatggactcgcggcctatcagcttgttggtggggtagtggcctaccaaggcggcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcagcagggacgaagctttttgtgacggtacctgcagaagaagcaccggctaactacgtgccagcagccgcggtgatacgtagggtgcgagcgttgtccggatttattgggcgtaaagggctcgtaggcggttgatcgcgtcggaagtggaaacttgatgcttaacgttgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctggtagtccacgctgtaaacggtgggtactaggtgtggggtccattccacggattctgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggatcggaagcttccagagatggttgtgcctcttttggggtcggttcacaggtggtgcatggctgtcgtcagctcgtgtcgtgagatgttgggttaagtcccgcaacgagcgcaaccctcgtccactgttgccagcaattcggttggggactcagtggagaccgccggggtcaactcggaggaaggtggggatgacgtcaagtcatcatgccccttatgtccagggcttcacgcatgctacaatggccggtacagtgagttgcgacatcgtaaggtggagcgaatctcaaaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagtcggtaacactcgaagccggtggcctaacactttttgtgggggagctgtcgaaggtg

SEQ ID NO: 1759 - DNA, 1487 bp, Propionibacterium jensenii
agttttgattcctgggcttcaaggaacgaaaccgctgggtggcgttgcttaaccctgcaaagtcggaaccgggttaaggccccttttgggggggttaccacgaagtggcgaaccgggttgagtaaacaccgtggagttaacccttccccattccactttcgggattaacgctagggaaacctggtggctaaattcccggatatgagctctcatcgccatggtgggggttggaaagttctggcggtggtggatggactcgcgtcctatcagcttgttggtgaggttgtggctcaccaaggcgtcgacgggtagccggcctgagagggtgaccggccacattgggactgagatacggcccagactcctacgggaggcagcagtggggaatattgcacaatgggcgcaagcctgatgcagcaacgccgcgtgcgggatgacggccttcgggttgtaaaccgctttcaccagggacgaagtgcctttcggggtgtgacggtacctggagaagaagcaccggctaactacgtgccagcagccgcggtgatacgtagggtgcgagcgttgtccggatttattgggcgtaaagagctcgtaggtggttgatcacgtcggaagtgaaaacttggggcttaaccctgggcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgtgccgtagctaacgcattaagtaccccgcctggggagtacggccgcaggctaaactcaaaggaattgacggggccccgcacaagcggcggagcatgcggattaattcgatgcaacgcgaagaaccttacctgggtttgacatggattggtaacggtcagagatggccgccccccttgtgggccgattcacaggtggtgcatggctgtcgtcagctcgtgtcgtgagatgttgggttaagtcccgcaacgagcgcaaccctcgtccactgttgccagcaattcggttggggactcagtggagaccgccggggtcaactcggaggaaggtggggatgacgacaagtcatcatgccccttatgtccagggcttcacgcatgctacaatggctggtacaaagagttgcgacactgtgaggtggagcgaatctcaaaaagccagtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcccaaccttttgggggggagccgtccaaggtgg

SEQ ID NO: 1760 - DNA, 1506 bp, Propionibacterium propionicum
tcaggacgaacgctggcggcgtgcttaacacatgcaagtcgaacggaaaggcccctttgggggtactcgagtggcgaacgggtgagtaacacgtgagtaacctgcccttgacttcgggataacttcaggaaactggggctaataccggatagacatccttgctgcatggtgggggttggaaagcttcggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggcttcgggttgtaaacccgctttcagcaggggcgaagcttttgtgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctgggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggactgggagtgctcagagatgggtatgcctccttgtggggctggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgaccctatgaagtcggagtcgctagtaatcgcagatcagcaacgctgcggtgaatacgttcccggggcttgtacacaccgcccgtcaagtcatgaaagtcggtaacacccgaagccggtggcctaacctgtgtgggggagccgtcgaaggtgggactggtaattaggactaagtcgtaacaaggtagccgtaccggaaggtgcggctggatcacctcctttctaagg

SEQ ID NO: 1761 - DNA, 1530 bp, Propionibacterium sp.
tttcattggagagtttgatcctggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggccggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctttct

SEQ ID NO: 1762 - DNA, 1367 bp, Propionibacterium sp.
gagtttgatcctggctcaggacgaacgctggcggcgtgcttaacacatgcaagtcgaacgagtggcgaacgggtgagtaacacgtgagtaacctgcccttgacttcgggataacttcaggaaactggggctaataccggatagggaaaggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcagcaggggcgatgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctcctgacgctgaggagcgaaagcgtggggagcgaacaggcttagataccctggtagtccacgctgtaaacggtgggtactaggtgtggggtattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatgcacaggtggtgcatggctgtcgtcagctcgtgtcgtgagatgttgggttaagtcccgcaacgagcgcaaccctcgttcactgttgccagcaygtggggactcagtggagaccgccggggtcaactcggaggaaggtggggatgacgtcaagtcatcatgccccttatgtccagggcttcacgcatgctacaatggccggcaaagagttgcgagcctgtgagggtgagcgaatctcggccggtctcagttcggatggggtctgcaactcgaccctagaagtcggagtcgctagtaatcgcagatcagcaacgctgcggtgaatacgttcccggggcttgtacacaccgcccgtcaagtcatgaaagtcggtaacacccgaagccggtgcctagggagccgtcgaaggtgggactggtaattaggactaagtcgtaacaaggtagccgtaccggaaggtgcggctggatcacctcctt

SEQ ID NO: 1763 - DNA, 1516 bp, Propionibacterium sp.
agagtttgatcctggctcaggacgaacgctggcggcgtgcttaacacatgcaagtcgaacggaaaggccctgcttttgtggggtgctcggtggcgaacgggtgagtaacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgtaatcttggggcttaaccctgagcgtgctttcgatacgggttgacttgaggaaggtaggggagaatggaattcctggtggagcggtggaatgcgcagatatcaggaggaacaccagtggcgaaggcggttctctgggcctttcctgacgctgaggagcgaaagcgtggggagcgaacaggcttagataccctggtagtccacgctgtaaacggtgggtactaggtgtggggtccattccacgggttccgtgccgtagctaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggcctaaccgttgtgggggagccgtcgaaggtgggactggtgattaggactaagtcgtaacaaggtagccgtaccggaaggtgcggctggatcacctcctt

SEQ ID NO: 1764 - DNA, 1494 bp, Propionibacterium sp.
gagtttgatcctggctcaggacgaacgctggcggcgtgcttaacacatgcaagtcgaacggtaaggccctttcgggggtacacgagtggcgaacgggtgagtaacacgtgagtaacctgcccctgactttgggataacggatggaaacgtttgctaataccggatattcagctcttgaggcatcttttgggttggaaagttttttcggttggggatgggctcgcgtcctatcagcttgttgttggggtagtggcctaccaaggcgtcgacgggtagccggcctgagagggcgaccggccacattgggactgagatacggcccagactcctacgggaggcagcagtggggaatattgcacaatggacggaagtctgatgcagcaacgccgcgtgcgggatgacggccttcgggttgtaaaccgctttcagccatgacgaagcgtgagtgacggtagtggtagaagaagcaccggctaactacgtgccagcagccgcggtgatacgtagggtgcgagcgttgtccggatttattgggcgtaaagagcttgtaggcggttgattgcgtcgaaagtgcaaactcagggcttaactctgagcctgctttcgatacgggttgacttgagggatgtaggggagaatggaattcccggtggagcggtggaatgcgcagatatcgggaggaacaccagtggcgaaggcggttctctggacatttcctgacgctgagaagcgaaagcgtggggagcaaacaggcttagataccctggtagtccacgctgtaaacggtgggcattaggtgtgggtcacattccacgtggtctgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatatgccggaagcatgcagagatgtgtgtgcctttttggtcggtttacaggtggtgcatggctgtcgtcagctcgtgtcgtgagatgttgggttaagtcccgcaacgagcgcaaccctcgtccaatgttgccagcacgttatggtggggactcattggagaccgccggggtcaactcggaggaaggtggggatgacgtcaagtcatcatgccccttatgtccagggcttcacgcatgctacaatggccggtacaaagagttgcgagcctgtgagggtgagcgaatctcataaagccggtctcagttcggattggggtctgcaactcgaccccatgaagtcggagtcgctagtaatcgcagatcagcaatgctgcggtgaatacgttctcggggcttgtacacaccgcccgtcaagtcatgaaagttggtaacacccgaagccggtggcctaacctttgtggggggagccgtcgaaggtgggactggtaattaggactaagtcgtaacaaggtagccgtaccggaaggtgc

SEQ ID NO: 1765 - DNA, 1359 bp, Propionibacterium sp.
  misc_feature (574)..(574): n is a, c, g, or t
aaggccctgcttttgtggggtgctcgagtggcgaacgggtgagtacacacgtgagtaacctgcccttgactttgggataacttcaggaaactggggctaataccggataggagctcctgctgcatggtgggggttggaaagtttcggcggttggggatggactcgcggcttatcagcttgttggtggggtagtggcttaccaaggctttgacgggtagccggcctgagagggtgaccggccacattgggactgagatacggcccagactcctacgggaggcagcagtggggaatattgcacaatgggcggaagctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgttaaagggctcgtaggtggtggatcgcgtcggaagtgtaatcttggcggcttaaccctgagcgtgctttcgacacgggttgacttgaggaaggtangggagaatggaattcctggtggagcggtggaatgcgcagatatcaggaggaacaccagtggcgaaggcgttctctgggcctttcctgacgctgaggagcgaaagcgtggggagcgaacaggcttagataccctggtagtccacgctgtaaacggtgggtactaggtgtggggtccattccacgggttccgtgccgtactaacgctttaagtaccccgcctggggagtacggccgcaaggctaaaactcaaaggaattgacggggccccgcacaagcggcggagcatgcggattaattcgatgcaacgcgtagaaccttacctgggtttgacatggatcgggagtgctcagagatgggtgtgcctcttttggggtcggttcacaggtggtgcatggctgtcgtcagctcgtgtcgtgagatgttgggttaagtcccgcaacgagcgcaacccttgttcactgttgccagcacgttatggtggggactcagtggagaccgccggggtcaactcggaggaaggtggggatgacgtcaagtcatcatgccccttatgtccagggcttcacgcatgctacaatggctggtacagagagtggcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagttggtaacacccgaagccggtggccta

SEQ ID NO: 1766 - DNA, 1467 bp, Propionibacterium thoenii
agttttgatcctggctcaggacgaaacgctggcggcgtgcttaacacatgcaattcgaacggtaaggcccttttcgggggtacaacgagtggccaacgggtgagtaacacgtgagtaaccctgcccatcacttcgggataacgctgggaaactggtgctaataccggatatgagctcctgctgcatggtgggggttggaaagtttttgcggtggtggatggactcgcgtcctatcagcttgttggtgaggttgtggctcaccaaggcgtcgacgggtagccggcctgagagggtgaccggccacattgggactgagatacggcccagactcctacgggaggcagcagtggggaatattgcacaatgggcgaaagcctgatgcagcaacgccgcgtgcgggatgacggccttcgggttgtaaaccgctttcaccagggacgaagggcctttcggggtttgacggtacctggagaagaagcaccggctaactacgtgccagcagccgcggtgatacgtagggtgcgagcgttgtccggatttattgggcgtaaagagctcgtaggtggttgatcgcgtcggaagtgaaaacttggggcttaaccctgggcgtgctttcgatacgggttgacttgtggaaggtaggggagaatggaattcttggtggagcggtggaatgcgcagatatcaggaggaacaccagtggcgaaggcggttctctggacctttcctgacgctgaggagcgaaagcgtggggagcaaacaggcttagataccctggtagtccacgctgtaaacggtgggtactaggtgtggggtccattccacggattccgttacgtagctattcgcttaagataccccgcctggggagtacggccgcaggctaaaactcaaaggaattgacggggccccgcacaagcggcggagcatgcggattaattcgatgcaacgcgaagaaccttacctgggtttgacatggattggtaacggtcagagatggccgccccccttgtgggccgattcacaggtggtgcatggctgtcgtcagctcgtgtcgtgagatgttgggttaagtcccgcaacgagcgcaaccctcgtccactgttgccagcaattcggttggggactcagctggagaccgccggggtcaactcggaggaaggtgggcaatgacgcacaagtcatcatgccccttatgtccagggcttcacgcatgctacaatggccggtacaaacagttgcgacactgtgaggtggagcgaatctcaaaaagccggtctcagttcggattggggtctgcaactcaaccccatgaagtcggagtcgctagtaatcgcagatcagcaacgctgcggtgaatacgttcccggggcttgtacacaccgcccgtcaagtcatgaaagtcagtaacacccttgagcgggtggccctacccttgtgggggggccgtcgaaggtggactggttc

SEQ ID NO: 1767 - DNA, 1546 bp, Proteus mirabilis
tttaattgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1768 - DNA, 1544 bp, Proteus penneri
aattgaagagtttgatcatggctcagattgaacgctggcggcaggcctaacacatgcaagtcgagcggtaacagaagaaagcttgctttcttgctgacgagcggcggacgggtgagtaatgtatggggatctgcccgatagagggggagtaactactggaaacggtggctaataccgcatgacgtctacggaccaaagcaggggctcttcggaccttgcgctatcggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatctgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcggatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1769 - DNA, 1374 bp, Proteus sp.
gagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccacttt

SEQ ID NO: 1770 - DNA, 1495 bp, Proteus vulgaris
gattgaacgctggcggcaggcctaacacatgcaagtcgagcggtaacagaggaaagcttgctttcttgctgacgagcggcggacgggtgagtaatgtatggggatctgcccgatagagggggataactactggaaacggtagctaataccgcatgacgtctacggaccaaagcaggggctcttcggaccttgcgctatcggatgaacccatatgggattagctagtaggtgaggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgttaagattaatactcttagcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccacgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatcctttagagatagaggagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcctaacaaggtaaccgtaggggaac

SEQ ID NO: 1771 - DNA, 1544 bp, Providencia alcalifaciens
tttaattgaagagtttgatcatggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctaaggagcaaagcaggggaacttcggtccttgcgctatcggatgaacccatatgggattagctagttggtgaggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacattatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1772 - DNA, 1497 bp, Providencia rettgeri
gctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctcttaggagcaaagcaggggaacttcggtccttgcgctatcggatgaacccatatgggattagctagtaggtgaggtaatggctcacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgctaatatcatcaacgattgacgttaccgacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaaccggattagataccctggtagtccacgctgtaaacgatgtcgatttgaaggttgttcccttgaggagtggctttcggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggttaagtcctaacaaggtaaccgtaggggaac

SEQ ID NO: 1773 - DNA, 1516 bp, Providencia rustigianii
ttgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtagctaataccgcataatctctttggagcaaagcaggggaacttcggtccttgcgctatcggatgaacccatatgggattagctagttggtggggtaatggctcaccaaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagttgggaggaaggcgttgatgctaatatcatcaacgattgacgttaccaacagaagaagcaccggctaactccgtgccagcagccgcggtaatacggagggtgcaagcgttaatcggaattactgggcgtaaagcgcacgcaggcggttgattaagttagatgtgaaatccccgggcttaacctgggaatggcatctaagactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctg

SEQ ID NO: 1774 - DNA, 1494 bp, Providencia stuartii
tgatcctggctcagattgaacgctggcggcaggcctaacacatgcaagtcgagcggtaacaggggaagcttgcttctcgctgacgagcggcggacgggtgagtaatgtatggggatctgcccgatagagggggataactactggaaacggtggctaataccgcataatctcttaggagcaaagcaggggaccttagggccttgcgctgtcggatgaacccatatgggattagctagtaggtaaggtaatggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccctagggttgtaaagtactttcagtcgggaggaaggcgttgatgttaataccatcaacgattgacgttaccgacagaagaagcaccggctaactccgtgccagcagccgcggtaatacggagggtgcaagcgttaatcggaattactgggcgtaaagcgcacgcaggcggttaattaagttagatgtgaaatccccgggcttaacctgggaatggcatctaagactggttagctagagtcttgtagaggggggtagaattccatgtgtagcggtgaaatgcgtagagatgtggaggaataccggtggcgaaggcggccccctggacaaagacttacgctcaggtgcgaaagcgtggggagcaaacaggattagataccctggtagtccacgctgtaaacgatgtcgatttggaggttgttccctagaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggagctctgagacaggtgctgcatggctgtcgtcaactcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgatccatgactggggtgaagtcgtaacaaggtagc

SEQ ID NO: 1775 - DNA, 1445 bp, Pseudoclavibacter sp.
gacgaacgctggcggcgtgcttaacacatgcaagtcgaacgatgaagccttagcttgctttggtggattagtggcgaacgggtgagtaacacgtgagcaacgtgcccaggactctggaataaccgcgggaaaccgtggctaataccggataggtgccgaggccgcatggtcttcggttggaaagtttttgcggttctggatcggctcacggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcaacgccgcgtgggggatgacggccttcgggttgtaaacctcttttagtagggaagaagcgcaagtgacggtacctgcagaaaaagcaccggctaactacgtgccagcagccgcggtaatacgtagggtgcaagcgttgtccggatttattgggcgtaaagagctcgtaggcggtttgtcgcgtctgctgtgaaagcccgaggctcaacctcgggtctgcagtgggtacgggcaggctagagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatatcggaatcggctagagatagtcgcgccctttgggtcggtatacaggtggtgcatggttgtcgtcagctcgtgtcgtgagatgttcggttaagtccggcaacgagcgcaacccttgtcctatgttrccagcacgttatggtgggaactcatgggatactgccgtggtcaacacggaggaaggtggggatgacgtcaaatcatcatgccccttatgtcttgggcttcacgcatgctacaatggccggtacaatgggctgcgataccgcgaggtggagcgaatcccaaaaagccggtctcagttcggattggggtctgcaactcgaccccatgaagtcggagtcgctagtaatcgcagatcagcattgctgcggtgaatacgttcccgggccttgtacacaccgcccgtcaagtcatgaaagtcggtaacacccgaagccggtggcctaaccttttggggggagctgtcgaaggtgggatcggtgattaggact

SEQ ID NO: 1776 - DNA, 1483 bp, Pseudoflavonifractor capillosus
gatgaacgctggcggcgtgcttaacacatgcaagtcgaacggagagctcatgacagaggattcgtccaatggattgggtttcttagtggcggacgggtgagtaacgcgtgaggaacctgcctcggagtggggaataacagtccgaaaggactgctaataccgcataatgcagctgagtcgcatgacactggctgccaaagatttatcgctctgagatggcctcgcgtctgattagctagttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggatgaaggctttcgggttgtaaacttcttttatcagggacgaaataaatgacggtacctgatgaataagccacggctaactacgtgccagcagccgcggtaatacgtaggtggcaagcgttatccggatttactgggtgtaaagggcgtgtaggcgggactgcaagtcaggtgtgaaaaccacgggctcaacctgtggcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggactgaccccctccgttgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatccgactaacgaagcagagatgcattaggtgcccttcggggaaagtcgagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaagcaatgccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaa

SEQ ID NO: 1777 - DNA, 1537 bp, Pseudomonas aeruginosa
tgaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctcctta

SEQ ID NO: 1778 - DNA, 1442 bp, Pseudomonas fluorescens
ctggcggcaggcctacacatgcaagtccagcggcagcacgggtacttgtacctggtggcgagcggcggacgggtgagtaatgcctaggaatctgcctagtagtgggggataacgtccggaaacgggcgctaataccgcatacgtcctacgggagaaagtgggggatcttcggacctcacgctattagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtaaatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcat

SEQ ID NO: 1779 - DNA, 1466 bp, Pseudomonas gessardii
agattgaacgctggcggcaggcctaacacatgcaagtcgagcggtagagagaagctttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagaggggggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccagaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggcaggacggttaccacggtgtgattcatgactggggtgaagt

SEQ ID NO: 1780 - DNA, 1537 bp, Pseudomonas mendocina
tgaactgaagagtttgatcatggctcagattgaacgctggcggcaggcctaacacatgcaagtcgagcggatgaggggagcttgctccctgatttagcggcggacgggtgagtaatgtctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccaacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgcggctggatcacctcctta

SEQ ID NO: 1781 - DNA, 1517 bp, Pseudomonas monteilii
atcctggctcagattgaacgctgcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctc

SEQ ID NO: 1782 - DNA, 1348 bp, Pseudomonas poae
cttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttctagagatagattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagcta

SEQ ID NO: 1783 - DNA, 1492 bp, Pseudomonas pseudoalcaligenes
attgaacgctggcggcaggcctaacacatgcaagtcgagcggatgaagggagcttgctccctgatttagcggcggacgggtgagtaatgcctaggaatctgcctggtagtgggggataacgttccgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagctaataccttgctgttttgacgttaccgacagaataagcaccggctaacttcgtgccagcagccgcggtaatacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggttccttgagaacttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccttcggggggacggttaccacggagtgattcatgactggggtgaagtcgtaacaaggtagccgtaggggaacctgc

SEQ ID NO: 1784 - DNA, 1476 bp, Pseudomonas putida
agagtttgatcatggctcagattgaacgctggcggcaggcctaacacatgcaagtcgagcggatgacgggagcttgctccttgattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggg

SEQ ID NO: 1785 - DNA, 1524 bp, Pseudomonas sp.
agagtttgatcatggctcagattgaacgctggcggcaggcctaacacatgcaagtcgagcggatgaagggagcttgctcctgaattcagcggcggacgggtgagtaatgcctaggaatctgcctgatagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacct

SEQ ID NO: 1786 - DNA, 1284 bp, Pseudomonas sp.
cctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggctacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgattacgttcccgggccttgtacacaccgcccg

SEQ ID NO: 1787 - DNA, 1402 bp, Pseudomonas sp.
catgcaagtcgagcggatgaagggagcttgcttctggattcagcggcggacgggtgagtaatgcctaggaatctgcctggtagtgggggacaacgttccgaaaggagcgctaataccgcatacgtcctacgggagaaagtgggggatcttcggacctcacgctatcagatgagcctaggtcggattagctagtaggtggggtaatggctcacctaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggtttggtaagatggatgtgaaatccccgggctcaacctgggaactgcatccataactgcctgactagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgtccggaatcctgcagagatgcgggagtgccttcgggaatcggaacacaggtgctgcatggctgtcgtcagctcgtgtcgtggagatgttgggttaagtcccgtaacgagcgcaccctttgtccttagttaccagcacgttatggtgggcactctaaggagactgccggtgacaaaccggaggaaggtggggatgaggtcaagtcatcatggcccttacggccagggctacacacgtgctacaatggtcggttcagagggttgccaagccgcgaggtggagctaatcccagaaaaccgattgtagtccggatcgcagtctgcaactcgactgcggaagtcggaatcgctagtaatcgtgaatcagaatgtcacggtgaatacgttcccgggccttgtacactccgcccgtcacaccatgggagtgggttgctccagaagtagctagtctaaccgcaagggggac

SEQ ID NO: 1788 - DNA, 1363 bp, Pseudomonas stutzeri
gcttgctctctgattcagcggcggacgggtgagtaatgcctaggaatctgcctgrtagtgggggacaacgtttcgaaaggaacgctaataccgcatacgtcctacgggagaaagcaggggaccttcgggccttgcgctatcagatgagcctaggtcggattagctagttggtgaggtaacggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaacttcgtgccagcagccgcggtaatacgaagggtgcaagcgttaatcggaattactgggcgtaaagcgcgcgtaggtggtttgttaagttgaatgtgaaagccccgggctcaacctgggaactgcatccaaaactggcaagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacaggattagataccctggtagtccacgccgtaaacgatgtcgactagccgttgggatccttgagatcttagtggcgcagctaacgcattaagtcgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtcta

SEQ ID NO: 1789 - DNA, 1450 bp, Pseudomonas tolaasii
agagtttgatcctggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacsggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacaaaccgcccgtcacaccatgggagtgggttgcaccagaagtagctagtctaaccttcgggaggacgg

SEQ ID NO: 1790 - DNA, 1439 bp, Pseudomonas viridiflava
tgcgagtcgatcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaacctaatacgttattgttttgacgttaccgacagaataagcaccggctaactctgtgccagcagccgcggtaatacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcctttagagatagaggagtgccttcgggagcattgagacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccgcggtgtgattcatgactggggtgaagtcgaa

SEQ ID NO: 1791 - DNA, 1480 bp, Pseudoramibacter alactolyticus
taagtcaaaaagaacagtttgatcatggctcaggacgaacgctggcggtatgcttaacacatgcaagtcgaacgagaagttttttattgaccttcgggggatataagagacagacagtggcgaacgggtgagtaacgcgtgggcaacctacctatcggagcgggatagcctcgagaaatcgggagtaaaaccgcataacacagcagaatcgcatgactttgctgtcaaaactccggtgccgatagatgggcccgcgtctgattagctagttggtaaggtaagggcttaccaaggcaacgatcagtagccggtctgagagggcgaacggccacactggaactgagacacggtccagactcctacgggaggcagcagtggggaatattgcgcaatgggggcaaccctgacgcagcaataccgcgtgagtgaagaaggttttcggatcgtaaagctctgttattggggaagaagcagtgacggtacccaatgaggaagtcccggctaactacgtgccagcagccgcggtaatacgtaggggacgagcgttgtccggaatcactgggcgtaaagggcgcgtaggcggttttataagtcagatgtgaaaggtaccggctcaaccggtgacgtgcatttgaaactgtaagacttgagtactgaagaggcaagcggaattcctagtgtagcggtgaaatgcgtagatattaggaagaacaccggtggcgaaggcggcttgctgggcagatactgacgctgaggtgcgaaagcgtggggagcgaacaggattagataccctggtagtccacgccgtaaacgatgaatactaggtgttggcgaataagtcagtgccggagttaacacaataagtattccgcctggggagtacgaccgcaaggttgaaactcaaaggaattgacggggacccgcacaagcagcggagcatgtggtttaattcgaagcaacgcgaagaaccttaccaggccttgacatcctctgagcgcaatagagatattgctttcccttcggagacagagagacaggtggtgcatggttgtcgtcagctcgtgtcgtgagatgttgggttaagtcccgcaacgagcgcaacccctgtcattagttgccatcattgagttgggcactctaatgagactgccgtagacaatacggaggaaggtggggacgacgtcaaatcatcatgccccttatggcctgggctacacacgtgctacaatggtctgaacaaagggaagcgaaggagcgattcggagcgaatctcataaaacagatcccagttcggattgcaggctgcaactcgcctgcatgaagatggagttgctagtaatcgcggatcagaatgtcgcggtgaatgcgttcccgggtcttgtacacaccgcccgtcacaccacgagagtcggtaacacccgaagccagtgagacaaccggaaggagtcagctgtcgaaggtgggatcggtaattggggtg

SEQ ID NO: 1792 - DNA, 1610 bp, Psychrobacter arcticus
atgagccaagtttagtagcctctttaaagggttacatagcaagattaaactgaagagtttgatcatggctcagattgaacgctggcggcaggcttaacacatgcaagtcgagcggaaacgatggtagcttgctaccaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggctcaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggaaggcgttcaccacggtgtggttgatgactggggtgaagtcgtaacaaggtagccgtaggggaacctgcggctggatcacctccttatagatggcattcggtcagcaagaat

SEQ ID NO: 1793 - DNA, 1428 bp, Psychrobacter cibarius
aagcttgcttctcgctgacgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagggagcgtaggtggctctataagtcagatgtgaaatccccgggcttaacctgggaactgcatctgaaactgtagagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagc

SEQ ID NO: 1794 - DNA, 1586 bp, Psychrobacter cryohalolentis
gatgagccaagtttagaagtctctttaaaggacttcatagcaagattaaactgaagagtttgatcatggctcagattgaacgctggcggcaggcttaacacatgcaagtcgagcggaaacgatgatagcttgctatcaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactcttcggttaatacccggagacgatgacattagctgcagaataagcaccggctaactctgtgccagcagccgcggtaatacagagggtgcaagcgttaatcggaattactgggcgtaaagggagcgtaggtggctcgataagtcagatgtgaaatccccgggctcaacctgggaactgcatctgatactgttgagctagagtatgtgagaggaaggtagaattccaggtgtagcggtgaaatgcgtagagatctggaggaataccgatggcgaaggcagccttctggcataatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcttaaccttcgggggagcgttcaccacggtgtggttgatgactggggtgaagtcgtaacaaggtagccgtaggggaacctgcggctggatcacctcctta

SEQ ID NO: 1795 - DNA, 1472 bp, Psychrobacter faecalis
ggctcagattgaacgctggcggcaggcttaacacatgcaagtcgagcggtaacaggagaagcttgcttctcgctgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagcgagcgtaggtggcttgataagtcagatgtgaaagccccgggcttaacctgggaacggcatctgatactgttaggctagagtaggtgagaggaaggtagaattccaggtgtagcggtgaaatgcgtagagatctggaggaataccgatggcgaaggcagccttctggcatcatactgacactgaggttcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtgggtagcctaaccttttaggatggcgctcaccacggtgtggttgatgactggggtgaagt

SEQ ID NO: 1796 - DNA, 1468 bp, Psychrobacter nivimaris
agattgaacgctggcggcaggcttaacacatgcaagtcgagcggaaacgatgatagcttgctatcaggcgtcgagcggcggacgggtgagtaatacttaggaatctacctagtagtgggggatagcacggggaaactcgtattaataccgcatacgacctacgggagaaagggggcagtttactgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggaaaccctgatccagccatgccgcgtgtgtgaagaaggccttttggttgtaaagcactttaagcagtgaagaagactcttcggttaatacccggagacgatgacattagctgcagaataagcaccggctaactctgtgccagcagccgcggtaatacagagggtgcaagcgttaatcggaattactgggcgtaaagcgagcgtaggtggcttgataagtcagatgtgaaatccccgggcttaacctgggaactgcatctgaaactgttaggctagagtaggtgagagggaggtagaatttcaggtgtagcggtgaaatgcgtagagatctgaaggaataccgatggcgaaggcagcctcctggcatcatactgacactgaggctcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcgggttaagccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggatagcctaaccttcgggaaggcgttcaccacggtgtggttgatgactggggtgaagtc

SEQ ID NO: 1797 - DNA, 1468 bp, Psychrobacter pulmonis
agattgaacgctggcggcaggcttaacacatgcaagtcgagcggtaacaggagaagcttgcttctcgctgacgagcggcggacgggtgagtaatacttaggaatctacctagtagtgggggatagctcggggaaactcgaattaataccgcatacgacctacgggagaaagggggcaacttgttgctctcgctattagatgagcctaagtcggattagctagatggtggggtaaaggcctaccatggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactccatggttaatacccatggacgatgacattagctgcagaataagcaccggctaactctgtgccagcagccgcggtaatacagagggtgcaagcgttaatcggaattactgggcgtaaagcgagcgtaggtggcttgataagtcagatgtgaaagccccgggcttaacctgggaacggcatctgatactgttaggctagagtaggtgagaggaaggtagaattccaggtgtagcggtgaaatgcgtagagatctggaggaataccgatggcgaaggcagccttctggcatcatactgacactgaggttcgaaagcgtgggtagcaaacaggattagataccctggtagtccacgccgtaaacgatgtctactagtcgttgggtcccttgaggacttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttgtccttagttaccagcggtttggccgggaactctaaggatactgccagtgacaaactggaggaaggcggggacgacgtcaagtcatcatggcccttacgaccagggctacacacgtgctacaatggtaggtacagagggcagctacacagcgatgtgatgcgaatctcaaaaagcctatcgtagtccagattggagtctgcaactcgactccatgaagtaggaatcgctagtaatcgcggatcagaatgccgcggtgaatacgttcccgggccttgtacacaccgcccgtcacaccatgggagttgattgcaccagaagtggttagcctaaccttttaggaaggcgatcaccacggtgtggttgatgactggggtgaagtc

SEQ ID NO: 1798 - DNA, 1457 bp, Psychrobacter sp.
attgaacgctggcggcaggcttaacacatgcaagtcgagcggtaacaggagaagcttgcttctygctgacgagcggcggacgggtgagtaatacttaggaatctgcccagtagtgggggatagcacggggaaactcgtattaataccgcatacaccctacggggaaaagggggcgcttgcgctctcgctattggatgagcctaagtcggattagctagttggtggggtaaaggcctaccaaggcgacgatctgtagctggtctgagaggatgatcagccacaccgggactgagacacggcccggactcctacgggaggcagcagtggggaatattggacaatgggggcaaccctgatccagccatgccgcgtgtgtgaagaaggccttttggttgtaaagcactttaagcagtgaagaagactctatggttaatacccatagacgatgacattagctgcagaataagcaccggctaactctgtgccagcagccgcggtaatacagagggtgcaagcgttaatcggaattactgggcgtaaagcgagcgtaggtggcttaataagtcagatgtgaaatccccgggcttaacctgggaactgcatctgatactgttgggctagagtaggtgagagggaggtagaatttcaggtgtagcggtgaaatgcgtagagatctgaaggaataccgatggcgaaggcagcctcctggcatcatactgacactgaggttcgaaagcgtgggtagcaaacaggattagataccctggtagtccacgccgtaaacgatgtctactagtcgttggggaacttgattccttagtgacgcagctaacgcaataagtagaccgcctggggagtacggccgcaaggttaaaactcaaatgaattgacgggggcccgcacaagcggtggagcatgtggtttaattcgatgcaacgcgaagaaccttacctggtcttgacatatctagaatcctgcagagatgcgggagtgccttcgggaattagaatacaggtgctgcatggctgtcgtcagctcgtgtcgtgagatgttgggttaagtcccgcaacgagcgcaacccttttccttagttaccagcggtttggccggggactctaaggatactgccagtgacaaactggaggaaggcggggacgacgtcaagtcatcatggcccttacgaccagggctacacacgtgctacaatggtaggtacagagggctgctacacagcgatgtgatgcgaatctcaaaaagcctatcgtagtccagattggagtctgcaactcgactccatgaagtcggaatcgctagtaatcgcggatcagaatgccgcggtgaatacgttcccgggccttgtacacaccgcccgtcacaccatgggagttgattgcaccagaagtgggtagcctaacttttagagggcgctcaccacggtgtggtcgatgactggggtg

SEQ ID NO: 1799 - DNA, 1327 bp, Pyramidobacter piscolens
gacgaacgctggcggcgtgcttaacacatgcaagttgagcgagcagcggacgggtgagtaaagcacaaggacttgtccgaaagagagggacacctgcgggaaaccggagctaatacctcataaaaaaggcgcttttggagagacttgtgtcctatcaggcagttggtgaggtaacggctcaccaaaccgaagacgggtagccggactgagaggtcgaccggccacattggaactgagagacggtccagactcctacgggaggcagcagtggggaatattgggcaatgggcgcaagcctgacccagcgacgccgcgtgagggaagacagccttcgggttgtaaacctctgttgcaggggaagatgacggtaccctgcgaggaagctccggctaactacgtgccagcagccgcggtaatacgtagggagcgagcgttgtccggaattactgggcgtaaagggcgcgtaggcggcgcttcaagtcgtctgtcaaaagccgaggctcaacctcggtgcgcagacgaaactggagagcttgagaagcagagaggcaaacagaattcctggtgtagcggtgaaatgcgtagatatcaggaagaataccagtggcgaaggcggtttgctggctgcctgacgctgaagcgcgaaagccaggggagcaaacgggattagataccccggtagtcctggcagtaaacgatgtatgctgggtgtgggacgttccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatcaacaggtgctgcatggctgtcgtcagctcgtgtcgtgagatgttgggttaagtcccgcaacgagcgcaacccctattgccggttgctaccagctgagcactccggcgagactgccatcgacaagatggaggaaggtggggacgacgtcaagtcatcatggcccatatgtccagggcgacacacatgctacaatggatggcagagagaagcgagcccgaaaggagaagcagatcccaaccatccccagttcggatgcagtctgcaactcgactgcagaagttggaatcgctagtaatcgcggatcagccaagccgcggtgaatacgttcccgggccttgtacacaccgcccgtcacaccatccgagtcgggtgctctcaaagccggagcctaaggatccgcctaaagagtgtccggtgaggagggtgaagtcgtaacaaggtaaccgtacgggaacgtgc

SEQ ID NO: 1800 - DNA, 1540 bp, Ralstonia pickettii
ttgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 1801 - DNA, 1540 bp, Ralstonia sp.
ttgaactgaagagtttgatcctggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgattaccacggtagggttcatgactggggtgaagtcgtaacaaggtagccgtatcggaaggtgcggctggatcacctccttt

SEQ ID NO: 1802 - DNA, 1515 bp, Raoultella ornithinolytica
cagattgaacgctggcggcacgcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtavagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggctggatcacctcctt

SEQ ID NO: 1803 - DNA, 1436 bp, Raoultella planticola
atcctggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcg

SEQ ID NO: 1804 - DNA, 1454 bp, Raoultella terrigena
tgaacgctggcggcaggcctaacacatgcaagtcgagcggtagcacagaagagcttgctcttcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatga

SEQ ID NO: 1805 - DNA, 1432 bp, Rhodobacter sp.
agagtttgatcctggctcagaacgaacgctggcggcaggcctaacacatgcaagtcgaacgagatcttcggatctagtggcggacgggtgagtaacgcgtgggaacgtgccctttggttcggaatagcctcgggaaactgggagtaataccggatacgcccttcgggggaaagatttatcgccaaaggatcggcccgcgttggattaggtagttggtggggtaacggcctaccaagccgacgatccatagctggtttgagaggatgatcagccacactgggactgagacacggcccagactcctacgggaggcagcagtggggaatcttagacaatgggggcaaccctgatctagccatgccgcgtgatcgatgaaggccttagggttgtaaagatctttcagctgggaagataatgactgtaccagcagaagaagccccggctaactccgtgccagcagccgcggtaatacggagggggctagcgttgttcggaattactgggcgtaaagcgcacgtaggcggaccagaaagtcagaggtgaaatcccagggctcaaccttggaactgcctttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagccatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacactttcagttgccatcattcagttgggcactctgaaagaactgccggtgataagccggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgta

SEQ ID NO: 1806 - DNA, 1466 bp, Rhodobacter sphaeroides
caacttgagagtttgatcctggctcagaatgaacgctggcggcaggcctaacacatgcaagtcgagcgaagtcttcggacttagcggcggacgggtgagtaacgcgtgggaacgtgccctttgcttcggaatagccccgggaaactgggagtaataccgaatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcaggtgggaagataatgacggtaccaccagaagaagccccggctaactccgtgccagcagccgcggtaatacggagggggctagcgttattcggaattactgggcgtaaagcgcacgtaggcggatcggaaagtcagaggtgaaatcccagggctcaaccctggaactgcctttgaaactcccgatcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcgatcgcggttccagagatggttccttcagttcggctggatcgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaacctcgcaagaggaggcagccgaccacggtaggatcagtgactggggtgaagtcgtaacaaggtagccgtaggggaacctgcggctggatcacctcctt

SEQ ID NO: 1807 - DNA, 1477 bp, Rhodococcus corynebacterioides
  misc_feature (970)..(970): n is a, c, g, or t
cctggctcaggacgaacgctggcggcgtgcttaacacatgcaagtcgaacggtaaggcccttcggggtacacgagtggcgaacgggtgagtaacacgtgggtgatctgccctgcacttcgggataagcccgggaaactgggtctaataccggataggactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagccgtngagatacggccccccttgtggtcggtgtacaggtggtgcatggctgtcgtcagctcgtgtcgtgagatgttgggttaagtcccgcaacgagcgcaacccttgtcctgtgttgccagcacgttatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccgg

SEQ ID NO: 1808 - DNA, 1523 bp, Rhodococcus equi
cttcaacggagagtttgatcctggctcaggacgaacgctggcggcgtgcttaacacatgcaagtcgaacggtaaggccccttcgggggtacacgagtggcgaacgggtgagtaacacgtgggtgatctgccctgcactctgggataagcctgggaaactgggtctaataccggatatgagctcctgtcgcatggcgggggttggaaaggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgagagtgacggtacctgcagaagaagcaccggccaactacgtgccagcagccgcggtaatacgtagggtgcgagcgttgtccggaattactgggcgtaaagagctcgtaggcggtttgtcgcgtcgtccgtgaaaacttggggctcaaccccaagcttgcgggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagccgtagagatacggccccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttct

SEQ ID NO: 1809 - DNA, 1527 bp, Rhodococcus erythropolis
acggagagtttgatcctggctcaggacgaacgctggcggcgtgcttaacacatgcaagtcgagcggtaaggcctttcggggtacacgagcggcgaacgggtgagtaacacgtgggtgatctgccctgcacttcgggataagcctgggaaactgggtctaataccggatatgacctcaggttgcatgacttgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaaggtgggatcggcgattgggacgaagtcgtaacaaggtagccgtaccggaaggtgcggctggatcacctcctttctaaggagca

SEQ ID NO: 1810 - DNA, 1424 bp, Rhodococcus fascians
cctggctcaggacgaacgctggcggcgtgcttaacacatgcaagtcgagcggtaaggcctttcggggtacacgagcggcgaacgggtgagtaacacgtgggtgatctgccctgcactctgggataagcttgggaaactgggtctaataccggatatgaccacagcatgcatgtgttgtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttacggggagggagccg

SEQ ID NO: 1811 - DNA, 1489 bp, Rhodopseudomonas palustris
tccaacttgagagtttgatcctggctcagagcgaacgctggcggcaggcttaacacatgcaagtcgaacgggcatagcaatatgtcagtggcagacgggtgagtaacgcgtgggaacataccttttggttcggaacaactgagggaaacttcagctaataccggataagccctaacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcagaggtgaaatcctggagctcaactccagaactgcctttgatactgaaagtcttgagtacgggagaggtgagtggaactgcgagtgtagaggtgaaattcgtagatattcgcaagaacaccagtggcgaaggcggctcactggcccgttactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctaggaccggtcgcagagatgtgaccttctcttcggagcctagagcacaggtgctgcatggctgtcgtcagctcgtgtcgtgagatgttgggttaagtcccgcaacgagcgcaacccccgtctttagttgctaccatttagttgagcactctaaagagactgccggtgataagccgcgaggaaggtggggatgacgtcaagtcctcatggcccttacgggctgggctacacacgtgctacaatggcggtgacaatgggatgctaaagggcaacctctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcct

SEQ ID NO: 1812 - DNA, 1526 bp, Robinsoniella peoriensis
gagagtttgattctggctcaggatgaacgctggcggcgtgcttaacacatgcaagtcgagcgaagcattaaaacagatttcttcggaawgaagttttratgactgagcggcggacgggtgagtaacgcgtgggtgaccygcctcatacagggggataacagacagaaatgtctgctaataccgcataagcgcacagtgctgcatggcacagtgtgaaaaactccggtggtatgagatggacccgcgtctgattagctagttggtaaggtaacggcttaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcatggcaagtctggtgtgaaaggcaggggctcaacccctggactgcattggaaactgtcaggctggagtgcaggagaggtaagtggaattcctagtgtagcggtgaaatgcgtagatattaggaggaacaccagtggcgaaggcgacttactggactgtaactgacgttgaggctcgaaagcgtggggagcaaacaggattagataccctggtagtccacgccgtaaacgatgaatactaggtgtcagggagcaaagctctttggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggacagtaacgtgtcctttccttcgggacaagagtgacaggtggtgcatggttgtcgtcagctcgtgtcgtgagatgttgggttaagtcccgcaacgagcgcaacccttatcttcagtagccagcaattcggttgggcactctggagagactgccagggataacctggaggaaggtggggatgacgtcaaatcatcatgccccttatgatttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggatsaatacgttcccgggtcttgtacacaccgcccgtcacaccatgggagtcggaaatgcccgaagtcagtgacccaaccgtaaggagggagctgccgaaggtggagccggtaactggggtgaagtcgtaacaaggtagccgtatcggaaggtgcggctggatcacctccttc

SEQ ID NO: 1813 - DNA, 1371 bp, Roseburia cecicola
ggatgaacgctggcggcgtgcttaacacatgcaagtcgaacgaagcactctatttgattttcttcggaaatgaagattttgtgactgagtggcggacgggtgagtaacgcgtgggtaacctgctcatacagggggataacagttggaaacgactgctaataccgcataagcgcacagtactgcatggtaccgtgtgaaaaactccggtggtatgagatggacccgcgtctgattagccagttggcggggtacggcccaccaaagcgacgatcagtagccgacctgagagggtgaccggccacattgggactgagacacggcccaaactcctacgggaggcagcagtggggaatattgcacaatgggggaaaccctgagcagcgacgccgcgtgagcgaagaagtatttcggtatgtaaagctctatcagcagggaagaaaaaatgacggtacctgactaagaagcaccggctaaatacgtgccagcagccgcggtaatacgtatgtgcaagcgttatccggatttactgggtgtaaagggagcgcaggcggtgcggcaagtctgatgtgaaagcccggggctcaaccccggtactgcattggaaactgtcgtactagagtgtcggaggggtagtggaattcctagtgtagcggtgaaatgcgtagatattaggaggaacaccagtggcgaaggcggcttactggacgattactgacgctgaggctcgaaagcgtggggagcaaacaggattagatacctggtagtccacgccgtaaacgatgaatactaggtgtcggggagcattgctcttcggtgccgcagcaaacgcaataagtattccacctggggagtacgttcgcaagaatgaaactcaaaggaattgacgggacccgcacaagcggtggagcatgtggtttaattcgaagcaacgcgaagaaccttaccaagtcttgacatccttctgacaatgtatgtaatgtatattctcttcggagcagaagtgacaggtggtcatggttgtcgtcagctcgtgtcgtgagatgttgggttaagtcccgcaacgagcgcaacccttattcttagtagccagcggttcgagactgccagggataacctggaggaaggtggggatgacgtcaatcatcatgccccttatgacctacaatggcgtaaacaaagggaagcaagaccgtgaggtggagcaaatcccaaaaataacgtctctgcaactcgactacacgaagctggaatcgctagtaatcgcgatcagaatgtcgcggtgaataacacaccgcccgtcacaccatgggagttggtaatgcccgaagtcagtgacccaaccgcaaggagaggatcgataactggggtgaa

SEQ ID NO: 1814 - DNA, 1497 bp, Roseburia faecalis
agagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatcgcatgatccggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtacyttctcttcggagcatcggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggtccgataactggggtgaagtcgtaacaaggtagccgt

SEQ ID NO: 1815 - DNA, 1297 bp, Roseburia faecis
gatgaacgctggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgtccttagtagccagcggccgggcactctagggagactgccagggataacctggaggaaggcggggatgacgtcaaatcatcatgccccttatgacttgggctacacacgtgctacaatggcgtacaaagggaagcggagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaatgcccgaagtcagtacccagggagctgccgaaggcaggttcgataactggggtg

SEQ ID NO: 1816 - DNA, 1480 bp, Roseburia hominis
gatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgcggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaagg

SEQ ID NO: 1817 - DNA, 1521 bp, Roseburia intestinalis
agagtttgatcctggctcaggatgaacgctggcggcgtgcttaacacatgcaagtcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagaacatgtaatgtgttttctcttcggagcatcggtgacaggtggtgcatggttgtcgtcagctcgtgtcgtgagatgttgggttaagtcccgcaacgagcgcaacccctattcttagtagccagcgggtaagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggatcgataactggggtgaagtcgtaacaaggtagccgtatcggaaggtgcggctggatcacct

SEQ ID NO: 1818 - DNA, 1454 bp, Roseburia inulinivorans
ttgatcctggctcaggatgaacgctggcggcgtgcttaacacatgcaagtcgaacgaagcacttttacagatttcttcggaatgaagttttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcctttccttcgggacagaagtgacaggtggtgcatggttgtcgtcagctcgtgtcgtgagatgttgggttaagtcccgcaacgagcgcaacccttatccccagtagccagcggttcggacgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgcgaaggcaggt

SEQ ID NO: 1819 - DNA, 1235 bp, Roseburia sp.
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttggaaat

SEQ ID NO: 1820 - DNA, 1231 bp, Roseburia sp.
tggcggcgtgcttaacacatgcaagtcgaacgagtggcggacgggtgagtaacgcgtgggtaacctgcctcatacagggggataacagttggaaacgactgctaataccgcataagaaaaagtggtatgagatggacccgcgtctgattagccagttggcagggtaacggcctaccaaagcgacgatcagtagccaacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgaactgacgctgaggctcgaaagcgtggggagcaaacaggattagataccctggtagtccacgccgtaaacgatgaatactaggtgtcggggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctgttcttagtagccagcggccgggcactctagggagactgccagggataacctggaggaaggcggggatgacgtcaaatcatcatgccccttatgacttgggctacacacgtgctacaatggcgtacaaagggaagcaaagccgtgaggccgagcaaatctcaaaacgtctcagttcggatgtagtctgcaacccgactacagaagctggaatcgctagtaatcgcagatcagaatgctgcggtgaatacgttcccgggtcttgtacacaccgcccgtcacaccatgggagttgg

SEQ ID NO: 1821 - DNA, 1469 bp, Roseiflexus castenholzii
agagtttgatcctggctcaggacgaacgctggcggcgtgcctaatgcatgcaagtcgaacgcacgcgcttcggcgcgtgagtggcgcacggctgagtaacacgtgggaacccgccctccggtgggggataacgagacgaaagtcgcgctaatcccgcatacgtccgcaaggggaaagcgcttcggcgcgccggaggaggggcctgcggcccatcaggtggttggtggggtaacggcctaccaagccgatgacgggtagctggtctgggaggatgaccagccagactgggactgagacacggcccagactcctacgggaggcagcagcaaggaattttcggcaatgggcgcaagcctgaccgagcaacgccgcgtgcgggatgacggccttcgggttgtaaaccgcttttcggggggacgactacgacggtacccccggaagaagccccggctaactctgtgccagcagccgcggtaagacagagggggcgagcgttgtccggagttactgggcgtaaagcgcgcgcaggcggtggtctcagtgtcgtgtgaaagcccccggctcaaccgggggaggtcatggcaaactagacgactagagcggcggagaggcccctcgaattgccggtgtagcggtgaaatgcgtagagatcggcaggaagaccaagggggaagccagggggctggccgctggctgacgctgaggcgcgacagcgtggggagcaaaccggattagatacccgggtagtccacgccgtaaacgatgaccactcggcgtgtggcgactattgacgtcgcggcgcgcctaagcttacgcgtgaagtggtccgcctgggaactacgagcgcaagcttaaaactcaaaggaattgacgggggcccgcacaagcagcggagcgtgtggtttaattcgaggcaacccgaagaaccttacccaggctggacatgacggtgcaggcggcggaaacgtcgcggccttcgagggaccgtcacaggtgctgcatggctgtcgtcagctcgtgtcgtgagatgttgggttaagtcccgcaacgagcgcaacccctgcggttagttaccggtgtctaaccggactgcccttcggggaggaaggcggggatgacgtcaagtccgcatggccctgacgcctggggcgacacacacgctacaatggcgccgacaatgcgtggcgaccgcgcgagcggaggcaaatcgccaaacggcgtctcagtgcagatcgggggctgcaactcgcccccgtgaaggcggagttgctagtaaccgcgtatcagccatggcgcggtgaatacgtacccgggccttgtacacaccgcccgtcacgtcatgggagttgtcaatgcctgaagtccgtgcgctaaccgtcaggaggcagcggccgagggcaggggcagcgactgggacgaagtcgtaacaaggtagccgtaccggaaggtgcggctggatcacctccttt

SEQ ID NO: 1822 - DNA, 1312 bp, Roseomonas cervicalis
aagcagcgatgcgcctttggagtaacctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgctccaagttaggcgtgaaagccctgggctcaacctggggactgcgcttaagactggagtgctagaggatggaagagggttgtggaattcccagtgtagaggtgaaattcgtagatattgggaagaacaccggtggcgaaggcggcaacctggtccatttctgacgctgaggcgcgatagcgtggggagcaaacaggattagataccctggtagtccacgccgtaaacgatgtgcgctgaatgttggggttcctagaacctcagtgttgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggccacgaccggttcagagatgaacttttcccgcaagggacgtggtgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcggtaaccgcaaggagctagcctgccacggtagggtcagtgactggggtgaagtcgtaacaaggtagccgtaggggaacctgcggctggatcacctccttt

SEQ ID NO: 1823 - DNA, 1482 bp, Roseomonas mucosa
ttagtttgatcctggctcagagcgaacgctggcggcatgcttaacacatgcaagtcgcacgggcagcaatgtcagtggcggacgggtgagtaacgcgtaggaacgtgtcctgaggtgggggacaaccccgggaaactggggctaataccgcatatgggctgaggcccaaagccgagaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttggggcccatagggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggtcacgaccggtccagagatggactttcctagcaataggcgtgatgcacaggtgctgcatggctgtcgtcagctcgtgtcgtgagatgttgggttaagtcccgcaacgagcgcaaccctcgcctctagttgccagcatgttcgggtgggcactctagaggaactgccggtgacaagccggaggaaggtggggatgacgtcaagtcctcatggcccttatgggctgggctacacacgtgctacaatggcggtgacagagggaagccaggtcgcgaggccgagccgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttctaccttaagtcgttgcgctaaccagcgatgggggcaggcgaccacggtagggtcagcgactggggtgaagtcgtaacaaggtagccgtaggggaacctgcggttggatcacctcctaa

SEQ ID NO: 1824 - DNA, 1295 bp, Roseomonas sp.
acgctggcggcatgcttaacacatgcaagtcgcacgagtggcggacgggtgagtaacgcgtaggaacgtgtccagaggtgggggacaaccccgggaaactggggctaataccgcatgggcaaaggcgccattggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtc

SEQ ID NO: 1825 - DNA, 1319 bp, Roseomonas sp.
agcgaacgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1826 - DNA, 1314 bp, Roseomonas sp.
acgctggcggcatgcttaacacatgcaagtcgcacgagtggcggacgggtgagtaacgcgtaggaacgtgtccagaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacaatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaagtcgtaacaaggtagccgtagg

SEQ ID NO: 1827 - DNA, 1297 bp, Roseomonas sp.
agcgaacgctggcggcatgcttaacacatgcaagtcgcacgagtggcggacgggtgagtaacgcgtaggaacgtgtcctgaggtgggggacaaccccgggaaactggggctaataccgcatatgcaaaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattsgtagatattgggaagaacaccggtggygaaggcggcgagctggtccaactgacgctgaggcgcgacagcgtggggagcaaacaggattagataccctggtagtccacgccgtaaacgatgtgcgctggatgttggggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgcacaggtgctgcatggctgtcgtcagctcgtgtcgtgagatgttgggttaagtcccgcaacgagcgcaaccctcgcctctagttgccagcatgtgggcactctagaggaactgccggtgacaagccggaggaaggtggggatgacgtcaagtcctcatggcccttatgggctgggctacacacgtgctacdatggcggtcagagggaagccaggtcgcgaggccgagccgatcccggccgtctcagttcggatgcactctgcaactcgggtgcagaaggtggaatcgctagtaatcgcggatcagcacgccgcggtgaatacgttcccgggccttgtacacaccgcccgtcacaccatgggagttggttctaccttaagtcgttcgctaggcaggcgaccacggtagggtcagcgactggggtgaa

SEQ ID NO: 1828 - DNA, 1269 bp, Rothia aeria
  misc_feature (838)..(838): n is a, c, g, or t
  misc_feature (1115)..(1115): n is a, c, g, or t
  misc_feature (1200)..(1200): n is a, c, g, or t
ccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcactatnggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgttntgggcttcacgcatgctacaatggccggtacagagggttgcgatactgtgaggtggagctaatcccttaaagccggtctcagttnggattggggtatgcaactcgaccccatgaagtcggagtcgctagtaatcgcagatcagcaacgctgcgg

SEQ ID NO: 1829 - DNA, 1531 bp, Rothia dentocariosa
ttgtaacggagagtttgattctggctcaggacgaacgctggcggcgtgcttaacacatgcaagtcgaacgatgaagcctagcttgctaggtggattagtggcgaacgggtgagtaatacgtgagtgacctacctttgactctgggataagcctgggaaactgggtctaataccggatacgaccaatctccgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggactgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggactaagtcgtaacaaggtagccgtaccggaaggtgcggctggatcacctcctttct

SEQ ID NO: 1830 - DNA, 1535 bp, Rothia mucilaginosa
tttcaacggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagaaattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaactcctggtgtagcggtggaatgcgcagatatcaggaagaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaaccttttggagggagccgtctaaggtgggattggcgattgggactaagtcgtaacaaggtagccgtaccggaaggtgcggctggatcacctcctttctaagg

SEQ ID NO: 1831 - DNA, 1481 bp, Rothia nasimurium
gacgaacgctggcggcgtgcttaacacatgcaagtcgaacgatgaagcccagcttgctgggtggattagtggcgaacgggtgagtaatacgtgagtaacctgcctttaactctgggataagccttggaaacgaggtctaataccggatacgaccagttcccgcatgggatgctggtggaaagggatatgtactggttttagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagcttgtaggcggtttgtcgcgtctgctgtgaaagcccggggcttaaccccgggtttgcagtgggtacgggctaactagagtgcagtaggggagactggaattcctggtgtagcggtgaaatgcgcagatatcaggaggaacaccaatggcgaaggcaggtctctgggctgtaactgacgctgagaagcgaaagcatggggagcaaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgctctagagatagagtttcccttcggggctggtatacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggatgacgtcaaatcatcatgccccttatgtcttgggcttcacgcatgctacaatggccggtacaaagggttgcgatactgtgaggttgagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccccttgtgggagggagtcgtcgaaggtgggattggcgattgggactaagtcgtaacaaggtagccgtaccggaagg

SEQ ID NO: 1832 - DNA, 1500 bp, Rothia sp.
gagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgc

SEQ ID NO: 1833 - DNA, 1539 bp, Ruminobacter amylophilus
aaagtgaagagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagcctgagggggaaaggctgggcaaccagtcgcattcagatgcgcccaggtgggattagctagttggtggggtaacggcctaccaaggcgacgatctctagctggtctgagaggatgatcagccacactggaactgagacacggtccagactcctacgggaggcagcagtagggaatattgcacaatgggggaaaccctgatgcagccatgccgcgtgtgtgaagaaggcctttgggttgtaaagcactttcagtatggaggaagtgtagtatgttaacagcatgctgcattgacgttacatacagaagaagcaccggctaactccgtgccagcagccgcggtaatacggagggtgcgagcgttaatcggaataactgggcgtaaagagctcgtaggcggtttgtcaagtcagatgtgaaagccccgggcttaacctgggaaccgcatttgaaactgacagactagagtactgtagagggaggtagaattccaggtgtagcggtgaaatgcgtagatatctggaggaataccggtggcgaaggcggcctcctggacagagactgacgctgaggagcgaaagcgtggggagcaaacaggattagataccctggtagtccacgccgtaaacgatgtcaattagaagcatgttgccatgagtagtgtgtttctaagctaacgcgataaattgaccgcctggggagtacggccggcaaggttaaaactcaaatgaattgacgggggcccgcacaagcggtggagcatgtggtttaattcgatgcaacgcgaagaaccttacctggacttgacatattgagaagtatttagagatagatacgtgccgcaaggagctcaaatacaggtgctgcatggctgtcgtcagctcgtgtcgtgagatgttgggttaagtcccgcaacgagcgcaacccttgttctttgttgccagcacgtaaaggtgggaactcaaagaagactgccggtgacaaaccggaggaaggcagggatgacgtcaagtcatcatggcccttacgtccagggctacacacgtgctacaatgggttgtacagagggaagcgaagtcgcgaggtagagcggaacccagaaagcaactcgtagtccggattggagtctgcaactcgactccatgaagtcggaatcgctagtaatcgcgaatcagaatgtcgcggtgaatacgttcccgggccttgtacacaccgcccgtcacaccatgggagtgaattgcaccagaagtagttagcttaacccgcaagggagggcgattaccacggtgtggtttatgactggggtgaagtcgtaacaaggtaaccataggggaacctgtggttggatcacctcctta

SEQ ID NO: 1834 - DNA, 1526 bp, Ruminococcaceae bacterium
agagtttgatcctggctcaggatgaacgctggcggcgtgcttaacacatgcaagtcgaacggagtgcctttgaaagaggattcgtccaattgataaggttacttagtggcggacgggtgagtaacgcgtgaggaacctgccttggagtggggaataacacagtgaaaattgtgctaataccgcataatgcagttgggccgcatggctctgactgccaaagatttatcgctctgagatggcctcgcgtctgattagctagttggtggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccgaggcccggtctagagatagacctttctcttcggagacctcggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaacccctaaaagccatcccagttcggattgcaggctgcaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctcctttct

SEQ ID NO: 1835 - DNA, 1503 bp, Ruminococcus albus
agagtttgatcctggctcaggacgaacgctggcggcacgcttaacacatgcaagtcgaacgagcgaaagagtgcttgcactctctagctagtggcggacgggtgagtaacacgtgagcaatctgcctttcggagagggataccaattggaaacgattgttaatacctcataacataacgaagccgcatgactttgttatcaaatgaatttcgccgaaagatgagctcgcgtctgattaggtagttggtgaggtaacggcccaccaagccgacgatcagtagccggactgagaggttgaacggccacattgggactgagacacggcccagactcctacgggaggcagcagtggggaatattgcacaatgggcgaaagcctgatgcagcgatgccgcgtgagggaagaaggttttaggattgtaaacctctgtctttggggacgataatgacggtacccaaggaggaagctccggctaactacgtgccagcagccgcggtaatacgtagggagcgagcgttgtccggaattactgggtgtaaagggagcgtaggcgggattgcaagtcaggtgtgaaatttaggggcttaacccctgaactgcacttgaaactgtagttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggtttaattcgaagcaacgcgaagaaccttaccaggtcttgacatcgtacgcatagcatagagatatgtgaaatcccttcggggacgtatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggctacacacgtactacaatggctgttaacagagggaagcaaaacagtgatgtggagcaaaaccctaaaagcagtcttagttcggattgtaggctgcaacccgcctacatgaagtcggaattgctagtaatcgcggatcagcatgccgcggtgaatacgttcccgggccttgtacacaccgcccgtcacgccatgggagtcggtaacacccgaagcctgtgttctaaccgcaaggaggaagcagtcgaaggtgggattgatgactggggtgaagtcgtaacaaggtagccgtatcggaaggtgcggctggatcacctcctt

SEQ ID NO: 1836 - DNA, 1452 bp, Ruminococcus bromii
gacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgayatatcggaaccacatggttytgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtg

SEQ ID NO: 1837 - DNA, 1371 bp, Ruminococcus callidus
ttaacacatgcaagtcgaacggagaacattgagcttgcttaatgttcttagtggcggacgggtgagtaacacgtgagtaacctgcctctgagagtgggatagcttctggaaacggatggtaataccgcataacatcatggattcgcatgtttctgtgatcaaagatttatcgcttagagatggactcgcgtctgattagctagttggtaaggtaacggcttaccaaggcgacgatcagtagccggactgagaggttgatcggccacattgggactgagacacggcccagactcctacgggaggcagcagtggggaatattgcacaatgggggaaaccctgatgcagcgatgccgcgtggaggaagaaggttttcggattgtaaactcctgttgaagaggacgataatgacggtactcttttagaaagctccggctaactacgtgccagcagccgcggtaatacgtagggagcgagcgttgtccggaattactgggtgtaaagggagcgtaggcgggatggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttactgggcctttactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgacgtacctagagataggtattttcttcggaacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaatataacagagggaagcaatacagcgatgtggagcaaatccccaaaaattgtcccagttcagattgcaggctgcaactcgcctgcatgaagtcggaattgctagtaatcgcagatcagcatgctgcggtgaatacgttcccgggccttgtacacaccgcccgtcacaccatgggagtcggtaacacccaaagccggtcgtctaacctt

SEQ ID NO: 1838 - DNA, 1494 bp, Ruminococcus champanellensis
agagtttgatcctggctcaggacgaacgctggcggcacgcctaacacatgcaagtcgaacggagataaagacttcggtttttatcttagtggcggacgggtgagtaacacgtgagcaacctgcctctgagagagggatagcttctggaaacggatggtaatacctcataacatagcggtaccgcatgatactgctatcaaagatttatcgctcagagatgggctcgcgtctgattagctagatggtgaggtaacggctcaccatggcgacgatcagtagccggactgagaggttgaacggccacattgggactgagacacggcccagactcctacgggaggcagcagtggggaatattgcacaatgggcgcaagcctgatgcagcgatgccgcgtggaggaagaaggttttcggattgtaaactcctgtcttaagggacgataatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgagtgaatgatctagagatagatcagtccttcgggacacaaagacaggtggtgcatggttgtcgtcagctcgtgtcgtgagatgttgggttaagtcccgcaacgagcgcaacccttacctttagttgctacgcaagagcactctagagggactgccgttgacaaaacggaggaaggtggggatgacgtcaaatcatcatgccccttatgacctgggctacacacgtactacaatggcaatgaacagagggaagcaatacagtgatgtggagcaaatccccaaaaattgtcccagttcagattgtaggctgcaactcgcctacatgaagtcggaattgctagtaatcgcagatcagcatgctgcggtgaatacgttcccgggccttgtacacaccgcccgtcacaccatgggagtcggtaacacccgaagccagtagcctaaccgcaaggagggcgctgtcgaaggtgggattgatgactggggtgaagtcgtaacaaggtagccgtatcggaaggtgcggctggatcacct

SEQ ID NO: 1839 - DNA, 1388 bp, Ruminococcus flavefaciens
  misc_feature (157)..(157): n is a, c, g, or t
  misc_feature (276)..(276): n is a, c, g, or t
gctggcggcacgcttaacacatgcaagtcgaacggagataatttgagtttacttaggttatcttagtggcggacgggtgagtaacacgtgagcaacctaccttagagagagggatagcttctggaaacggatggtaatacctcataacataactganccgcatgatttagttatcaaagatttatcactctgagatgggctcgcgtctgattagatagttggtgaggtaacggctcaccaagtcgacgatcagtagccggactgagaggttgaacngccacattgggactgagacacggcccagactcctacgggaggcagcagtggggaatattgcacaatgggggaaaccctgatgcagcgatgccgcgtggaggaagaaggttttcggattgtaaactcctgtcttaaaggacgataatgacggtactttaggaggaagctccggctaactacgtgccagcagccgcggtaatacgtagggagcgagcgttgtccggaattactgggtgtaaagggagcgtaggcgggagcgcaagtcagatgtgaaatacatgggctcaacccatgggctgcatttgaaactgtgtttcttgagtgaagtagaggtaagcggaattcctggtgtagcggtgaaatgcgtagatatcaggaggaacaccggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacgsccscaaggttgaaactcaaaggaattgacgggggcccgcacaagcagtggagtatgtggtttaattcgaagcaacgcgaagaaccttaccaggtcttgacatcgtatgcatagtctagagatagatgaaattccttcggggacatatagacaggtggtgcatggttgtcgtcagctcgtgtcgtgagatgttgggttaagtcccgcaacgagcgcaacccttacctttagttgctacgcaagagcactctaaagggactgccgttgacamaacggaggaaggtggggatgacgtcaaatcatcatgccccttatgacctgggctacacacgtactacaatggcaattaacaaagagaagcaagacggtgacgtggagcgaatctcaccaaattgtcccagttcagattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcggtagtctaacagc

SEQ ID NO: 1840 - DNA, 1481 bp, Ruminococcus gnavus
  misc_feature (148)..(148): n is a, c, g, or t
  misc_feature (1071)..(1071): n is a, c, g, or t
  misc_feature (1341)..(1341): n is a, c, g, or t
tgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacgnctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcancccctatctttagtagccagcattttggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgtncccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaagg

SEQ ID NO: 1841 - DNA, 1446 bp, Ruminococcus hansenii
  misc_feature (25)..(25): n is a, c, g, or t
  misc_feature (105)..(105): n is a, c, g, or t
  misc_feature (182)..(182): n is a, c, g, or t
  misc_feature (244)..(244): n is a, c, g, or t
  misc_feature (280)..(280): n is a, c, g, or t
  misc_feature (343)..(344): n is a, c, g, or t
  misc_feature (395)..(395): n is a, c, g, or t
  misc_feature (510)..(510): n is a, c, g, or t
  misc_feature (529)..(529): n is a, c, g, or t
  misc_feature (600)..(600): n is a, c, g, or t
  misc_feature (602)..(602): n is a, c, g, or t
  misc_feature (612)..(612): n is a, c, g, or t
  misc_feature (645)..(646): n is a, c, g, or t
  misc_feature (676)..(676): n is a, c, g, or t
  misc_feature (911)..(911): n is a, c, g, or t
  misc_feature (915)..(915): n is a, c, g, or t
  misc_feature (949)..(950): n is a, c, g, or t
  misc_feature (1114)..(1114): n is a, c, g, or t
  misc_feature (1126)..(1127): n is a, c, g, or t
  misc_feature (1177)..(1178): n is a, c, g, or t
  misc_feature (1192)..(1194): n is a, c, g, or t
  misc_feature (1367)..(1367): n is a, c, g, or t
  misc_feature (1386)..(1387): n is a, c, g, or t
  misc_feature (1424)..(1424): n is a, c, g, or t
gagagtttgatcctggctcaggatnaacgctggcggcgtgcttaacacatgcaagtcgagcgaagcacttatcattgactcttcggaagatttgatatttgactnagcggcggacgggtgagtaacgcgtgggtaacctgcctcatacaggggaataacagttagaaatggctgctaatgcncataagcgcacagggaccgcatggtctggtgtgaaaaactgaggtggtatgagatggacccncgtctgattaggtagttggtggggtaacggcctacnaagccgacgatcagtagccggcctgagagggtgaacggccacattgggactgagacacggccnngactcctacgggaggcagcagtggggaatattgcacaatgggggaaacccngatgcagcgacgccgcgtgaaggaagaagtatctcggtatgtaaacttctatcagcagggaagaaaatgacggtacctgactaagaagccccggctaactacgtgccagcagccncggtaatacgtagggggcnagcgttatccggatttactgggtgtaaagggagcgtagacggaagagcaagtctgatgtgaaaggctgggncntaaccccagnactgcattggaaactgtttttctagagtgccgnngaggtaagcggaattcctagtgtagcggtnaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacgggnaccngcacaagcggtggagcatgtggtttaattcgaannaacgcgaagaaccttaccaagtcttgacatctgcctgaccgttccttaaccggagctttcttcgggacaggcaagacaggtggtgcatggttgtcgtcagctcgtgtcgtgagatgttgggttaagtcccgcaacgagcgcaacccctatccttagtagccagnagtccggctggnnactctagggagactgccggggataacccggaggaaggcggggacgacgtnnaatcatcatgcccnnnatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccnggtcttgtacacaccgccnntcacaccatgggagtcagtaacgcccgaagtcagtgncccaaccttatggagggagctg

SEQ ID NO: 1842 - DNA, 1529 bp, Ruminococcus lactaris
gagagtttgatcctggctcaggatgaacgctggcggcgtgcttaacacatgcaagtcgagcgaagcactttgctttgatttcttcgggatgaagagcttagtgactgagcggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagttagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaacccggggctcaaccccgggactgcattggaaactgttgatctggagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggtggcaaagccattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgacggcagagtaatgtctgcttttcttcggaacaccggtgacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttct

SEQ ID NO: 1843 - DNA, 1490 bp, Ruminococcus obeum
agagtttgatcctggctcagaatgaacgctgcggcgtgtttaacacatgcaagtcgaacgggaattattttatttgaaacttcggtcgatttaattattctagtggcggacgggtgagtaacgcgtgggtaacctgccttatacagggggataccagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtaacc

SEQ ID NO: 1844 - DNA, 1368 bp, Ruminococcus sp.
tcgaacggagataaagacttcggtttttatcttagtggcggacggttgagtaacacgtgagcaacctgcctttgagagagggatagcttctggaaacggatggtaatacctcataacatagcggtaccgcatgatactgctatcaaagatttatcgctcagagatgggctcgcgtctgattagctagatggtgaggtaacggttcaccatggcgacgatcagtagccggactgagaggttgaacggccacattgggactgagacacggcccagactcctacgggaggcagcagtgcggaatattgcacaatgacgcaagcctgatgcagcgatgccgcgtggaggaagaaggttttcggattgtaaactcctgtcttaagggacgataatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgagtgaatgatctagagatagatcagtccttcgggacacaaagacaggtggtgcatggttgtcgtcagctcgtgtcgtgagatgttgggttaagtcccgcaacgagcgcaacccttacctttagttgctacgcaagagcactctagagggactgccgttgacaaaacggaggaaggtggggatgacgtcaaatcatcatgccccttatgacctgggctacacacgtactacaatggcaatgaacagagggaagcaatacagtgatgtggagcaaatccccaaaaattgtcccagttcagattgtaggctgcaactcgcctacatgaagtcggaattgctagtaatctgcagctcagcatgctgcggtgaatacgttcccgggccttgtacacgccgcccgtcacaccatgggagtcggtaacacccgaagccagtagcctaaccgcaaggagggcgctgt

SEQ ID NO: 1845 - DNA, 1523 bp, Ruminococcus sp.
gagagtttgatcctggctcaggatgaacgctggcggcgtgcttaacacatgcaagtcgaacgggaattactttattgacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttct

SEQ ID NO: 1846 - DNA, 1223 bp, Ruminococcus sp.
cacgcctaacacatgcaagtcgaacgagtggcggacgggtgagtaacacgtgagcaacctgcctctgagagagggatagcttctggaaacggatggtaatacctcataaccaaagtcgctcagagatggtctcgcgtctgattagctagatggtgaggtaacggctcaccatggcgacgatcagtagccggactgagaggttgaacggccacattgggactgagacacggccagactcctacgggaggcagcagtggggaatattgcacaatgggcgcaagcctgatgcagcgatgccgcgtggaggaagaaggttttcggattgtaaactcctgtcttaagggacgatgacggtaccttaggaggaagctccggctaactacgtgccagcagccgcggtaatacgtagggagcgagcgttgtccggaattactgggtgtaaagggagcgtaggcgggattgcaagtcagatgtgaaaactatgggcttaacccatagactgcatttgaaactgtagttcttgagtgaagtagaggtaagcggaattcctagtgtagcggtgaaatgcgtagatattaggaggaacatcggtggcgaaggcggcttactgggcttactgacgctgaggctcgaaagcgtggggagcaaacaggattagataccctggtagtccacgctgtaaagatgattactaggtgtgggggcttccgtgccgcagttaacacaataagtaatccacctggggagtacggccgcaaggttgaaactcaaaggaattgacgggggcccgcacaagcagtggagtatgtggtttaattcgaagcaacgcgaaaaaccttaccaggtcttgacatcgacaggtggtgcatggttgtcgtcagctcgtgtcgtgagatgttgggttaagtcccgcagcgagcgcaacccttacctttagttgctacagcactctagagggactgccgttgacaaaacggaggaaggtggggatgtcgtcaaatcatcatgccccttatgactgggctacacacgtactacaatggcaatcagagggaagcaatacagtgatgtggagcaaatccccattgtcccagttcagatgtaggctcaactcgcctacagaagtcggaattgctagtaatcgcagctcagcatgccgcggtgaatacgttaacgggccttgtacacggcgcccgtcacaccatgggagtcggtaacaaccg

SEQ ID NO: 1847 - DNA, 1416 bp, Ruminococcus sp.
ctagggatgaacgctggcggcgtgcctaacacatgcaagtcgagcgaagattgttttcagaatcttcggaggaagaggacagttactgagcggcggacgggtgagtaacgcgtgggcaacctgcctcatacagggggataacagttagaaatgactgctaataccgcataagcgcacaggaccgcatggtgtagtgtgaaaaactccggtggtatgagatggacccgcgtctgattaggtagttggtggggtaaaggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaagatgacggtacctgagtaagaagcaccggctaaatacgtgccagcagccgcggtaatacgtatggtgcaagcgttatccgggtttactgggtgtaaagggagcgtagacggataggcaagtctggagtgaaaacccagggctcaaccctgggactgctttgggaactgcagatctcgagtgccggagaggtaagcggaattcctagtgtagcggtgaaatdcgtaratattaggaggagcaccagtggcgaagcggcttactggacggtgaytgacgttgaggctcgaaagcgtggggagcaaaaaggattagataccctggtagtccacgccgtaaacgataactactaggtgtcggtktcaaagcacatcggtgccgcagaaaacgcaataagtagtccacctggggagtacgttcgcaagaatgaaactcaaaggaattgacggggacccgcacaagcggtggagcatgtggtttaattcgaagcaacgcgaagaaccttacctggtcttgacatccggatgacgggcgagtaatgtcgccgtcttcggggcatccgagacaggtggtgcatggttgtcgtcagctcgtgtcgtgagatgttgggttaagtcccgcaacgagcgcaacccttatcttcagtagccagcatataaggtgggcactctggagagactgccaggggagaacctggaggaaggtggggatgacgtcaaatcatcatgccccttatggccagggctacacacgtgctacaatggcgtaaacaaagggaagcgagagggtgacctggagcgaatcccaaaaataacgtctcagttcggattgtagtctgcaactcgactacatgaagctggaatcgctagtaatcgcggatcagcatgccgcggtgaatacgttcccgggtcttgtacacaccgcccgtcacaccatgggagtcagtaacgcccgaagccagtgacccaaccttag

SEQ ID NO: 1848 - DNA, 1286 bp, Ruminococcus sp.
cctggctcaggatgaacgctggcggcgtgcttaacacatgcaagtcgaacgagtggcggacgggtgagtaacgcgtgggtaacctgccttatacagggggataacagtcagaaatggctgctaataccgcataagaaaaagtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggactgacgttgaggctcgaaagcgtggggagcaaacaggattagataccctggtagtccacgccgtaaacgatgaatactaggtgtcggggcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcgacaggtggtgcatggttgtcgtcagctcgtgtcgtgagatgttgggttaagtcccgcaacgagcgcaacccctatcctcagtagccagcatgtgggcactctggggagactgccagggataacctggaggaaggcggggatgacgtcaaatcatcatgccccttatgatttgggctacacacgtgctacaatggcgtacaaagggaagcgagattgtgagatggagcaaatcccaaaacgtcccagttcggatgtagtctgcaacccgactacagaagctggaatcgctagtaatcgcggatcagaatgccgcggtgaatacgttcccgggtcttgtacacaccgcccgtcacaccatgggagtcagtaacgcccgaagtcagtacctaaggagctgccgaag

SEQ ID NO: 1849 - DNA, 1528 bp, Ruminococcus torques
gagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtccccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttct

SEQ ID NO: 1850 - DNA, 1375 bp, Saccharomonospora viridis
  misc_feature (95)..(95): n is a, c, g, or t
  misc_feature (128)..(128): n is a, c, g, or t
  misc_feature (155)..(155): n is a, c, g, or t
  misc_feature (167)..(167): n is a, c, g, or t
  misc_feature (293)..(293): n is a, c, g, or t
  misc_feature (341)..(341): n is a, c, g, or t
  misc_feature (776)..(776): n is a, c, g, or t
  misc_feature (854)..(854): n is a, c, g, or t
  misc_feature (890)..(890): n is a, c, g, or t
  misc_feature (917)..(917): n is a, c, g, or t
  misc_feature (920)..(920): n is a, c, g, or t
  misc_feature (1001)..(1001): n is a, c, g, or t
  misc_feature (1030)..(1031): n is a, c, g, or t
  misc_feature (1172)..(1172): n is a, c, g, or t
  misc_feature (1179)..(1179): n is a, c, g, or t
  misc_feature (1181)..(1181): n is a, c, g, or t
  misc_feature (1289)..(1290): n is a, c, g, or t
  misc_feature (1292)..(1292): n is a, c, g, or t
  misc_feature (1294)..(1294): n is a, c, g, or t
  misc_feature (1298)..(1298): n is a, c, g, or t
  misc_feature (1333)..(1333): n is a, c, g, or t
  misc_feature (1354)..(1354): n is a, c, g, or t
tgagtggcgaacgggtgagtaacacgtgggtaatctgccctgtactctgggataagcctgggaaactgggtctaataccggataggcaccagctnccgcatggtggtgtgtggaaagctgcggcggtncaggatgagccggcggcccatcagctngttggtggggtnatggcctaccaaggcgacgacgggtagccggcctgagagggtgaccggccacactgggactgagacacggcccagactcctaccggaggcagcagtggggaatattgcacaatggacggaagcctnatgcagcgacgccgcgtgggggatgacggccttcgggttgtaaacccntttcgcccgggacgaagcgagagtgacggtaccgggagaagaagcaccggctaactacgtgccagcagccgcggtaatacgtagggtgcaagcgtggtccggaatgattgggcgtaaagagctcgtaggcggtgtgtcgcgtctgccgtgaaaacctgcggctgaaccgtgggcgtgcggtggatacgggcacactggagttcggtaggggagactggaattcctggtgtagcggtgaaatgcgcagatatcaggaggaacgccagtggcgaaggcggggctctgggccgaaactgacgctgaggagcgaaagcgtggggagcgaacaggattagataccctggtagtccacgccgtaaacggtgggcgctaggtgtgggatgctgtgcacgtgtcccgtgccgtagctaacgcatgaagcgccccgcctggggngtacggccgcaaggctaaaactcaaaggaatggacgggggcccgcacaagcggcggagcatgtggattaattcgatgnaacgcgaagaacctgacctgggtgggacatgcactngaccggcgtagagatacgccggccctngtngctggtgcacaggtggtgcatggctgtcgtcagctcgtgtcgtgagatgttgggttaagtcccgcaacgagcgcaaccctngtcccatgttgccagcgggtaatgccggnnactcgtgggagactgccggggttaactcggaggaaggtggggatgacgtcaagtcatcatgccccttatgcccagggctgcacacatgctacaatggccagtacagagggtggcgagaccgtgaggtggagcgaatcccgnaaagctngnctgagttcggatcgtggtctgcaactcgactgcgtgaagtcggagtcgctagtaatcgcagatcagcaacgctgcggtgaatrcgttcccgggccttgtacacaccgnncntnacgncatgaaagtcggtaacacccgaagcccatggcctnaccccgtcaggggagggagtngtcgaaggtgggacccgcgat

SEQ ID NO: 1851 - DNA, 1461 bp, Sarcina ventriculi
  misc_feature (1413)..(1413): n is a, c, g, or t
  misc_feature (1431)..(1431): n is a, c, g, or t
  misc_feature (1450)..(1450): n is a, c, g, or t
gatgaacgctggcggcgtgcttaacacatgcaagtcgagcgagaaaagttcttcggagcttttctagcggcggacgggtgagtaacacgtgggcaacctgcctcatacaccccaatagccttccgaaaggaagattaataccgcataacattgttgaaaggcatcttttaacaatcaaaggagcaatccgctatgagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggattgtaaagctctgtctttagggacgataatgacggtacctaaggaggaagccacggctaactacgtgccagcagccgcggtaatacgtaggtggcaagcgttatccggatttactgggcgtaaagggagcgtaggcgatatttaagtgggatgtgaaatacccgagcttaacttgggagctgcattccaaactggatatctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggccccaagcctctgtgccgccgctaacgcattaagtattccgcctggggagtacggtcgcaagattaaaactcaaaggaattgacggggacccgcacaagcagcggagcatgtggtttaattcgaagcaacgcgaagaaccttacctagacttgacatgtcctgaattaccagtaatgtgggaagttccttcgggaacaggaacacaggtggtgcatggttgtcgtcagctcgtgtcgtgagatgttgggttaagtcccgcaacgagcgcaacccttattgttagttggtaccattaagttgaccactctagcgagactgcccgggttaaccgggaggaaggtggggatgacgtcaaatcatcatgccccttatgtctagggctacacacgtgctacaatggcaagtacaaagagaagcaatactgtgaagtggagcaaaactcaaaaacttgtctcagttcggattgtaggctgaaactcgcctacatgaagctggagttgctagtaatcgcgaatcagaatgtcgcggtgaatacgttcccgggtcttgtacacaccgcccgtcacaccatgagagttggcaatacccgaagtccgtaagctaaccgtaaggaggcagcggccgaaggtngggtcagcgattggggtnaagtcgtaacaaggtagcngtaggagaacc

SEQ ID NO: 1852 - DNA, 1557 bp, Scardovia inopinata
  misc_feature (967)..(967): n is a, c, g, or t
agagtttgatcatggctcaggacgaacgctggcggcgtgcttaacacatgcaagtcgaacgggatcctgcttggtttttgctgggtgggtgagagtggcgaacgggtgagtaatgcgtgactaacctgccgtgtagttgggtatagctcctggaaacgggtggtaataccgaatggtccactgggctgcatggtctggtgggaaagttttgtgtgctatgcgatggggtcgcgtcctatcagcttgttggtggggtgatggcctaccaaggcttcgacgggtagccggcctaagagggcgaccggccacattgggactgagatacgcccagactcctacgggaggcagcagtggggaatattgcacaatggggggaaccctgatgcagcgacgccgcgtgcgggatggaggccttcgggttgtgaaccgcttttattggggagcaagctggccctgtgttgggttggtgagtgtacttggtgaataagcaccggccaactacgtgccagcagccgcggtaatacgtagggtgccagcgttgtccggatttattgggcgtaaagggctcgtaggcggttcgtcgcgtctggtgtgaaagcttactgcttaacggtgggtttgcgttggatacgggcgggcttgagtgcagtaggggagactggaattctcggtgtaacggtggaatgtgtagatatcgggaagaacacctatggcgaaggcaggtctctgggctgttactgacgctgaggagcgaaagcgtggggagcgaacaggattagataccctggtagtccacgctgtaaacggtggacgctggatgtggggcctatttccacgggttctgtgtcggagctaacgcgttaagcgtcccgcctggggagtacggccgcaaggttaaaactcaaagaaattgacgggggcccgcacaagcggcggagcatgcggattaattcgatgcaacgcgaanaaccttaccagggcttgacatgtgagcgttgatcttagagatagggtttcccttcggggcgctttcacaggtggtgcatggtcgtcgtcagctcgtgtcgtgagatgttgggttaagtccccgcaaacgagcgcaacccttgccttgtgttgccagccggttcttgcccggggaactcaacaaagggaaccgcccgggggttaaacttcgggaaggaaagggtgggggatgacgtccagaatcatcatgccccttaacgtcctggggcttcaacgcatgctacaatggctggtacagcggggatgcgatacggtgacgtggagcggatcctgtaaaaccggtctcagttcggatcggagcctgcaactcggctccgtgaaggtggagtcgctagtaatcgcggatcagcagtgccgcggtgaatgcgttcccgggccttgtacacaccgcccgtcaagtcatgaaagtgggcagcacccgaagccggtggcctaacccttgtggggagaaccgtctaaggtgaggttcgcgattgggactaagtcgtaacaaggtagccgtaccggaaggtgcggctggatcacctcctt

SEQ ID NO: 1853 - DNA, 1294 bp, Scardovia wiggsiae
gacgaacgctggcggcgtgcttaacacatgcaagtcgaacgagtggcgaacgggtgagtaatgcgtgactaacctgccgtatggttggggatagctcctggaaacgggtggtaatacccaatgctgaaaggtgccatatgatggggtcgcgtcctatcagcttgttggtggggtgatggcctaccaaggcgtcgacgggtagccggcctaagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttataggggggcatgagtggactttatgaataagcaccggctaactacgtgccagcagccgcggtaatacgtagggtgcaagcgttgtccggatttattgggcgtaaagggctcgtaggcggtttgttgcgtctggtgtgaaagcttactgcttaacggtaggttgcgctggatacgggcaggcttgagtgcagtaggggagactggaattctcggtgtaacggtggaatgtgtagatatcgggaagaacacctatggcgaaggcaggtctctgggctgactgacgctgaggagcgaaagcgtggggagcgaacaggattagataccctggtagtccatgctgtaaacggtggacgctggatgtggggcgttctgtgtcggagctaacgcgttaagcgtcccgcctggggagtacggccgcaaggttaaaactcaaagaaattgacgggggcccgcacaagcggcggagcatgcggattaattcgatgcaacgcgaagaaccttaccagggcttgacatatacaggtggtgcatggtcgtcgtcagctcgtgtcgtgagatgttgggttaagtcccgcaacgagcgcaacccttgccttgtgttaccagcggccggggactcacaagggaccgccggggttaactcggaggaaggtggggatgacgtcagatcatcatgccccttacgtcctgggcttcacgcatgctacaatggctggcagcgggatgcgatactgtaaggtggagcggatcctgtccggtctcagttcggacggggcctgcaactcggcctcggaaggtggagtcgctagtaatcgcggatcagcagtgccgcggtgaatgcgttcccgggccttgtacacaccgcccgtcaagtcatgaaagtgggcagcacccgaagccggtgcctagggagccgtctaaggtgaggttcgcgattggg

SEQ ID NO: 1854 - DNA, 1504 bp, Segniliparus rotundus
agagtttgattctggctcaggacgaacgctggcggcgtgcctaacacatgcaagtcgaacggtaaggcccttcggggtacacgagtggcgaacgggtgagtaacacgtgggcaatctgccctgcactctgggataagcctgggaaactgggtctaataccggatatgagtctccaccgcatggcggagactggaaagtttttcggtgcaggatgagcccgcggcctatcagctagttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgcgggatgacggccttcgggttgtaaaccgctttcagcagggacgaagcgcaagtgacggtacctgcaaaagaagcaccggctaactacgtgccagcagccgcggtaatacgtagggtgcgagcgttgttcggaattactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgctgtaaacggtgggcgctaggtgtgggtttccttccatgaaatccgtgccgtagctaacgcattaagcgccccgcctggggagtacggccgcaaggctaaaactcaaagaaattgacgggggcccgcacaagcggcggagcatgtggattaattcgatgcaacgcgaagaaccttacctgggtttgacatggactggaaagccgtagagatacggccccccttgtggtcggttcacaggtggtgcatggctgtcgtcagctcgtgtcgtgagatgttgggttaagtcccgcaacgagcgcaacccttgtcctgtgttgccagcgcgtaatggcggggactctcaggaaactgccggggtcaactcggaggaaggtggggacgacgtcaagtcatcatgccccttatgtccagggcttcacacatgctacaatggcgcgtacagagggcagcgatatcgcaaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaaccttttaggagggagccgtcgaaggtgggattggcgattgggactaagtcgaaacaaggtagccgtaccggaaggtgcggctggatcacct

SEQ ID NO: 1855 - DNA, 1520 bp, Segniliparus rugosus
ctttcacggagagtttgattctggctcaggacgaacgctggcggcgtgcctaacacatgcaagtcgaacgatgaagcccttcggggtggattagtggcgaacgggtgagtaacacgtgggcaatctgccctgcactctgggataagcctgggaaactgggtctaataccggatatgagcttccaccgcatggtggaggttggaaagtttttcggtgcaggatgagcccgcggcctatcagctagttggtggggtaacggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcaaaagaagcaccggctaactacgtgccagcagccgcggtaatacgtagggtgcgagcgttgttcggatttactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacaggattagataccctggtagtccacgctgtaaacggtgggcgctaggtgtgggtttccttccatgaaatccgtgccgtagctaacgcattaagcgccccgcctggggagtacggccgcaaggctaaaactcaaagaaattgacgggggcccgcacaagcggcggagcatgtggattaattcgatgcaacgcgaagaaccttacctgggtttgacatggactggaaagccgtagagatacggccccccttgtggtcggttcacaggtggtgcatggctgtcgtcagctcgtgtcgtgagatgttgggttaagtcccgcaacgagcgcaacccttgtcctgtgttgccagcgcgtaatggcggggactctcaggaaactgccggggtcaactcggaggaaggtggggacgacgtcaagtcatcatgccccttatgtccagggcttcacacatgctacaatggcgcgtacagagggcagcgatatcgcaaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaaccttttaggagggagccgtcgaaggtgggattggcgattgggactaagtcgaaacaaggtagccgtaccggaaggtgcggctggatcacctcctttct

SEQ ID NO: 1856 - DNA, 1520 bp, Selenomonas artemidis
gagtttgatcctggctcaggacgaacgctggcggcgtgcttaacacatgcaagtcgaacggagcgaatgaaagcttgcttttatgagcttagtggcaaacgggtgagtaacacgtagacaacctgccgatcagatggggacaacattccgaaaggaatgctaataccgaatggcgtgtaggggaggcatcttccctacatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtacataagttgaataagcttatgtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgaaaggcgtagagatacgtccctctcttcggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagagcgatcttaagcgaacctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcgg

SEQ ID NO: 1857 - DNA, 1520 bp, Selenomonas dianae
gagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggatgggaggcatctcctatccgtgaaagatggcctctatttataagctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgagaggtgaataaactcttgcaatgacggtacctgtcgaggaagccacggctaactacgtgccagcagccgcggtaatacgtaggtggcgagcgttgtccggaatcattgggcgtaaagggagcgcaggcgggcatataagtctttcttaaaagttcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagcgctagagatagctccctctcttcggagacaggaaaacaggtggtgcatggctgtcgtcagctcgtgtcgtgagatgttgggttaagtcccgcaacgagcgcaacccctgttctttgttgccatcacgttatggtgggcactcaaaggagactgccgcggagaacgcggaggaaggcggggatgacgtcaagtcatcatgccccttatggtctgggctacacatgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcgg

SEQ ID NO: 1858 - DNA, 1484 bp, Selenomonas flueggei
  misc_feature (77)..(77): n is a, c, g, or t
  misc_feature (82)..(82): n is a, c, g, or t
  misc_feature (89)..(90): n is a, c, g, or t
  misc_feature (216)..(216): n is a, c, g, or t
  misc_feature (218)..(218): n is a, c, g, or t
  misc_feature (574)..(574): n is a, c, g, or t
  misc_feature (593)..(593): n is a, c, g, or t
  misc_feature (602)..(602): n is a, c, g, or t
  misc_feature (657)..(657): n is a, c, g, or t
  misc_feature (731)..(731): n is a, c, g, or t
  misc_feature (781)..(781): n is a, c, g, or t
  misc_feature (821)..(821): n is a, c, g, or t
  misc_feature (946)..(946): n is a, c, g, or t
  misc_feature (948)..(948): n is a, c, g, or t
  misc_feature (1019)..(1019): n is a, c, g, or t
  misc_feature (1148)..(1148): n is a, c, g, or t
  misc_feature (1158)..(1158): n is a, c, g, or t
  misc_feature (1305)..(1305): n is a, c, g, or t
gagagtttgatcctggctcaggacgaacgctggcggcgtgcttaacacatgcaagtcgaacggagcgaatgaaagcntgcanttatganncttagtggcaaacgggtgagtaacacgtagacaacctgccgacaggatggggacaacattccgaaaggaatgctaataccgaatgaagcggaggagaggcatctctcttccgtgaaagatggccantntttatgctatcacctgttgatgggtctgcgtctgattagctggtaggtgaggtaacggctcacctaggcgacgatcagtagccggtctgagaggatgaacggccacattgggactgagacacggcctagactcctacgggaggcagcagtggggaatcttccgcaatgggcgcaagcctgacggagcaacgccgcgtgagtgaagaaggtcttcggatcgtaaagctctgttgttcgggacgaacgtgcgtgatgcgaacagtgtcatgcaatgacggtacctgtcgaggaagccacggctaactacgtgccagcagccgcggtaatacgtaggtggctagcgttgtccggaatcnttgggcgtaaagggagcgnaggcgggcnagtaagtctttcttaaaagtgcggggctcaaccccgtgatgggaaagaaactacntgtcttgagtacgggagaggaaagcggaattcccagtgtagcggtgaaatgcgtagatattgggaggaacgccngtggcgaaggcggctttctggactgcgactgacgctgaggctcgaaagcnaggggagcgaacgggattagataccccggtagtcctggcngtaaacgatggatactaggtgtgggaggtatcgacccctaccgtgccggagttaacgcaataagtatcccgcctggggagtacggccgcaaggctgaaactcaaaggaattgacggggacccgcncnagcggtggagtatgtggtttaattcgaagcaacgcgaacaaccttaccaggccttgacattgactgaaagngctagagatagctccctctcttcggagacaggaaaacaggtggtgcatggctgtcgtcagctcgtgtcgtgagatgttgggttaagtcccgcaacgagcgcaacccctgtcctttgttgccatcacgtnaaggtgggcnctcaaaggagactgccgcggagaacgcggaggaaggcggggatgacgtcaagtcatcatgccccttatgctctgggctacacacgtactacaatggaacggacagagagcagcgaacccgcgagggcaagcgaacctcaaaaaccgnttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggctargccgtctaaggtggggaaggtgactgggg

SEQ ID NO: 1859 - DNA, 1296 bp, Selenomonas genomosp.
gacgaacgctggcggcgtgcttaacacatgcaagtcgaacgagtggcaaacgggtgagtaacgcgtagacaacctgccgcaaagatggggacaacagcccgaaagggctgctaataccgaatgttcaaagtcgctttgcgatgggtctgcgcctgattagctggttggcggggcaacggcccgccaaggcgacgatcagtagccggtctgagaggatggacggccacattgggactgagacacggcccagactcctacgggaggcagcagtggggaatcttccgcaatgggcgaaagcctgacggagcaacgccgcgtgggtgaagaaggtcttcggatcgtaaagccctgttgcccgggacgatgacggtaccgggcgaggaagccacggccaactacgtgccagcagccgcggtaatacgtaggtggcgagcgttgtccggaatcattgggcgtaaagggagcgcaggcgggcatgcaagtccatcttaaaagcgcggggcccaaccccgtgaggggatggaaactgcgtgccttgagtgcaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatgaatgctaggtgtgggggctcccgtgccggagtcaacgcaataagcattccgcctggggagtacggccgcaaggctgaaactcaaaggaattgacgggggcccgcacaagcggtggagtatgtggttcaattcgacgcaacgcgaagaaccttaccagggcttgacattaacaggtggtgcatggctgtcgtcagctcgtgtcgtgagatgttgggtcaagtcccgcaacgagcgcaacccctgtccctcgttgccagcgcgcggggactcaagggagactgccgcggacaacgcggaggaaggcggggacgacgtcaagtcatcatgccccttatgccctgggctacacacgtactacaatgggatgcagagggcagcgagcccgcgagggcgagcgaaccccggcatcccccagttcggatgcaggctgaaacccgcctgcagaagttggaatcgctagtaatcgcaggtcagcatactgcggtgaatacgttcccgggccttgtacacaccgcccgtcacaccacggaagtcattcacacccgaagccggcacgcagcaagccgcccaaggtgggggcgatgactggggtg

SEQ ID NO: 1860 - DNA, 1319 bp, Selenomonas genomosp.
gacgaacgctggcggcgtgcttaacacatgcaagtcgaacgagtggcaaacgggtgagtaacgcgtaggcaacctgccctcaggatggggacaacggctcgaaagagccgctaataccgaatgactaaagtcgcctaaggatgggcctgcgtctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaagacggtacctgacgaggaagccacggctaactacgtgccagcagccgcggtaatacgtaggcggcaagcgttgtccggaattattgggcgtaaagggagcgcaggtgggacggtaagtccgtcttaaaaggcaggggctcagcccctgtaagggatggaaactatcgatcttgagtgccggagaggaaagcggaattcccagtgtagcggtgaaatgcgtagatattgggaagaacaccagtggcgaaggcggctttctggacggactgacactgaggctcgaaagccaggggagcgaacgggattagataccccggtagtcctggccgtaaacgatggatactaggtgtaggagctcctgtgccggagttaacgcaataagtatcccgcctggggggtacggtcgcaagactgaaactcaaaggaattgacgggggcccgcacaagcggtggagtatgtggtttaattcgacgcaacgcgaagaaccttaccagggcttgacattaacaggtggtgtatggctgtcgtcagctcgtgtcgtgagatgttgggttaagtcccgcaacgagcgcaacccctatattctgttgccaacagctgggaactcaggatagactgccgcggagaacgcggaggaaggcggggatgacgtcaagtcatcatgccccatatgacctgggctacacacgtactacaatgggatgcagagggcagcgaaagagcgatctggagcgaaccccagcatctcccagttcggatgcaggctgaaacccgcctgcagaagatggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgc

SEQ ID NO: 1861 - DNA, 1329 bp, Selenomonas genomosp.
gacgaacgctggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgtacgggacgatgacggtaccgtacgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatgaatgctaggtgtaggagctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctgtcccttgttgccagcacgtgggaactcaagggagactgccgtggagaacgcggaggaaggcggggatgacgtcaagtcatcatgccccttatgtcctgggctacacacgtactacaatgggatgcagagggaagcgagggcgcgagccggagcggatcccagcatcccccagttcggatgcaggctgcaacccgcctgcagaagtcggaatcgctagtaatcgcaggtcagcatactgcggtgaatacgttcccgggccttgtacacaccgcccgtcacaccacggaagtcattcacgcccgaagccggcggccaggcagccgtctaaggcgggggcgatgactggggtgaagtcgtaacaaggtagccgtatcggaaggtgc

SEQ ID NO: 1862 - DNA, 1287 bp, Selenomonas genomosp.
gacgaacgctggcggcgtgcttaacacatgcaagtcaaacgagtggcaaacgggtgagtaacgcgtaggcaacctgcccttaggatggggacaacggcccgaaaggaccgctaataccgaatgactaaagtcgccgaaggaagggcctgcgtctgattagccagttggtgaggtaacggctcaccaaagcaacgatcagtagccggtctgagaggatgaacggccacaatgggactgagacacggcccatactcctacgggaggcagcagtggggaatcttccgcaatgggcgcaagcctgacggagcaacgccgcgtgagtgaagaaggtcttcggatcgtaaaactctgttgacggggacgatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgtcggagttaacgcaataagtatcccgcctggggagtacggtcgcaagactgaaactcaaaggaattgacggggacccgcacaagcggtggagtatgtggtttaattcggagcaacgcgaagaaccttaccaggccttgacattaacaggtggtgcatggctgtcgtcagctcgtgtcatgagatgttgggttaagtcccgcaacgagcgcaacccctgttctttgttgccatcacgtgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggtgactggggtg

SEQ ID NO: 1863 - DNA, 1460 bp, Selenomonas genomosp.
gacgaacgctggcggcgtgcttaacacatgcaagtcgaacgggaacctttatttcggtaaaggtgagagtggcaaacgggtgagtaacacgtaggcaacctgccgacaggatggggacaacattccgaaaggaatgctaataccgaatggagtccggggatggcatcatccctggataaaagatggcctctgaatatgctatcgcctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgacggagcaacgccgcgtgagtgaagaaggtcttcggatcgtaaagctctgttgacggggacgaacgtgcaaagggtgaataatcctttgcaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccagggcttgacattgagtgacagacttagagacaagtcattctcttcggagacacgaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcggagccgtctaaggtggggaaggtgactggggtg

SEQ ID NO: 1864 - DNA, 1296 bp, Selenomonas genomosp.
gacgaacgctggcggcgtgcttaacacatgcaagtcgaacgagtggcaaacgggtgagtaacgcgtagacaacctgccgcaaagatggggacaacagttcgaaaggactgctaataccgaatgttcaaagtcgctttgcgatgggtctgcgtctgattagctagttggcagggcaacggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgccggggacgatgacggtacccggcgaggaagccacggctaactacgtgccagcagccgcggtaatacgtaggtggcgagcgttgtccggaattattgggcgtaaagggagcgcaggcgggcgagtaagtctttcttaaaagtgcggggctcaaccccgtgaggggagagaaactactcatcttgagtgcaggagaggaaagcggaattcctagtgtagcggtgaaatgcgtagatattaggaagaacaccagtggcgaaggcggctttctggactgactgacgctgaggctcgaaagccaggggagcgaacgggattagataccccggtagtcctggccgtaaacgatgaatgctaggtgtaggggctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctattctctgttgccagcacgtgggaactcagaggagactgccgcggacaacgcggaggaaggcggggatgacgtcaagtcatcatgccccttatgtcctgggctacacacgtactacaatgggatgcggagagcagcgaagccgcgaggccaagcgaaccccaacatttcccagttcggatgcaggctgcaactcgcctgcagaagatggaatcgctagtaatcgcaggtcagcatactgcggtgaatacgttcccgggccttgtacacaccgcccgtcacaccacggaagtcgttcacacccgaagccggtgggcagctagctgtctaaggcgggggcgatgactggggtg

SEQ ID NO: 1865 - DNA, 1519 bp, Selenomonas infeli
ggagagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcctccgtgaaagatggcctctgtatatgctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcgaagggtgaataatcctttgcaatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgtaagagctagagatagctccctctcttcggagacaggaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgc

SEQ ID NO: 1866 - DNA, 1520 bp, Selenomonas noxia
gagtttgatcctggctcaggacgaacgctggcggcgtgcttaacacatgcaagtcgaacggagcgaatgaaagcttgcttttataagcttagtggcaaacgggtgagtaacacgtaggcaacctgccgacaggatggggacaacattccgaaaggaatgctaataccgaatgaagtcagagaagggcatccttttctgatgaaagatggcctctatatataagctatcacctgtcgatgggcctgcgtctgattagctggtaggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggtaatgacggtacccatcgaggaagccacggctaactacgtgccagcagccgcggtaatacgtaggtggctagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccagcatgtaaggatgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcattcacacccgaagccggctaggccgtctaaggtggggaaggtgactggggtgaagtcgtaacaaggtagccgtatcggaaggtgcgg

SEQ ID NO: 1867 - DNA, 1565 bp, Selenomonas ruminantium
attttatggagagtttgatcctggctcaggacgaacgctggcggcgtgcttaacacatgcaagtcgaacgagacgattgaaagcttgcttttgagagtcgagtggcaaacgggtgagtaacgcgtagacaacctgccgcaaagatggggacaacagtccgaaaggactgctaataccgaatgttgtcagattcccgcatgggagactgattaaagatggcctctacttgtaagctatcgctttgcgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaagggtttcggctcgtaaagctctgttgacggggacgaatgtgcgaaatgcgaatagtttttcgcaatgacggtacccgtcgaggaagccacggctaactacgtgccagcagccgcggtaatacgtaggtggcgagcgttgtccggaattattgggcgtaaagggagcgcaggcgggaaggcaagtcagtcttaaaagtgcggggctcaaccccgtgatgggattgaaactgtctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgaccccttctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagatctagagatagatccctctcttcggagacacgaaaacaggtggtgcatggctgtcgtcagctcgtgtcgtgagatgttgggttaagtcccgcaacgagcgcaacccctatcatttgttgccagcacgttatggtgggaactcaaatgagactgccgcggacaacgcggaggaaggcggggatgacgtcaagtcatcatgccccttatgtcctgggctacacacgtactacaatgggatggacagagagcagcgaacccgcgagggcaagcgaaccccataaaccatctcccagttcggattgcaggctgcaacccgcctgcatgaagtcggaatcgctagtaatcgctggtcagcatacagcggtgaatacgttcccgggccttgtacacaccgcccgtcacaccacggaagtcattcacacccgaagccggtgggcaaaccgcaaggatgcagccgtctaaggtgggggcgatgactggggtgaagtcgtaacaaggtagccgtatcggaaggtgcggctggatcacctcctttct

SEQ ID NO: 1868 - DNA, 1270 bp, Selenomonas sp.
  misc_feature (1084)..(1084): n is a, c, g, or t
  misc_feature (1175)..(1175): n is a, c, g, or t
ccctatatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgatcgaggggcgaacaggctctcggtatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgacagggatagagatatcctattctctttggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagngcgaccttaagcgaacctcaaaaaccgtttctcagttcggattgcaggctgcaactcgcctgcatgaagtcggaatcgctagtaatcgcangtcagcatactgcggtgaatacgttcccgggtcttgtacacaccgcccgtcacaccacggaagtcgttcacacccgaagccggcgcagccgtcta

SEQ ID NO: 1869 - DNA, 1356 bp, Selenomonas sp.
gagtttgatcctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggtggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggcctgggctacacacgtactacaatggaacgcagagagcagcgaacccgcgagggcaagcgaacctcaacgtttcccagttcggatgcaggctgcaacccgcctgcagaagtcggaatcgctagtaatcgcaggtcagcatactgcggtgaatacgttcccgggtcttgtacacaccgcccgtcacaccacggaagtcattcacacccgaagccggcgccgtctaaggtggggaaggtgactggggtgaagtcgtaacaaggtagccgtatcggaaggtgcggctggaacacctcctt

SEQ ID NO: 1870 - DNA, 1356 bp, Selenomonas sp.
gagtttgattctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggcctgggctacacacgtactacaatggaacgcagagagcagcgaacccgcgagggcaagcgaacctcaacgtttcccagttcgggtgcaggctgcaacccgcctgcagaagtcggaatcgctagtaatcgcaggtcagcatactgcggtgaatacgttcccgggtcttgtacacaccgcccgtcacaccacggaagtcattcacacccgaagccggcgccgtctaaggtggggaaggtgactggggtgaagtcgtaacaaggtagccgtatcggaaggtgcggctggatcacctcctt

SEQ ID NO: 1871 - DNA, 1356 bp, Selenomonas sp.
gagtttgattctggctcaggacgaacgctggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcacgtgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggcgactggggtgaagtcgtaacaaggtagccgtatcggaaggtgcggctggaacacctcctt

SEQ ID NO: 1872 - DNA, 1536 bp, Selenomonas sp.
gagtttgatcctggctcaggacgaacgctggcggcgtgcttaacacatgcaagtcgaacggagctatttatttcggtagatagcttagtggcaaacgggtgagtaacacgtagacaacctgccgatcagatggggacaacattccgaaaggaatgctaataccgaatgaggtgtaggggaggcatctcccctacatgaaagatggcctctatatataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtgcataggatgaataagcctgtgtaatgacggtaccttttgaggaagccacggctaactacgtgccagcagccgcggtaatacgtatgtggcgagcgttgtccggaatcattgggcgtaaagggagcgcaggcggtcatgtaagtcttacttaaaagttcggggctcaaccccgtgatgggtaagaaactatatgacttgagtacaggagaggaaagcggaattcccagtgtagcggtgaaatgcgtatgatattgggaggaacaccagtggcgaaggcggctttctggactgcaactgacactgaggctcgaaagccaggggagcgaacgggattagataccccggtagtcctggccgtacacgatggatactaggtgtaggaggtatcgacccctcctgtgccggagttaacgcaataagtatcccgcctggggagtacggtcgcaagactgaaactcagaggaattgacgggggcccgcacaagcggtggagtatgtggtttaattcgacgcaacgcgaagaaccttaccagggcttgacattgagtgaaagggcaagagattgtccccttatcttcggataacacgaaaacaggtggtgcatggctgtcgtcagctcgtgtcgtgagatgttgggttaagtcccgcaacgagcgcaacccctatattctgttgccaacaggtaaagctgggaactcaggatagactgccgcggagaacgcggaggaaggcggggatgacgtcaagtcatcatgccccatatgacctgggctacacacgtactacaatgggatgtacagagggcagcgaaagagcgatctggagcgaaccccagaaaacatctcccagttcggattgcaggctgaaacccgcctgcatgaagatggaatcgctagtaatcgcaggtcagcatactgcggtgaatacgttcccgggccttgtacacaccagcccgtcacaccacggaagtcattcacacccgaagccggtgaaagccgtcgaaggtgggggcgatgactggggtgaagtcgtaacaaggtagccgtatcggaaggtgcggctggaacacctcctt

SEQ ID NO: 1873 - DNA, 1356 bp, Selenomonas sp.
gagtttgattctggctcaggacgaacgctggcggcgtgcttaacacatgcaagtcgaacgagtggcaaacgggtgagtaacacgtagacaacctgccgacaggatggggacaacattccgaaaggaatgctaataccgaatgaagaaagtcacctgccgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgactgacgctgaggctcgaaagccaggggagcgaacgggattagataccccggtagtcctggccgtaaacgatggatactaggtgtgggagctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccatcagctgggcactcaaaggagactgccgcggagaacgcggaggaaggcggggatgacgtcaagtcatcatgccccttatggtctgggctacacacgtactacaatggaacgcagagagcagcgaacccgcgagggcaagcgaacctcaacgtttcccagttcggatgcaggctgcaactcgcctgcagaagtcggaatcgctagtaatcgcaggtcagcatactgcggtgaatacgttcccgggtcttgtacacaccgcccgtcacaccacggaagtcgttcacacccgaagccggcgccgtctaaggtggggaaggtgactggggtgaagtcgtaacaaggtagccgtatcggaaggtgcggctggatcacctcctt

SEQ ID NO: 1874 - DNA, 1362 bp, Selenomonas sp.
agtttgattctggctcaggacgaacgcgggcggcgtgcttaacacatgcaagtcgaacgagtggcaaacgggtgagtaacacgtaggcaacctgccgacaggatggggacaacattccgaaaggaatgctaataccgaatgaagaaagtcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaggacggaccgagcgaggaatccacggctaactacgtgccagcggccgcggtaatacgtacgtggcgagcgttgtccggaattattgggcgtaaagggagcgcagggggacatataagtccatcttaaaagtgcggtgctcaaccccgtgaggggatggaaactgtatgccttgagtgcaagataggaaagcggaattcccagtgtagcggtgaaatgcgtaatattgggaggaacaccagtggccaatgcggctttctggactgactgacgctgaggctcgaaagccaggggagcgaacgggattagataccccggtagtcctggccgtaaacgatgaatgctaggtgtaggagctcctgtgccggagttaacgcaataagcattccgcctggggagtacggtcgcaagactgaaactcaaaggaattgacgggggcccgcacaagcggtggagtatgtggtttaattcgaagcaacgcgaagaaccttaccaggccttgacattaacaggtggtgcatggctgtcgtcagctcgtgtcgtgagatgttgggttaagtcccgcaacgagcgcaacccctgttctttgttgccagcatatgggcactcaaaggagactgccgcggagaacgcggaggaaggcggggatgacgtcaagtcatcatgccccttatggtctgggctacacacgtactacaatgggacgcagagggcagcgagagagtgatcttaagcgaatctcaacgtttctcagttcggatgcaggctgcaactcgcctgcagaagtcggaatcgctagtaatcgcaggtcagcatactgcggtgaatacgttcccgggtcttgtacacaccgcccatcacaccacggaagtcattcacacccgaagccggcacgcagcaagccgcccaaggtgggggcgatgactggggtgaagtcgtaacaaggtagccgtatcggaaggtgcggctggatcacctcctt

SEQ ID NO: 1875 - DNA, 1366 bp, Selenomonas sp.
ggagtttgattctggctcaggacgaacgctggcggcgtgcttaacacatgcaagtcgaacgagtggcaaacgggtgagtaacacgtaggcaacctgccgacaggatggggacaacattccgaaagggatgctaataccgaatggagaaagtcgcctgtcgatgggcctgcgtctgattagctagttggtgaggtaaaggctcaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgtcgaggacgatgacggtacttgacgaggaagtcacggctaactacgtgccagcagccgcggtaatacgtaggtggcaagcgttgtccggaatcattgggcgtaaagggagcgcaggtgggaacttaggtctttcttaaaagtgcggggctcaaccccgtgatgggagagaaaccgagattcttgagtgcaggagaggaaagcggaattcccggtgtagcggtgaaatgcgtagatatcgggaggaacaccagtggcgaaggcggctttctggactgactgacactgaggctcgaaagccagggtagcgaacgggattagataccccggtagtcctggccgtaaacgatgaatgctaggtgtaggagcttctgtgccggagttaacgcaataagcattccgcctggggagtacggccgcaaggctgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctgtcctttgttgccagcgcgcgggaactcaaaggagactgccgcggagaacgcggaggaaggcggggatgacgtcaagtcatcatgccccttatgtcctgggctacacacgtactacaatgggatgcagagagcagcgaatgggcgaccatgagcgaaccccttcatctctcagttcggatgcaggctgaaacccgcctgcagaagtcggaatcgctagtaatcgcaggtcagcatactgcggtgaatacgttcccgggccttgtacacaccgcccgtcacaccacgaaagtcattcacacccgaagtcggtgaggacctagccgcctaaggtgggggcgatgattggggtgaagtcgtaacaaggtagccgtatcggaaggtgcggctggatcacctcctt

SEQ ID NO: 1876 - DNA, 1356 bp, Selenomonas sp.
ggagtttgatcctggctcaggacgaacgctggcggcgtgcttaacacatgcaagtcgaacgagtggcaaacgggtgagtaacgcgtaggcaacctgccctcaggatggggacaacggctcgaaagagccgctaataccgaatgactaaagtcgcccgaggatgggcctgcgtctgattagccagttggtgaggtaacggctcaccaaagcaacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaagacggtacccgacgaggaagccacggctaactacgtgccagcagccgcggtaatacgtaggcggcaagcgttgtccggaattattgggcgtaaagggagcgcaggtgggacggtaagtctgtcttaaaaggcaagggctcagcccctgtaagggacagaaactatcgttcttgagtgccggagaggaaagcggaattcccagtgtagcggtgaaatgcgtagatattgggaagaacaccagtggcgaaggcggctttctggacggactgacactgaggctcgaaagccagggtagcgaacgggattagataccccggtagtcctggccgtaaacgatggatactaggtgtaggggctcctgtgccggagttaacgcaataggtatcccgcctggggagtacggtcgcaagactgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctatattctgttgccaacagctgggaactcaggatagactgccgcggagaacgcggaggaaggcggggatgacgtcaagtcatcatgccccttatgacctgggctacacacgtactacaatgggatgcagagggcagcgaaggagcgatctggagcgaaccccagcatctctcagttcggatgcaggctgaaacccgcctgcagaaggtggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgcggctggatcacctcctt

SEQ ID NO: 1877 - DNA, 1414 bp, Selenomonas sp.
tacggagcgatgaagcttgcttttataagcttatggcaacgggtgagtaacaggtggacaacctgccgacaggatggggacaacattccgaaaggaatgctaataccgaatgaacagaggagaggcatctctcctctgtgaaagatggcctctttttatgctatcacctgttgatggggctgctctgattagctggtaggtggagtaacggctcacctaggggagaatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggcgaaacgtgcctaatgcgaatagttttaggtaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagttagagataactccctctcttcggagacaggaaaacaggtggtgcatggctgtcgtcagctcgtgtcgtgagatgttgggttaagtcccacaacgagcgcaacccctgttctttgttgccagcaagtgaagttgggcactcaaaggagactgccgcggagaacgcggaggaaggcggggatgacgtcaagtcatcatgccccttatggtctgggctacacacgtactacaatgggacggacagagggcagcgagagagtgatattaagcgaatctcaaaaaccgtttttcagttcggattgcaggctgcaactcgcctgcatgaagtcggaatcgttagtaatcgcaggtcagcatactgcggtgaatacgttcccgggtcttgtacacaccgcccgtcacaccacggaagtcattcacacccgaagccggcaaagccgtctaaggtggggaaggtgac

SEQ ID NO: 1878 - DNA, 1319 bp, Selenomonas sp.
gacgaacgctggcggcgtgcttaacacatgcaagtcgaacgagtggcaaacgggtgagtaacgcgtaggcaacctgcccttaggatggggacaacggcccgaaaggaccgctaataccgaatgcagaaagtcgccgaaggaagggcctgcgcctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgttggggacgaagacggtacccgacgagcaagccacggctaactacgtgccagcagccgcggtaatacgtaggtggcgagcgttgtccgggatgattgggcgtaaagggagcgcaggtgggacggtaagtccttcttaaaagcgtggggctcagccccatgaagggaaggaaactatcgatcttgagtgccagagaggaaagcggaattcccagtgtagcggtgaaatgcgtagatattgggaagaacaccagtggcgaaggcggctttctggacggactgacgctgaggctcgaaagccaggggagcgaacgggattagataccccgctagtcctggccgtaaacgatggatactaggtgtaggagcttctgtgccggagttaacgcaataagtatcccgcctggggagtacggtcgcaagattgaaactcaaaggaattgacgggggcccgcacaagcggtggagtatgtggtttaattcgacgcaacgcgaagaaccttaccagggcttgacattaacaggtggtgcatggctgtcgtcagctcgtgtcgtgagatgttgggttaagtcccgcaacgagcgcaacccctatgttctgttgccagcgcgcgggcactcagaagagactgccgcggagaacgcggaggaaggcgggggtgacgtcaagtcatcatgccccttatgacctgggctacacacgtactacaatgggatgcagagggcagcgaacgggcgaccggaagcgaaccccagcatctcccagttcggatgcaggctgaaacccgcctgcagaagatggaatcgctagtaatcgcaggtcagcatactgcggtgaatacgttcccgggccttgtacacaccgcccgtcacaccacggaagtcattcacacccgaagccggaccgtcgaaggtgggggcgatgactggggtgaagtcgtaacaaggtagccgtatcggaaggtgc

SEQ ID NO: 1879 - DNA, 1541 bp, Selenomonas sp.
ggagagtttgatcctggctcaggacgaacgctggcggcgtgcttaacacatgcaagtcgaacggagcgaatgaaagcttgcttttatgagcttagtggcaaacgggtgagtaacacgtagacaacctgccgatcagatggggacaacattccgaaaggaatgctaataccgaatggcgtgtggggaggcatcttccctacatgaaagatggcctctatttataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaagggggcgaacgtacgcagtgcgaatagtgctgagtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgacagggatagagatatcctattctctttggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagggcgaccttaagcgaacctcaaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttct

SEQ ID NO: 1880 - DNA, 1265 bp, Selenomonas sp.
ggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggagtgcgaatagcgctttgtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagcaccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttct

SEQ ID NO: 1881 - DNA, 1548 bp, Selenomonas sputigena
ggagagtttgatcctggctcaggacgaacgctggcggcgtgcttaacacatgcaagtcgaacgggaacctttatttcggtaaaggtgagagtggcaaacgggtgagtaacacgtaggcaacctgccgacaggatggggacaacattccgaggaatgctaataccgaatggagtccggggatggcatcatcctcggataagatggcctctgaatatgctatcgcctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaaaaccgagcttgagaatattgagtttgggtgacggtaccgagcgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgaggctcgaaagccaggggagcgaacgggattagataccccggtagtcctggccgtaaacgatgaatgctaggtgtaggaggtatcgacccctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagagctagagatagcttcctcccttcggggacacgaaaacaggtggtgcatggctgtcgtcagctcgtgtcgtgagatgttgggttaagtcccgcaacgagcgcaacccctgtcctttgttgccagcgcgtaatggcgggaactcaaaggagactgccgcggagaacgcggaggaaggcggggatgacgtcaagtcatcatgccccttatgtcctgggctacacacgtactacaatgggatggacagagggaagcgaaggcgcgagccggagcggaccccacaaaccatcccccagttcggattgcaggctgcaacccgcctgcatgaagtcggaatcgctagtaatcgcaggtcagcatactgcggtgaatacgttcccgggccttgtacacaccgcccgtcacaccacggaagtcattcacgcccaaagccggtgggccaaccgcaaggaggcagccgtctaaggcgggggcgatgactggggtgaagtcgtaacaaggtagccgtatcggaaggtgcggctggatcacctcctttct

SEQ ID NO: 1882 - DNA, 1490 bp, Serratia fonticola
tcagattgaacgctggcggcaggcctaacacatgcaagtcgagcggtagcacaaggagcttgctcctgggtgacgagcggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttctgtgttaatagcaccgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagttagtagcttaaccttcgggagggcgcttaccactttgtgattcatgactggggtgaagtcctaacaaggtaaccgtag

SEQ ID NO: 1883 - DNA, 1428 bp, Serratia liquefaciens
  misc_feature (1070)..(1070): n is a, c, g, or t
acacaagaagcttgctctctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgcgtaatggngggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgta

SEQ ID NO: 1884 - DNA, 1496 bp, Serratia marcescens
atcctggctcagattgaacgctggcggcaggcttaacacatgcaagtcgagcggtagcacaagagagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgttcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccg

SEQ ID NO: 1885 - DNA, 1545 bp, Serratia odorifera
tttaattgaagagtttgatcatggctcagattgaacgctggcggcaggcctaacacatgcaagtcgagcggtagcacaggagagcttgctctctgggtgacgagcggcggacgggtgagtaatgtctgggaaactgcccgatggagggggataaccactggaaacggtggctaataccgcataacgtctacggaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggccaatagcttaatacgctgttggattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggaagggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacttgcgagagtaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1886 - DNA, 1546 bp, Serratia proteamaculans
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcataacgtcttcggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagccagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttac

SEQ ID NO: 1887 - DNA, 1546 bp, Shewanella putrefaciens
tttaattgaagagtttgatcatggctcagattgaacgctggcggcaggcctaacacatgcaagtcgagcggcagcacaagggagtttacttctgaggtggcgagcggcggacgggtgagtaatgcctagggatctgcccagtcgagggggataacagttggaaacgactgctaataccgcatacgccctacgggggaaaggaggggaccttcgggccttccgcgattggatgaacctaggtgggattagctagttggtgaggtaatggctcaccaaggcgacgatccctagctgttctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagtagggaggaaagggtgtagcttaatacgctatatctgtgacgttacctacagaagaaggaccggctaactccgtgccagcagccgcggtaatacggagggtccgagcgttaatcggaattactgggcgtaaagcgtgcgcaggcggtttgttaagcgagatgtgaaagccctgggctcaacctaggaatagcatttcgaactggcgaactagagtcttgtagaggggggtagaattccaggtgtagcggtgaaatgcgtagagatctggaggaataccggtggcgaaggcggccccctggacaaagactgacgctcatgcacgaaagcgtggggagcaaacaggattagataccctggtagtccacgccgtaaacgatgtctactcggagtttggtgtcttgaacactgggctctcaagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccacggaattggctagagatagcttagtgccttcgggaaccgtgagacaggtgctgcatggctgtcgtcagctcgtgttgtgaaatgttgggttaagtcccgcaacgagcgcaacccctatccttatttgccagcacgtaatggtgggaactctagggagactgccggtgataaaccggaggaaggtggggacgacgtcaagtcatcatggcccttacgagtagggctacacacgtgctacaatggcgagtacagagggttgcaaagccgcgaggtggagctaatctcacaaagctcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagcttaaccttcgggggggcgctcaccactttgtggttcatgactggggtgaagtcgtaacaaggtagccctaggggaacctggggctggatcacctccttac

SEQ ID NO: 1888 - DNA, 1539 bp, Shuttleworthia satelles
tttaacatgagagttcgatcctggctcaggatgaacgctggcggcgtgcttaacacatgcaagtcgaacgagaaatgatattacgatctcttcggagtgacggttttatttcgagtggcggacgggtgagtaacgcgtgagcaacctgccctataccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcggctcgagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgatgacaagcgatgtaatgtcgtctctcttcggagcatcggagacaggtggtgcatggttgtcgtcagctcgtgtcgtgagatgttgggttaagtcccgcaacgagcgcaacccttgttcttagtagccagcaggtgaagctgggcactctaaggagactgccggggtgaacccggaggaaggtggggatgacgtcaaatcatcatgccccttatgacttgggctacacacgtgctacaatggcgtaaacaaagggaggcgaagccgtgaggccaagcgaatcccaaaaataacgtctcagttcggattgtagtctgcaactcgactacatgaagctggaatcgctagtaatcgcagatcagcatgctgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctcctttct

SEQ ID NO: 1889 - DNA, 1451 bp, Shuttleworthia sp.
gaacgctggcggcgtgcttaacacatgcaagtcgaacgagaaatgatattacgatctcttcggagtgacgattttatttcgagtggcggacgggtgagtaacgcgtgagcaacctgccctgtaccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcagctggagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgatgacaagcgatgtaatgtcgtctctcttcggagcatcggagacaggtggtgcatggttgtcgtcagctcgtgtcgtgagatgttgggttaagtcccgcaacgagcgcaacccttgttcttagtagccagcaggtgacgctgggcactctaaggagactgccggggtgaacccggaggaaggtggggatgacgtcaaatcatcatgccccttatgacttgggctacacacgtgctacaatggcgtaaacaaagggaggcgaagccgtgaggccaagcgaatcccaaaaataacgtctcagttcggattgtagtctgcaactcgactacatgaagctggaatcgctagtaatcgcagatcagcatgctgcggtgaatacgttcccgggtcttgtacacaccgcccgtcacaccatgggagttggtaatgcccgaagtcagtgacccaaccgcaaggagggagctgccgaaggcaggactgataactggg

SEQ ID NO: 1890 - DNA, 1241 bp, Shuttleworthia sp.
gatgaacgctggcggcgtgcttaacacaagcaagtcgaacgagaaatgatattacgatctcttcggagtgacggttttatttcgagtggcggacgggtgagtaacgcgtgagcaacctgccctgtaccgggggataccagttggaaacgactgttaataccgcataagcgcacgataagacatcttgttgtgtgaaaaactccggtggtataggatgggctcgcgtatgattagccagttggcggggtaaaggcccaccaaagcgacgatcattagccgacctgagagggcgaccggccacattgggactgagacacggcccaaactcctacgggaggcagcagtggggaatattgcacaatgggcgaaagcctgatgcagcgacgccgcgtgagtgaggaagtatttcggtatgtaaagctctatcagcagggaagaaagaaatgacggtacctgagtaagaagctccggctaaatacgtgccagcagccgcggtaatacgtatggagcaagcgttatccggatttactgggtgtaaagggagcgtaggcggcagagcaagtctgatgtgaaagcccggggctcaaccccggtagtgcattggaaactgttcagctcgagtgtcggaggggtaagcggaattcctggtgtagcggtgaaatgcgtagatatcaggaagaacaccggaggcgaaggcggcttactggacgattactgacgctgaggctcgaaagcgtggggagcgaacaggattagataccctggtagtccacgctgtaaacgatgaatactaggtgtcggtacccgaagggtatcggtgccgtcgcaaacgcattaagtattccacctggggagtacgttcgcaagaatgaaactcaaaggaattgacggggacccgcacaagcggtggagcatgtggtttaattcgaagcaacgcgaagaaccttacccagtcttgacatcccgatgacaagcgatgtaatgtcgtctctcttcggagcatcggagacagggtggtgcatggctagtcgtcagcctcgtgtcgtgagaagttggggttaagttcccgcgacgagcgccacccctggttcttgttagccagcaggtgacgctgggcaccctaggaaactggcgaggtgacccgggagaagggtgggaatacgtcaatcatcatgccccttattacctgggctacacgttcctcaagggcttacccaggggaggcaagcccgtaaggcacc

SEQ ID NO: 1891 - DNA, 1547 bp, Simonsiella muelleri
ttgaacataagagtttgatcctggctcagattgaacgctggcggcatgctttacacatgcaagtcggacggcagcggggtagtgcttgcattactgccggcgagtggcgaacgggtgagtataatattggaacgtaccgagtaatgggggataactatccgaaaggatggctaataccgcatacgtcctgagggagaaagcgggggacaggcaactgcctcgcgttatttgagcggccaatatcggattagctagttggtggggtaaaggcttaccaaggcgacgatccgtagcgggtctgagaggatgatccgccacactgggactgagacacggcccagactcctacgggaggcagcagtggggaattttggacaatggggggaaccctgatccagccatgtcgcgtgtatgaagaaggccttagggttgtaaagtacttttgttagggaagaaaaggcatttgctaatatcagatgctgatgacggtacctaaagaataagcaccggctaactacgtgccagcagccgcggtaatacgtagggtgcgagcgttaatcggaattactgggcgtaaagcgagcgcagacggttacttaagcaagatgtgaaatccccgagctcaacttgggaactgcgttttgaactgggtagctagagtgtgtcagaggggggtagaattccacgtgtagcagtgaaatgcgtagagatgtggaggaataccgatggcgaaggcagccccctgggatagcactgacgttcatgctcgaaagcgtgggtagcaaacaggattagataccctggtagtccacgccctaaacgatgtcaattagctgttggggcactagatgccttagtagcgaagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatctctcagagacgggagagtgccttcgggagccgtaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccaaaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagtaggtagaataaccgcgaggagttcgcttaccacggtatgcttcatgactggggtgaagtcgtaacaaggtagccgtaggggaacctgcggctggatcacctcctttct

SEQ ID NO: 1892 - DNA, 1474 bp, Slackia equolifaciens
agagtttgatcctggctcaggatgaacgctggcggcgtgcctaacacatgcaagtcgaacgagtaaggcgccttcgggcgcgtatagagtggcgaacgggtgagtaacacgtgaccaacctgccccccgccccgggacaaccgcccgaaagggcggctaataccgggcgaaccggagaggacgcatgccccctccggcaaagctcaggcggcgggggatggggtcgcggcccatcaggtagacggcggggtgacggcccaccgtgcctacaacgggtagccgggctgagaggccgatcggccacattgggactgagacacggcccagactcctacgggaggcagcagtggggaattttgcgcaatgggggcaaccctgacgcagcaacgccgcgtgcgggacgaaggccttcgggtcgtaaaccgctttcagcagggaagaaaccatgacggtacctgcagaagaagccccggctaactacgtgccagcagccgcggtaatacgtagggggcgagcgttatccggattcattgggcgtaaagcgcgcgcaggcggcctctcaagcggcaccgtcgaagccgggggctcaacccccggaagcgggccgaactggggggctcgaggcaggcagaggaaggcggaattcccggtgtagcggtggaatgcgcagatatcgggaagaacaccgacggcgaaggcagccttctgggcctgtcctgacgctcaggcgcgaaagccgggggagcgaacaggattagataccctggtagtcccggccgtaaacgatgggcgctaggtgtgggggcgacatgcctccgtgccgaagccaacgcattaagcgccccgcctggggagtacggccgcaaggctaaaactcaaaggaattgacgggggcccgcacaagcggcggagcatgtggcttaattcgaagcaacgcgaagaaccttaccagggcttgacatcaccgtgagccggcggagacgccggggccgagaggagcggtgacaggtggtgcatggctgtcgtcagctcgtgtcgtgagatgttgggttaagtcccgcaacgagcgcaacccctgccgtatgttgccagcatgtaacgatggggactcatacgggaccgccggcgtcaagccggaggaaggcggggacgacgtcaagtcatcatgccccttacgccctgggctgcacacgtgctacaatggccggtacagagggaagccaccccgcgagggggagccgatcccgaaaagccggccccagttcggatcggaggctgcaacccgcctccgtgaagccggagtcgctagtaatcgcggatcagcatgccgcggtgaatacgttcccgggccttgtacacaccgcccgtcacaccacccgagtcgtctgcacccgaagccgccggccgaacccgagaggggcggaggcgtcgaaggtgtggagggtgaggggggtgaagtcgtaacaaggtaacc

SEQ ID NO: 1893 - DNA, 1509 bp, Slackia exigua
ggagagtttgatcctggctcaggatgaacgctggcggcgcgcctaacacatgcaagtcgaacggttaaggccccctttagggggcgcatagagtggcgaacgggtgagtaacacgtgaccaacccgcccccccaccgggacaacctcgggaaaccgaggctaataccggatacgccggggcccccgcatgggggccccgggaaagccttggcgggaggggacggggtcgcggcccatcaggtagacggcggggcgaaggcccgccgtgccgacgacgggtagccgggctgagaggccgatcggccacattgggactgagacacggcccagactcctacgggaggcagcagtggggaatattgcgcaatggggggaaccctgacgcagcgacgccgcgtgcgggaaggaggccttcgggtcgtaaaccgctttcagcagggaagaagcctgacggtacctgcagaagaagccccggctaactacgtgccagcagccgcggtaatacgtagggggcgagcgttatccggattcattgggcgtaaagcgcgcgcaggcggcccgccaagcggcctcgtcgaagccgggggctcaacccccggaagcgacccgaactggcgggctcgagtggggcaggggaggatggaattcccggtgtagcggtgaaatgcgcagatatcgggaggaacaccgacggcgaaggcagccctctgggccttcactgacgctgaggcgcgaaagctgggggagcgaacaggattagataccctggtagtcccagccgtaaacgatgggcgctaggtgcggggggacacgaccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccggaaggagcccgcgcaggtggtgcatggctgtcgtcagctcgtgtcgtgagatgttgggttaagtcccgcaacgagcgcaacccccgccgcatgttgccagcattcagttgggcactcatgcgggaccgccggcgccaagccggaggaaggcggggacgacgtcaagtcatcatgccccccatgccctgggccgcacacgtgctacaatggccggcacagcgggcagcggacccgcgagggcgagcgaatcccttaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggcccaacccgcaagggggggaggcgtcgaaggtgtggagggtgaggggggtgaagtcgtaacaaggtagccgtaccggaaggtgcggctggatcacctcctttct

SEQ ID NO: 1894 - DNA, 1476 bp, Slackia faecicanis
gatgaacgctggcggcgtgcctaacacatgcaagtcgaacggttaaggcgccttcgggcgcgaatagagtggcgaacgggtgagtaacgcgtggccaacctgccccctcctccgggacaacctcgggaaaccgaggctaataccggatgctccgggccccccgcatggggggcccgggaaagcccaggcgggaggggatggggccgcgtcccatcaggtagtaggcggggtgacggcccacctagctgacgacgggtagccggactgagaggtcgatcggccacattgggactgagacacggcccagactcctacgggaggcagcagtggggaattttgcgcaatgggggaaaccctgacgcagcaacgccgcgtgcgggacgaaggccttcgggtcgtaaaccgctttcggcagggaagaattttgacggtacctgcagaagaagccccggctaactacgtgccagcagccgcggtaatacgtagggggcgagcgttatccggattcattgggcgtaaagcgcgcgtaggcgtctcctcaagcggcaccgtcgaagccgggggctcaacccccggaagcgggccgaactggggggatcgagtgcggtaggggcaggcggaattcccggtgtagcggtgaaatgcgcagatatcgggaagaacaccgacggcgaaggcagcctgctgggccggcactgacgctgaggcgcgaaagctgggggagcgaacaggattagataccctggtagtcccagccgtaaacgatgggcgctaggtgtgggggagccattcctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgagccggcggagacgccggggccgaaaggagcggtgacaggtggtgcatggctgtcgtcagctcgtgtcgtgagatgttgggttaagtcccgcaacgagcgcaacccccgccgtatgttgccatcgggtaatgccgggcactcgtacgggaccgccggagccaatccggaggaaggcggggacgacgtcaagtcatcatgcccctcatgccctgggctgcacacgtgctacaatggccggtacaacgggccgccacgccgcgaggcggagcgaatccctcaaagccggccccagttcggatcgcaggctgcaacccgcctgcgtgaagccggagttgctagtaatcgcggatcagcatgccgcggtgaatacgttcccgggccttgtacacaccgcccgtcacaccacccgagtcgtctgcacccgaagccgccggccgaacccgaaaggggcggaggcgtcgaaggtgtggagggtgaggggggtgaagtcgtaacaaggtagccgtaccggaaggtgcggctggatc

SEQ ID NO: 1895 - DNA, 1505 bp, Slackia heliotrinireducens
agagtttgatcctggctcaggatgaacgctggcggcgcgcctaacacatgcaagtcgaacgattaaaccgccctcgggcggacatacagtggcgaacgggtgagtaacacgtgaccaacccgccccctcctccgggacaacctcgggaaaccgtggctaataccggatactccggcagcagcgcatgctgcggccgggaaagcccagacgggaggggatggggtcgcggcccatcaggtagacggcggggcaacggcccgccgtgccgacgacgggtagccgggctgagaggctgatcggccacattgggactgagacacggcccagactcctacgggaggcagcagtggggaatcttgcgcaatggggggaaccctgacgcagcgacgccgcgtgcgggacgaaggccttcgggtcgtaaaccgctttcagcagggaagaaacatgacggtacctgcagaagaagctccggctaactacgtgccagcagccgcggtaatacgtagggagcgagcgttatccggattcattgggcgtaaagcgcgcgcaggcggccggccaagcgggcctcgtcgaagccgtgggctcaacccgcggaagcgacccgaactggccggctcgagtgaggtaggggaggatggaattcccggtgtagcggtggaatgcgcagatatcgggaggaacaccgacggcgaaggcagtcctctgggccttcactgacgctgaggcgcgaaagctgggggagcgaacaggattagataccctggtagtcccagccgtaaacgatgggcgctaggtgtggggggccggaccccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggaaacgccgtggcctgaccggagcctgcacaggtggtgcatggctgtcgtcagctcgtgtcgtgagatgttgggttaagtcccgcaacgagcgcaacccctgccgcatgttgccagcatcaagttggggactcatgcgggaccgccggcgccaagccggaggaaggcggggacgacgtcaagtcatcatgcccctcatgccctgggctgcacacgtgctacaatggccggcacagcgggctgcgacgcagcgatgcggagcgaatccctcaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggccgaacccgttaaggggcggaggcgtcgaaggtgtggagggtgaggggggtgaagtcgtaacaaggtagccgtacgggaacgtgcggctggatcacctcctt

SEQ ID NO: 1896 - DNA, 1473 bp, Slackia isoflavoniconvertens
agagtttgatcctggctcaggatgaacgctggcggcgcgcctaacacatgcaagtcgaacgagtaagacgccttcgggcgtggatagagtggcgaacgggtgagtaacacgtgaccaacctgccccctcctccgggacaacctcgggaaaccgaggctaataccggatactccgggcaccccgcatgggatgcccgggaaagccctggcgggaggggatggggtcgcggcccatcaggtagacggcggggtaacggcccaccgtgcccgcaacgggtagccgggctgagaggccgatcggccacattgggactgagacacggcccagactcctacgggaggcagcagtggggaattttgcgcaatgggggcaaccctgacgcagcgacgccgcgtgcgggacgaagtcattcgtgacgtaaaccgctttcagcgaggaagaaccatgacggtactcgcagaagaagccccggctaactacgtgccagcagccgcggtaatacgtagggggcgagcgttatccggaatcattgggcgtaaagcgcgcgcaggcgggctttcaagcggcggcgtcgaagccgggggctcaacccccggaagcgccccgaactggaagcctcggatgcggcagggggaggcggaattcccggtgtagcggtgaaatgcgcagatatcgggaagaacaccgacggcgaaggcagcctcctgggccggcatcgacgctgaggcgcgaaagctgggggagcgaacaggattagataccctggtagtcccagccgtaaacgatggacgctaggtgtgggggaggaatctcctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatcggtgaagccggagagatccggtggccgagaggagcccacacaggtggtgcatggctgtcgtcagctcgtgccgtgaggtgttgggttaagtcccgcaacgagcgcaacccccgccgcgtgttgccagcattcagttgggcactcacgcgggactgccggcgtcaagccggaggaaggcggggacgacgtcaagtcatcatgcccctcatgccctgggccgcacacgtgctacaatggccggcacaacgggttgccaccccgcgagggggagcggatccctaaagccggccccagttcggatcgcaggctgcaacccgcctgcgtgaagccggagttgctagtaatcgcggatcagcacgccgcggtgaatacgttcccgggccttgtacacaccgcccgtcacaccacccgagtcgtctgcacccgaagccgccggccgaacccctccggggggcggaggcgtcgaaggtgtggagggtgaggggggtgaagtcgtaacaaggtaacc

SEQ ID NO: 1897 - DNA, 1463 bp, Slackia piriformis
gatgaacgctggcggcgtgcctaacacatgcaagtcgaacggttaaggcgccttcgggcgcgcatagagtggcgaacgggtgagtaacacgtgaccaacctgccccctcctccgggacaacctcgggaaaccgaggctaataccggatggtcccgccgggccgcatggccgggcggggaaagcccaggcgggaggggatggggtcgcggcccatcaggtagtaggcggggtgacggcccacctagctgacgacgggtagccgcgctgagaggcggaccggccacattgggactgagacacggcccagactcctacgggaggcagcagtggggaattttgcgcaatgggggaaaccctgacgcagcaacgccgcgtgcgggacgaaggccttcgggtcgtaaaccgctttcagcagggaagaagaatgacggtacctgcagaagaagccccggctaactacgtgccagcagccgcggtaatacgtagggggcgagcgttatccggattcattgggcgtaaagcgcgcgtaggcgtcccttcaagcggcaccgtcgaagccgggggctcaacccccggaagcgggccgaactggggggatcgagtgcggtaggggaaggcggaattcccggtgtagcggtgaaatgcgcagatatcgggaagaacaccgacggcgaaggcagccttctgggccgccactgacgctgaggcgcgaaagctgggggagcgaacaggattagataccctggtagtcccagccgtaaacgatgggcgctaggtgtggggggagatgtccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgagccgccggagacggcggggccgaaaggagcggtgacaggtggtgcatggctgtcgtcagctcgtgtcgtgagatgttgggttaagtcccgcaacgagcgcaacccccgccgcgtgttgccagcattgagttgggcactcgcgcgggactgccggcgtcaagccggaggaaggtggggacgacgtcaagtcatcatgcccctcatgccctgggctgcacacgtgctacaatggccggtacagcgggctgcgacgccgcgaggcggagcgaatcccacaaagccggccccagttcggaccgcaggctgcaacccgcctgcgcgaagccggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtgaggggggtgaagtcgtaacaaggtagccgtaccggaagg

SEQ ID NO: 1898 - DNA, 1355 bp, Slackia sp.
tttgatcatggctcaggatgaacgctggcggcgcgcctaacacatgcaagtcgaacgagtggcgaacgggtgagtaacacgtgaccaacctgccccctcctccgggacaacctcgggaaaccgaggctaataccggatactgaaaggcgggaggggatggggtcgcggcccatcaggtagacggcggggtaacggcccaccgtgcctgcaacgggtagccgggctgagaggccgatcggccacattgggactgagacacggcccagactcctacgggaggcagcagtggggaattttgcgcaatgggggcaaccctgacgcagcgacgccgcgtgcgggacgaagtcattcgtgacgtaaaccgctttcagcgaggaagatgacggtactcgcagaagaagccccggctaactacgtgccagcagccgcggtaatacgtagggggcgagcgttatccggaatcattgggcgtaaagcgcgcgcaggcgggctttcaagcggggcgtcgaagccgggggctcaacccccggaagcgccccgaactggaagcctcggatgcggcagggggaggcggaattcccggtgtagcggtgaaatgcgcagatatcgggaagaacaccgacggcgaaggcagcctcctgggccgatcgacgctgaggcgcgaaagctgggggagcgaacaggattagataccctggtagtcccagccgtaaacgatggacgctaggtgtgggggcctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatacaggtggtgcatggctgtcgtcagctcgtgccgtgaggtgttgggttaagtcccgcaacgagcgcaacccccgccgcgtgttgccagcatgggcactcacgcgggactgccggcgtcaagccggaggaaggcggggacgacgtcaagtcatcatgcccctcatgccctgggccgcacacgtgctacaatggccggcaacgggttgccaccccgcgagggggagcggatccctccggccccagttcggacgcaggctgcaacccgcctgcggaagccggagttgctagtaatcgcggatcagcacgccgcggtgaatacgttcccgggccttgtacacaccgcccgtcacaccacccgagtcgtctgcacccgaagccgccgccgacggaggcgtcgaaggtgtggagggtgaggggggtgaagtcgtaacaaggtagccgtaccggaaggtgcggctggatcacct

SEQ ID NO: 1899 - DNA, 1528 bp, Solobacterium moorei
tcaaatgaagagtttgatcctggctcaggatgaacgctggcggcgtgcctaatacatgcaagtcgaacgctggagatctagcttgctagatcgaaggagtggcgaacgggtgagtaatacataagcaacctacccacgaagactgggataatctctggaaacggggactaataccggataggtaatcggaaggcatcttctggttattaaaggttaaaaacactggtggatgggcttatggcgcattagttagttggtgaggtaacggcccaccaagacgatgatgcgtagccggcctgagagggtgaacggccacattgggactgagacacggcccagactcctacgggaggcagcagtagggaattttcggcaatgggggcaaccctgaccgagcaacgccgcgtgagtgaagacggccttcgggttgtaaagctctgttgtaagggaagaacggtagatagagaatatctaagtgacggtaccttaccagaaagccacggctaactacgtgccagcagccgcggtaatacgtaggtggcgagcgttatccggaattattgggcgtaaagggtgcgtaggcggcctgttaagtaagtggttaaattgttgggctcaacccaatccagccacttaaactggcaggctagagtattggagaggcaagtggaattccatgtgtagcggtaaaatgcgtagatatatggaggaacaccagtggcgaaggcggcttgctagccaaagactgacgctcatgcacgaaagcgtggggagcaaataggattagataccctagtagtccacgccgtaaacgatgaatactaagtattggggaaactcagtgctgcagctaacgcaataagtattccgcctgtggagtatgcacgcaagtgtgaaacataaaggaattgacgggggcccgcacaagcggtggagtatgtggtttaattcgacgcaacgcgaagaaccttaccaggccttgacatcccttgcaaagctgtagagatacagtagaggttatcaaggagacaggtggtgcatggttgtcgtcagctcgtgtcgtgagatgttgggttaagtcccgcaacgagcgcaacccttgccttcagttaccagcattcagttggggactctggagggactgccggtgataaaccggaggaaggtggggatgacgtcaaatcatcatgccccttatggcctgggctacacacgtactacaatggctgttacaacgtgcagcgacctagcgataggaagcgaatcactaaaagacagtctcagttcggattgaagtctgcaactcgacttcatgaagctggaatcgctagtaatcgcggatcagaatgccgcggtgaatacgttctcgggccttgtacacaccgcccgtcataccatgagagctggtaatacccgaagccggtggcctaaccgcaaggaaggagccgtcgaaggtaggactagtgattggggtcaagtcgtaacaaggtatccctacgagaacgtggggatggatcacctcctttct

SEQ ID NO: 1900 - DNA, 1494 bp, Sphingobacterium faecium
ggctcaggatgaacgctagcggcaggcctaatacatgcaagtcggacgggattcagggagtagcttgctacgaactgatgagagtggcgcacgggtgcgtaacgcgtgagcaacctacccatatcagggggatagcctctcgaaagagagattaacaccgcataacatcatttaccggcatcggttaatgatcaaatatttataggatatggatgggctcgcgtgacattagctagttggaggggtaacggcccaccaaggctacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttgtcagggaataaacctttctacgtgtaggaagctgaatgtacctgaagaataaggatcggctaactccgtgccagcagccgcggtaatacggaggatccaagcgttatccggatttattgggtttaaagggtgcgtaggcggtcctataagtcagtggtgaaagacggcagcttaactgtcgcagtgcctttgatactgtaggacttgaatctatttgaagtgggcggaataagacaagtagcggtgaaatgcatagatatgtcttagaactccgattgcgaaggcagctcactaagttagtattgacgctgatgcacgaaagcgtggggatcaaacaggattagataccctggtagtccacgccctaaacgatgataactcgatgtttgcgatacacagtaagcgtccaagcgaaagcgttaagttatccacctggggagtacggtcgcaagattgaaactcaaaggaattgacgggggcccgcacaagcggaggagcatgtggtttaattcgatgatacgcgaggaaccttacccgggcttgaaagttagtgaatgatccagagacggatcagtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgccagcgtaagctgtgaggaaggtggggacgacgtcaagtcatcatggcccttacgtccggggctacacacgtgctacaatggatggtacagcgggcagctacatagcaatatgatgctaatctctaaaagccattcacagttcggattgaggtctgcaactcgacctcatgaagttggattcgctagtaatcgcgtatcagcaatgacgcggtgaatacgttcccgggccttgtacacaccgcccgtcaagccatgaaagttgggggtacctaaagcatgtaaccgcaaggagcgtgttagggtaaaaccgataattggggctaagtcgtaacaaggtagccgtaccggaaggtgcgg

SEQ ID NO: 1901 - DNA, 1454 bp, Sphingobacterium mizutaii
gctcaggatgaacgctagcggcaggcctaatacatgcaagtcggacgggatccatcggtagcttgctaccgatggtgagagtggcgcacgggtgcgtaacgcgtgagcaacctgcccatatcagggggatagcccggagaaatccggattaacaccgcatgacactgctttccggcatcgggaggtagtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgttagggaataaaccccgctacgtgtagcgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtggtgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattgggg

SEQ ID NO: 1902 - DNA, 1439 bp, Sphingobacterium multivorum
  misc_feature (1112)..(1112): n is a, c, g, or t
  misc_feature (1114)..(1114): n is a, c, g, or t
ggctcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataacatcaacagttcgcatgttcggttgattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccaggaataaacctaaatacgtgtatttagctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagagtgcagagacgcactcgtccttcgggacacgaaactaggtgctgcatggctgtcgtcagctcgtgccgtgaggtgttgggttaagtcccgcaacgagcgcaacccctatgtttagttgccagcatgtnanggtggggactctaaacagactgcctgtgcaaacagagaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgttaccgcaaggagcgtgttaggg

SEQ ID NO: 1903 - DNA, 1527 bp, Sphingobacterium spiritivorum
ttacaatggagagtttgatcctggctcaggatgaacgctagcggcaggcctaatacatgcaagtcgaacgagattatccagcttgctggatatgaaagtggcgcacgggtgcgtaacgcgtgagcaacctacctctgtcagggggatagcccggcgaaagtcggattaacaccgcatgacattattgatgtggcatcacattataatcaaatatttataggacagagatgggctcgcgtgacattagctagttggagaggtaacggctcaccaaggcaacgatgtctaggggctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttgtcggggaataaacctacgtttgtaaacgtagctgaatgtacccgaagaataaggatcggctaactccgtgccagcagccgcggtaatacggaggatccaagcgttatccggatttattgggtttaaagggtgcgtaggcggttctttaagtcagaggtgaaagacggcagcttaactgtcgcagtgcctttgatactgaagaacttgaattaggttgaggaatgcggaatgagacaagtagcggtgaaatgcatagatatgtctcagaaccccgattgcgaaggcagcattccaagcctttattgacgctgatgcacgaaagcgtggggatcgaacaggattagataccctggtagtccacgccctaaacgatgataactcgatgttggcgatagacagtcagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaatgatccagagacggatcagtccttcgggacacgaaactaggtgctgcatggctgtcgtcagctcgtgccgtgaggtgttgggttaagtcccgcaacgagcgcaacccctatgtttagttgccagcatgtcatgatggggactctaaacagactgcctgcgcaagcagagaggaaggtggggacgacgtcaagtcatcatggcccttacgtccggggctacacacgtgctacaatggtcggtacagcgggcagctacacagtaatgtgatgccaatctctgaaagccgatcacagttcggattgaggtctgcaactcgacctcatgaagttggattcgctagtaatcgcgtatcagcaatgacgcggtgaatacgttcccgggccttgtacacaccgcccgtcaagccatgaaagttgggggtgcctaaagcatgtaaccgcaaggagcgtgttagggcaaaaccgataattggggctaagtcgtaacaaggtagccgtaccggaaggtgcggctggaatacctcctttct

SEQ ID NO: 1904 - DNA, 1463 bp, Sphingomonas echinoides
  misc_feature (439)..(439): n is a, c, g, or t
  misc_feature (956)..(959): n is a, c, g, or t
tgatcatggctcagaatgaacgctggcggcatgcctaacacatgcaagtcgaacgaaggctttggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctnactccgtgccagcagccgcggtaatacggagggagctagcgttattcggaattactgggcgtaaagcgcacgtaggcggctttgtaagttagaggtgaaagcctggagctcaactcctgaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcacgtaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcnnnntcggggactggaacacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatccgtagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcac

SEQ ID NO: 1905 - DNA, 1362 bp, Sphingomonas sp.
gagtttgatcctggctcagaacgaacgctggcggcgtgcctaacacatgcaagtcgaacgagtggcgcacgggtgcgtaacgcgtgggaatctgcctcttgcttcggaataacagtgggaaactactgctaataccggatgatcaaagtcggcaagagatgagcccgcgtaggattaggtagttggtggggtaaaggcctaccaagccgacgatccttagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctcttttaccagggatgatgacagtacctggagaataagctccggctaactccgtgccagcagccgcggtaatacggagggagctagcgttgttcggaattactgggcgtaaagcgcacgtaggcggttactcaagtcagaggtgaaagcccggggctcaaccccggaactgcctttgaaactaggtaactagaatcctggagaggtgagtggaattccgagtgtagaggtgaaattcgtagatattcggaagaacaccagtggcgaaggcggctcactggacagattgacgctgaggtgcgaaagcgtggggagcaaacaggattagatacccaggtagtccacgccgtaaacgatgataactagctgtccgggtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcgacaggtgctgcatggctgtcgtcagctcgtgtcgtgagatgttgggttaagtcccgcaacgagcgcaaccctcgtccttagttgccatcatgggcactctaaggaaaccgccggtgataagccggaggaaggtggggatgacgtcaagtcctcatggcccttacacgctgggctacacacgtgctacaatggcggtcagtgggcagcgacctcgcgaggggtagctaatctccgccgtctcagttcggatgttctctgcaactcgagagcagaaggcggaatcgctagtaatcgcggatcagcatgccgcggtgaatgcgttcccaggccttgtacacaccgcccgtcacaccatgggagttggattcactcgaaggcgttaggtaggtaggcgaccacagtgggtttagcgactggggtgaagtcgtaacaaggtagccgtaggggaacctgcggttggatcacctcctt

SEQ ID NO: 1906 - DNA, 1362 bp, Sphingomonas sp.
gagtttgattctggctcagaacgaacgctggcggcatgcctaatacatgcaagtcgaacgagtggcgcacgggtgcgtaacgcgtgggaatctgcccttgggttcggaataacagctggaaacggctgctaataccggatgatcaaagtcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccgattgacgctgaggtgcgaaagcgtggggagcaaacaggattagataccctggtagtccacgccgtaaacgatgataactagctgccggggtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcgacaggtgctgcatggctgtcgtcagctcgtgtcgtgagatgttgggttaagtcccgcaacgagcgcaaccctcgcctttagttgccagcatgggtactctaaaggaaccgccggtgataagccggaggaaggtggggatgacgtcaagtcctcatgscccttacgcgttgggctacacacgtgctacaatggcgaccagtgggcagcgaccgtgcgagcggaagctaatctccgtcgtctcagttcgggcgttctctgcaactcgagagcggaaggcggaatcgctagtaatcgcggatcagcatgccgcggtgaatacgttcccaggccttgtacacaccgcccgtcacaccatgggagttggattcactcgaaggcgttagctaggcaggcgaccacagtgggtttagcgactggggtgaagtcgtaacaaggtagccgtaggggaacctgcggctggatcacctcctt

SEQ ID NO: 1907 - DNA, 1405 bp, Sphingomonas sp.
agagtttgatcctggctcagaatgaacgctggcggcatgcctaacacatgcaagtcgaacgaagccttcgggcttagtggcgcacgggtgcgtaacgcgtgggaatctgcccttgggttcggaataacagttggaaacgactgataataccggatgatgacgtaagtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcccagagctcaactctggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgttcggggacttagtccgtgagtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgctgggctacacacgtgctacaatggcggtgacagtgggcagcaatcccgcaagggggagctaatctccaaaagccgtctcagttcggattgcactctgcaactcgagtgcatgaaggcggaatcgctagtaatcgcggatcagcacgccgcggtgaatacgttcccaggccttgtacacaccgcccgtcacaccatgggagttgggttcacccgaaggcgttgcgctaactcgcaagagaggcaggcgacc

SEQ ID NO: 1908 - DNA, 1450 bp, Sphingomonas sp.
agagtttgatcctggctcagaacgaacgctggcggcacgcctaacacatgcaagtcgaacgaaggcttcggccttagtggcgcacgggtgcgtaacgcgtgggaatctgcccttgggtctgggataacggcgggaaactgccgctaataccggatgatatcgcgagatcaaagatttatcgcctgaggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccgggggcttggcctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcactaactcgcaagagaggcaggcgaccacggtgggcttagcgactggggtgaagtcgtaacaaggtagccgt

SEQ ID NO: 1909 - DNA, 1484 bp, Sphingopyxis alaskensis
ttgagagtttgatcctggctcagaacgaacgctggcggcatgcctaacacatgcaagtcgaacgagaccttcgggtctagtggcgcacgggtgcgtaacgcgtgggaatctgcccttgggtacggaataactcagagaaatttgagctaataccgtataatgacttcggtccaaagatttatcgcccaaggatgagcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctt

SEQ ID NO: 1910 - DNA, 1515 bp, Spiroplasma insolitum
tggagagtttgatcctggctcaggatgaacgctggcggcatgcctaatacatgcaagtcgaacggggtgcttgcacccagtggcgaacgggtgagtaacacgtatctaatctacccattagcgggggataacagttggaaacgactgctaataccgcatacgacattttctggcatcagagaatgttaaaaggtccgtttggaccactaatggatgagggtgcggcgtattagttagttggtggggtaatggcctaccaagacaatgatacgtagccgaactgagaggttgaacggccacatcgggactgagacacggcccgaactcctacgggaggcagcagtagggaatttttcacaatgggcgaaagcctgatggagcaatgccgcgtgactgaagacggtcttcggattgtaaaggtctgttgtaagggaagaacagtaagtataggaaatgatacttatttgacggtaccttaccagaaagccacggctaactatgtgccagcagccgcggtaatacataggtggcaagcgttatccggatttattgggcgtaaagcgtgcgcagacggtttaacaagtttggggtcaaattctggagcttaactccagttcgccttgaaaactgttaagctagagtgtaggagaggtcgatggaattccatgtgtagcggtgaaatgcgtagatatatggaggaacaccagtggcgaaggcggtcgactggcctatcactgacgtttaggcacgaaagcgtagggagcaaataggattagataccctagtagtctacgccgtaaacgatgagtactaagtgtcggactaagttcggtgctgcagctaacgcattaagtactccgcctgagtagtatgctcgcaagagtgaaactcaaaggaattgacggggacccgcacaagcggtggagcatgtggtttaattcgaagcaacgcgaagaaccttaccaaggcttgacatccagtgcaaagctgtagaaatacagtggaggttaacattgagacaggtggtgcatggttgtcgtcagctcgtgccgtgaggtgtttggttaagtccagtaacgagcgcaacccttgccgttagttactccattaagttgagatactctaacgggactgctagtgtaagctagaggaaggtggggatgacgtcaaatcatcatgccccttatgtcttgggctacacacgtgctacaatggccggtacaaacagttgcgatctcgtaagagggagctaatctgaaaaagccggtctcagttcggattgagggctgcaactcgccctcataaagccggaatcgctagtaatcgcgaatcagcaatgtcgcggtgaatacgttctcgggtcttgtacacaccgcccgtcacaccatgagagttgataataccagaagtcggtattctaaccgtaaggaggaagccgcccaaggtaggattgatgattagggtgaagtcgtaacaaggtatccgtacgagaacgtgcggctggatcacctcctt

SEQ ID NO: 1911 - DNA, 1506 bp, Sporobacter termitidis
  misc_feature (361)..(361): n is a, c, g, or t
  misc_feature (377)..(377): n is a, c, g, or t
  misc_feature (863)..(863): n is a, c, g, or t
  misc_feature (1094)..(1094): n is a, c, g, or t
  misc_feature (1104)..(1104): n is a, c, g, or t
  misc_feature (1110)..(1110): n is a, c, g, or t
agagtttgatcctggctcaggacgaacgctggcggcgtgcctaacacatgcaagtcgaacggagacaattggttcgctgattgtcttagtggcggacgggtgagtaacgcgtgagcaatctgcccttcggagggggacaacagctggaaacggctgctaataccgcataatgtatattcaaggcatcttggatataccaaagatttatcgccgaaggatgagctcgcgtctgattagctagttggtgaggtaaaggctcaccaaggctgcgatcagtagccggactgagaggttgaacggccacattggaactgagatacgggccagactcctacgggagggagcagtggggaattttggncaatgggggaaagccntacccagcaacgccgcgtgaaggaagaaggccttcgggttgtaaacttctttgaccagggacgaaacaaatgacggtacctggaaaacaagccacggctaactacgtgccagcagccgcggtattacgtaggtggcaagcgttgtccggatttactgggtgtaaagggcgcgtaggcgggagtacaagtcagatgtgaaatctgggggcttaaccctcaaactgcatttgaaactgtatttcttgagtatcggagaggcaggcggaattcctagtgtagcggtgaaatgcgttgatattaggaggaacaccagtggcgaaggcggcctgctggacgacaactgactctgaggcgcgaaagcgtggggagcaaacaggattagataccctggtagtccacgctgtaaacgatgaatactaggtgtggggggactgaccccctccgtgccggagttaacacaataagtattccacctggggagtacgnccgcaaggttgaaactcaaaggaattgacgggggcccgcacaagcagtggattatgtggtttaattcgaagcaacgcgaagaaccttaccagggcttgacatcgtactaacgaagcagagatgcattaggtgcccttccggggaaagtatagacaggtggtgcatggttgtcgtcagctcgtgtcgtgagatgttgggttaagtcccgcaacgagcgcaacccctattgtnatttgctacncgagancactctagcgaggctgccgatgacaaaccggaggaaggtggggacgacgtcaaatcatcatgccccttatgtcctgggctacacacgtaatacaatgtctctcacagagggaagcaagaccgcgaggtggagcaaatccctaaaatgcgtctcagttcagattgcaggctgcaactcgcctgcatgaagtcggaattgctagtaatcgcggatcagcatgccgcggtgaatacgttcccgggccttgtacacaccgcccgtcacaccatgagagccgggaacacccgaagtccgtagtctaaccgcaagggggacgcggccgaaggtgggtttggtaattggggtgaagtcgtaacaaggtagccgtatcggaaggtgcggctggatcacctcctt

SEQ ID NO: 1912 - DNA, 1503 bp, Sporolactobacillus inulinus
  misc_feature (62)..(62): n is a, c, g, or t
  misc_feature (174)..(174): n is a, c, g, or t
  misc_feature (243)..(243): n is a, c, g, or t
gacgaacgctggcggcgtgcctaatacatgcaagtcgagcgcacagaagggagcttgctccnggacgtgagcggcggatgggtgagtaacacgtgggcaacctgcctgtaagacggggataacttcgggaaaccggagctaataccggataatccctcgcaccgcatggtgcgnggttgaaagatggtttcggccatcacttacagatgggcccgcggtgcattagttagttggcggggtaanggcccaccaagaccgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaacgagtgccagaggaaatgctggtgctgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaaaggtcattggaaactggggagcttgagtgcagaagaggagagtagaattccacgtgtagcggtgaaatgcgtagagatgtggaggaataccagtggcgaaggcggctctctggtctgttactgacgctgaggtgcgaaagcatggggagcaaacaggattagataccctggtagtccatgccgtaaacgatgaatgctaggtgttaggggggtccaaccccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagtctagagataggccgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgatctgggctacacacgtgctacaatgggcggtacaaagggcagcgaaaccgcaaggtcaagccaatcccataaagccgcccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgtgggaacctttatggacccagccgccgaaggtgggacaaatgattggggtgaagtcgtaacaaggtagccgtatcggaagg

SEQ ID NO: 1913 - DNA, 1518 bp, Sporolactobacillus nakayamae
tttcctggctcaggacgaacgctggcggcgtgcctaatacatgcaagtcgagcgcattgaagggagcttgctcccggatgtgagcggcggatgggtgagtaacacgtgggtaacctgcctgtcagattgggataactgtgggaaaccgcagctaataccgaatgatcccctgcaccacatggtgcagggttgaaagatggtttcggccatcactgacagatgggcccgcggtgcattagttagttggcggggtaacggcccaccaagacagcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaatgagtatgagaggaaatgcttgtactgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaatggtcattggaaactgggaagcttgagtgcagaagaggagagtagaattccacgtgtagcggtgaaatgcgtagatatgtggaggaataccagtggcgaaggcggctctctggtctgtaactgacgctgaggcgcgaaagcgtggggagcaaacaggattagataccctggtagtccacgccgtaaacgatgaatgctaggtgttagggggtccaacccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagtctagagataggccgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgatctgggctacacacgtgctacaatgggtggtacaaagggcagcgaaaccgcgaggtcaagcgaatcccataaagccacccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgcgagaacctttatgggctcagccgccgaaggtgggacagatgattggggtgaagtcgtaacaaggtagccgtatcggaaggtgcg

SEQ ID NO: 1914 - DNA, 1539 bp, Sporosarcina newyorkensis
agagtttgatcctggctcaggacgaacgctggcggcgtgcctaatacatgcaagtcgagcgaatctttgggagcttgctcccaaagattagcggcggacgggtgagtaacacgtgggcaacctaccttacagatggggataactccgggaaaccggggctaataccgaataatccatttcttcgcatgaagagatgttgaaagacggtttcggctgtcactgtgagatgggcccgcggcgcattagttagttggtggggtaacggcctaccaagaccacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaagctctgttgtaagggaagaacacgtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccgctgcccggcatggagacatgctttcccttcggggacagcggtgacaggtggtgcatggttgtcgtcagctcgtgtcgtgagatgttgggttaagtcccgcaacgagcgcaacccttaatcttagttgccatcattcagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccacaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacct

SEQ ID NO: 1915 - DNA, 1474 bp, Sporosarcina sp.
gacgaacgctggcggcgtgcctaatacatgcaagtcgagcgratcttygggagcttgctccyraagrttagcggcggacgggtgagtaacacgtgggcaacctaccttacagatggggataactccgggaaaccggggctaataccgaataatccatytcttcgcatgragagatgttgaaagacggtttcggctgtcactgtgagatgggcccgcggcgcattagttagttggtggggtaacggcctaccaagaccacgatgcgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaagctctgttgtaagggaagaacacgtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccgctgcccggcatggagacatgcytttcccttcggggacagcggtgacaggtggtgcatggttgtcgtcagctcgtgtcgtgagatgttgggttaagtcccgcaacgagcgcaacccttaatcttagttgccatcattyagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccacaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtg

SEQ ID NO: 1916 - DNA, 1509 bp, Staphylococcaceae bacterium
gatgaacgctggcggcgtgcctaatacatgcaagtcgagcgcgactgattacaccgtycttcggracaccgtaatcatcgagcggcggacgggtgagtaacacgtgggcaacctacccttaagactgggataaccgcgggaaaccgtggctaataccggataatacttttatacaacggtatagaagttgaaaggtggatttctatcacttaaggatgggcctgcggcgcattagctggttggtaaggtaacggcttaccaaggcgacgatgcgtagccgacctgagagggtgatcggccacactggaactgagacacggtccagactcctacgggaggcagcagtagggaatcttccgcaatgggcgaaagcctgacggagcaacgccgcgtgtgcgaagaaggtcttcggatcgtaaagcactgttgttaaggaagaacgacagtaagagtaactgyttactgtgtgacggtacttaaccagaaagccacggctaactacgtgccagcagccgcggtaatacgtaggtggcaagcgttatccggaattattgggcgtaaagcgcgcgtaggcggcgagattagtctgatgtgaaagcccccggctcaaccggggaaggtcattggaaactgtttcgcttgagtgcagaagaggagagtggaattccatgtgtagcggtgaaatgcgcagagatatggaggaacaccagtggcgaaggcggctctctggtctgcaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgtcatggagacatgattttccctttgggacagagagacaggtggtgcatggttgtcgtcagctcgtgtcgtgagatgttgggttaagtcccgcaacgagcgcaacccttaactttagttgccatcattcagttgggcactctagagtgactgccggtgacaaaccggaggaaggtggggatgacgtcaaatcatcatgccccttatgatttgggcgacacacgtgctacaatggacaggaacaaagggcagcgaaactgtgaagtcaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagttggtaacacctgaagccggtggcctaaccatttggagggagccgtcgaaggtgggaccgatgattggggtgaagtcgtaacaaggtagccgtatcggaagg

SEQ ID NO: 1917 - DNA, 1562 bp, Staphylococcus aureus
taatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaag

SEQ ID NO: 1918 - DNA, 1410 bp, Staphylococcus auricularis
tcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaaggcggctttgctgtcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgcgtaagtaactgtgcgcgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactgaaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttaggggggtttccgccccttagtgctgcagctaacgcattamgcactccgcctggggagtacggccgcaaggcttaaactcaaaggaattgacggggacccgcacaagcggtggagcatgtggtttaaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagtcggtagagtaaccttttggagcta

SEQ ID NO: 1919 - DNA, 1549 bp, Staphylococcus capitis
tggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1920 - DNA, 1551 bp, Staphylococcus caprae
tggagagtttgatcctggctcaggatgaacgctggcggcgtgcctaatacatgcaagtcgagcgaacagacgaggagcttgctcctttgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatcccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1921 - DNA, 1555 bp, Staphylococcus carnosus
ttttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatatgcagaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttct

SEQ ID NO: 1922 - DNA, 1232 bp, Staphylococcus cohnii
gcaagtcgagcgagcggcggacgggtgagtaacacgtgggtaacctacctataagactggaataactccgggaaaccggggctaatgccggataacgaaagttacttatagatggacccgcgccgtattagctagttggtaaggtaacggcttaccaaggcaacgaaacgtagccgacctgagagggggatcgtccacactggaactgagacacggtccagactcctaccggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaaacttagttgccagcatgggcactctaagttgactgccggtgacaaaccggaggaaggtggggatgacgtcaaatcatcatgccccttatgatttgggctacacacgtgctacaatggacaacaaagggcagctaaaccgcgaggtcatgcaaatcccatttgttctcagttcggatgtagtctgcaactcgactacagaagctggaatcgctagtaatcgtagatcagcatgctacggtgaatacgttcccgggtcttgtacacaccgcccgtcacaccacgagagtttgtaacacccgaagccggtgagtag

SEQ ID NO: 1923 - DNA, 1545 bp, Staphylococcus condimenti
  misc_feature (11)..(12): n is a, c, g, or t
agagtttgatnntggctcaggatgaacgctggcggcgtgcctaatacatgcaagtcgagcgaacagatgaggagcttgctcctctgacgttagcggcggacgggtgagtaacacgtgggtaacctacctataagactggaataactccgggaaaccggggctaatgccggataatatgcggaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctccttt

SEQ ID NO: 1924 - DNA, 1549 bp, Staphylococcus epidermidis
tggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1925 - DNA, 1494 bp, Staphylococcus equorum
agagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggt

SEQ ID NO: 1926 - DNA, 1454 bp, Staphylococcus fleurettii
agctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcgatagtgaaaggcggcttcggctgtcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaacccgcgaggtcaagcaaatcccataaaattattctcagttcggattgtagtctgcaactcgactacatgaagctggaatcgctagtaatcgtagatcagcatgctacggtgaatacgttcccgggtcttgtgaacaccgcccgtcacaccacgagagtctgtaacacccgaaagccggtggagtaaccttttattaggagctagccgtcgaaggt

SEQ ID NO: 1927 - DNA, 1549 bp, Staphylococcus haemolyticus
tggagagtttgatcctggctcaggatgaacgctggcggcgtgcctaatacatgcaagtcgagcgaacagacaaggagcttgctcctttgacgttagcggcggacgggtgagtgacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagtttagttgccatcattaagttgggcactctaagttgactgccggtgacaaaccggaggaaggtggggatgacgtcaaatcatcatgccccttatgatttgggctacacacgtgctacaatggacaatacaaagggcagcgaaatcgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1928 - DNA, 1575 bp, Staphylococcus hominis
  misc_feature (1)..(1): n is a, c, g, or t
ncgvtccagctccggccgccatggcggccgcgggaaattcgattagagtttgattatggctcaggatggacgctggcggcgtgcctaatacatgcaagtcgagcgaacagacgaggagcttgctccttcgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaaccatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtaaccgtaaatcactagtgaattc

SEQ ID NO: 1929 - DNA, 1549 bp, Staphylococcus lugdunensis
tggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 1930 - DNA, 1520 bp, Staphylococcus pasteuri
ggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcagcgccgcgtgagtgatgaaggtcttcggatcgtaaaactctgttatcagggaagaacaaatgtgtaagtaactgtgcacatcttgacggtacctgatcagaaagccacggctaacaacgtgccagcagccgcggtaatacgtaggtggcaagcgttatccggaattattgggcgtaaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcacgccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagaacagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgta

SEQ ID NO: 1931 - DNA, 1555 bp, Staphylococcus pseudintermedius
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgagcttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 1932 - DNA, 1527 bp, Staphylococcus saccharolyticus
  misc_feature (22)..(22): n is a, c, g, or t
  misc_feature (1505)..(1505): n is a, c, g, or t
ctggctcaggatgtaygctggnggcgtgcctaatacatgcaagtcgagcgaacagacgaggagcttgctcctctgacgttagcggcggacgggtgagtaacacgtggataacctacctataagactgggataacttcgggaaaccggagctaataccagataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggcacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaaccccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaacctkttggagctagccgtcgaaggtgggacaaatgattggggtgaagtcgtaacaaggtaagtcgtnacaaggtaagtcgccacaaggt

SEQ ID NO: 1933 - DNA, 1551 bp, Staphylococcus saprophyticus
tggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 1934 - DNA, 1528 bp, Staphylococcus sciuri
gatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatattttgaaccgcatggttcaatagtgaaagacggtttcggctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaatccgcgaggccaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttct

SEQ ID NO: 1935 - DNA, 1545 bp, Staphylococcus sp.
gagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataactccgggaaaccggggctaataccggataatatttagaaccgcatggttctaaagtgaaagatggccttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttactagggaagaacaaatgcgtaagtaactgtgcgcgtcttgacggtacctaatcagaaagccacggctaactacgtgccagcagccgcggtaatacgtaggtggcaagcgttatccggaattattgggcgtaaagcgcgcgtaggcgggtttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgctgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccacgctagagatagcgttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 1936 - DNA, 1364 bp, Staphylococcus sp.
gagtttgatcctggctcaggatgaacgctggcggcgtgcctaatacatgcaagtcgagcgagcggcggacgggtgagtaacacgtaggtaacctacctataagactgggataacttcgggaaaccggagctaataccggataatgaaagtcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaagcttagttgccatcatgggcactctaagttgactgccggtgacaaaccggaggaaggtggggatgacgtcaaatcatcatgccccttatgatttgggctacacacgtgctacaatggacaacaaagggcagcgaaaccgcgaggtcaagcaaatcccatttgttctcagttcggatgtagtctgcaactcgactacagaagctggaatcgctagtaatcgtagatcagcatgctacggtgaatacgttcccgggtcttgtacacaccgcccgtcacaccacgagagtttgtaacacccgaagccggtgagtagctagccgtcgaaggtgggacaaatgattggggtgaagtcgtaacaaggtagccgtatcggaaggtgcggctggatcacctcctt

SEQ ID NO: 1937 - DNA, 1364 bp, Staphylococcus sp.
gagtttgatcctggctcaggatgaacgctggcggcgtgcctaatacatgcaagtcgagcgagcggcggacgggtgagtaacacgtggataacctacctataagactgggataacttcgggaaaccggagctaataccggataatgaaagtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagatgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgactgacgctgatgtgcgaaagcgtggggatcaaacaggattagataccctggtagtccacgccgtaaacgatgagtgctaagtgttagggccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcgacaggtggtgcatggttgtcgtcagctcgtgtcgtgagatgttgggttaagtcccgcaacgagcgcaacccttaagcttagttgccatcatgggcactctaagttgactgccggtgacaaaccggaggaaggtggggatgacgtcaaatcatcatgccccttatgatttgggctacacacgtgctacaatggacaacaaagggcagcgaaaccgcgaggtcaagcaaatcccatttgttctcagttcggatgtagtctgcaactcgactatagaagctggaatcgctagtaatcgtagatcagcatgctacggtgaatacgttcccgggtcttgtacacaccgcccgtcacaccacgagagtttgtaacacccgaagccggtgagtagctagccgtcgaaggtgggacaaatgattggggtgaagtcgtaacaaggtagccgtatcggaaggtgcggctggatcacctcctt

SEQ ID NO: 1938 - DNA, 1548 bp, Staphylococcus succinus
tggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatatagaaccgcatggttctatagtgaaagatggttttgctatcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttattagggaagaacaaatgcgtaagtaactgtgcgcatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctt

SEQ ID NO: 1939 - DNA, 1497 bp, Staphylococcus vitulinus
agagtttgatcctggctcaggacgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcaatagtgaaagacggcttcggctgtcacttatagatggacccgcgccgtattagctagttggtaaggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagtccacggctcaaccgtggaaggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaaaccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttattaggagctagccgtcgaaggtgggacagatgattggggt

SEQ ID NO: 1940 - DNA, 1551 bp, Staphylococcus warneri
tggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccactctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 1941 - DNA, 1487 bp, Staphylococcus xylosus
tggcggggtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttaggtgggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacaccgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaagggaacc

SEQ ID NO: 1942 - DNA, 1547 bp, Stenotrophomonas maltophilia
taagtgaagagtttgatcctggctcagagtgaacgctggcggtaggcctaacacatgcaagtcgaacggcagcacagtaagagcttgctcttacgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggttaatacccggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 1943 - DNA, 1508 bp, Stenotrophomonas sp.
gtttgatcctggctcagagtgaacgctggcggtaggcctaacacatgcaagtcgaacggcagcacagtaagagcttgctcttacgggtggcgagtggcggacgggtgaggaatgcatcggaatctactctgtcgtgggggataacgtagggaagcttacgctaataccgcatacgacctacgggtgaaagcaggggatcttcggaccttgcgcgattgaatgagccgatgcccgattagctagttggcggggtaagagcccaccaaggcgacgatcggtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagccggttaatacccggttgttctgacggtacccaaagaataagcaccggctaacttcgtgccagcagccgcggtaatacgaagggtgcaagcgttactcggaattactgggcgtaaagcgtgcgtaggtggttgtttaagtctgtcgtgaaagccctgggctcaacctgggaatggcgatggaaactgggcgactagagtgtggcagagggtagtggaattcctggtgtagcagtgaaatgcgtagagatcaggaggaacatccgtggcgaaggcgactgcctgggccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgta

SEQ ID NO: 1944 - DNA, 1485 bp, Streptobacillus moniliformis
agagtttgatcctggctcaggatgaacgctgacagaatgcttaacacatgcaaatctatgtatgaaatgtaagcttgcttacatagactacatggtggactggtgagtaacgtgtaaagaacttacctcttagactgggataaccattaggaaatgatggataatactagatattattagtagtaggcatctactattaatgaaaggagagattgctaagagagagctttgcatcctattagctagttggtggggtaaaggcctaccaaggctatgataggtagccggcccgagaggtgaacggccacaaggggactgagatacggcccttactcctacgggaggcagcagtggggaatattggacaatggaggaaactctgatccagcaattctgtgtgcacgaagaaggttttcggattgtaaagtgctttcagtagggaagaagaagatgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtcagactagagtactggaaaggtgggtggaactacacgagtagaggtgaaattcgtagatatgtgtaggaatgccgatgatgaagataactcactggacagaaactgacgctgaagtgcgaaacgtaggggagcaaacaggattagataccctggtagtcctagctgtaaacgatgatcactgggtgtgggggtgtgaagcctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaataagatggaagcatcttagtgcctttgggaaccgagatacaggtggtgcatggctgtcgacagctcgtgtcgtgagatgttgggttaagtcccgcaacgagcgaaacccctatcattagttgccatcattaagttggggactctaatgaaactgcccgcgacgagcaggaggaaggtggggatgacgtcaagtcattctgccccttatgatctgggctacacacgtgctacaatgggtagtacaaagaggagctaagcagtgatgtggagcaaatctttcaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaacccgtaagggagggaagtacctaaggtgtgattagtgattggggtgaagtcgtaacaaggtagccgta

SEQ ID NO: 1945 - DNA, 1550 bp, Streptococcus agalactiae
tgagagtttgatcctggctcaggacgaacgctggcggcgtgcctaatacattgcaagtagaacgctgagggttttggtgtttacactagactgatgagttgcgaacgggtgagtaacgcgtaggtaacctgcctccatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatgagggaccaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1946 - DNA, 1437 bp, Streptococcus alactolyticus
atggctcaggacgaacgctggcggcgtgcctaatacatgcaagtagaacgctgaagaaaggagcttgcttcttttggatgagttgcgaacgggtgagtaacgcgtaggtaacctgccttgtagcgggggataactattggaaacgatagctaataccgcataacagcttttgacacatgttagaagcttgaaagatgcaattgcatcactacgagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgctctagagatagagtttttcttcggaacactggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacc

SEQ ID NO: 1947 - DNA, 1553 bp, Streptococcus anginosus
tgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgaaaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggggcggctggatcacctcctttct

SEQ ID NO: 1948 - DNA, 1546 bp, Streptococcus australis
tgagagtttgatcctggctcaggatgaacgctggcggcgtgcctaatacatgcaagtagaacgctgaaggaaggagcttgctctttctggatgagttgcgaacgggtgagtaacgcgtaggtaacctgcctggtagcgggggataactattggaaacgatagctaataccgcataacagtagatgttgcatgatatctgcttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1949 - DNA, 1546 bp, Streptococcus bovis
tgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaattgcatcactagtagatggacctgcgttgtattagctagttggtggggtaacggcccaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaaggtgggatagatgattggggtgaagtcgtaacaaggtagccgtatcggaaggtgcggctggatcacctcctttct

SEQ ID NO: 1950 - DNA, 1472 bp, Streptococcus canis
tgtttgatcctggctcaggacgaacgctggcggcgtgcctaatacatgcaagtagaacgctgaggacaggtgcttgcactagtctaaggagttgcgaacgggtgagtaacgcgtaggtaacctacctgatagcgggggataactattggaaacgatagctaataccgcataaaagtgcttaacacatgttaagaacttaaaaggggcaactgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaacccattatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcattggctcaaccaatgtatgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttagcccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggcctggtacacaccgcccgtcacaccacgagagtttgtaacacccgaagtcggtgaggtaacctattaggagccagccgcctaaggtgg

SEQ ID NO: 1951 - DNA, 1508 bp, Streptococcus constellatus
gacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaagg

SEQ ID NO: 1952 - DNA, 1544 bp, Streptococcus cristatus
tgagagtttgatcctggctcaggacgaacgctggcggcgtgcctaatacatgcaagtagaacgctgaaggaggagcttgctcttctggatgagttgcgaacgggtgagtaacgcgtaggtaacctacctggtagcgggggataactattggaaacgatagctaataccgcataatattgactattgcatgatagtcaattaaaaggtgcaaatgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1953 - DNA, 1555 bp, Streptococcus downei
tgagagtttgatcctggctcaggacgaacgctggcggcgtgcctaatacatgcaagtggaacgcattgatatcaccggagcttgctccactgatattaatgagtcgcgaacgggtgagtaacgcgtaggtaacctgcctgatagcgggggataactattggaaacgatagctaataccgcatgagagtgtttaacacatgttagagacttaaaagataccattgtatcactatcagatggacctgcgttgtattagctagttggtagggtagcggcctaccaaggcaccgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtagcggaagaacgcgtgtaagagtggaaagtttacacagtgacggtacgctaccagaaagggacggctaactacgtgccagcagccgcggtaatacgtaggtcccgagcgttgtccggatttattgggcgtaaagggagcgcaggcggtttagtaagtctgaagttaaaggcattggctcaaccaatgtatgctttggaaactgttagacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacaggattagataccctggtagtccacgccgtaaacgatgagtgctaggtgttaggtcctttccgggacttagtgccgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttactttttgtacatcggagacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccaaagtcggtgaggtaaccttataggagccagccgcctaaggtgggacagatgattggggtgaagtcgtaacaaggtagccgtatcggaaggtgcggctggatcacctcctttct

SEQ ID NO: 1954 - DNA, 1546 bp, Streptococcus dysgalactiae
tgagagtttgatcctggctcaggacgaacgctggcggcgtgcctaatacatgcaagtagaacgctgaggactggtgcttgcaccggtccaaggagttgcgaacgggtgagtaacgcgtaggtaacctacctcatagcgggggataactattggaaacgatagctaataccgcataaaagtgtttaacccatgttaaccatttaaaaggtgcaattgcatcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaatgatggtgggagtggaaaatccaccatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggctcaaccattgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctcctgaccggtctagagataggctttcccttcggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttct

SEQ ID NO: 1955 - DNA, 1545 bp, Streptococcus equi
gagagtttgatcctggctcaggacgaacgctggcggcgtgcctaatacatgcaagtagaacgcagaggtcaggtgcttgcactagactgatgagttgcgaacgggtgagtaacgcgtaggtaacctagcttatagcgggggataactattggaaacgatagctaataccgcataaaagtggttgacccatgttaacgatttaaaaggagcaacagctccactatgagatggacctgcgttgtattagctagttggtagggtaaaggcctaccaaggcgacgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacagtgatgggagtggaaagtccatcatttgacggtaactaaccagaaagggacggctaactacgtgccagcagccgcggtaatacgtaggtcccgagcgttgtccggatttattgggcgtaaagcgagcgcaggcggtttgataagtctgaagttaaaggcagtggcttaaccattgtatgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgctgagtgctaggtgttaggccctttccggggcttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcttagagataagaagttacttcggtacattggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatagatgattggggtgaagtcgtaacaaggtagccgtatcggaaggtgcggctggatcacctcctttct

SEQ ID NO: 1956 - DNA, 1545 bp, Streptococcus equinus
tgagagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacacatgttagatgcttgaaagaagcaattgcttcactagtagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttct

SEQ ID NO: 1957 - DNA, 1546 bp, Streptococcus gallolyticus
tgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaaatgcatcactagtagatggacctgcgttgtattagctagttggtggggtaacggcctaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1958 - DNA, 1293 bp, Streptococcus genomosp.
gatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacatagccgacctgggagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataggtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctgggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 1959 - DNA, 1294 bp, Streptococcus genomosp.
gacgaacgctggcggcgtgcctaatacatgcaagtagaacgagttgcgaacgggtgagtaacgcgtaggtaacctgcctggtagcgggggataactattggaaacgatagctaataccgcataagaaaagtcactaccagatggacctgcgttgtattagctagttggtgaggtaacggctcaccaaggcgacgatacatagccgacctgagagggtgattggccacactgggactgagacacggcccagactcctacgggaggcagcagtagggaatcttcggcaatggacggaagtctgaccgagcaacgccgcgtgtgtgaagaaggttttcggatcgtaaagctctgttgtaagagaagatgacggtatcttaccagaaagggacggctaactacgtgccagcagccgcggtaatacgtaggtcccaagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcgacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttccctggccttgtacacaccgcccgtcacaccacgagagtttgtaacacccgaagtcggtaggtagccagccgcctaaggtgggatagatgattggggtg

SEQ ID NO: 1960 - DNA, 1327 bp, Streptococcus genomosp.
gacgaacgctggcggcgtgcctaatacatgcaagtagaacgagttgcgaacgggtgagtaacgcgtaggtaacctgcctggtagcgggggataactattggaaacgatagctaataccgcataaagaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgctagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1961 - DNA, 1327 bp, Streptococcus genomosp.
gacgaacgctggcggcgtgcctaatacatgcaagtagaacgagttgcgaacgggtgagtaacgcgtaggtaacctgcctggtagcgggggataactattggaaacgatagctaataccgcataaaaaaagtcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1962 - DNA, 1294 bp, Streptococcus genomosp.
gacgaacgctggcggcgtgcctaatacatgcaagtagaacgagttgcgaacgggtgagtaacgcgtaggtaacctgcctggtagcgggggataactattggaaacgatagctaataccgcataacgaaagtcactaccagatggacctgcgttgtattagctagttggtggggtaacggctcaccaaggcgacgatacatagccgacctgagagggtgatcggccacactgggactgagacacggcccagactcctacgggaggcagcagtagggagtcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggtgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgccacaccacgagagtttgtaacacccgaagtcggtaggtagccagccgcctaaggtgggatagatgattggggtg

SEQ ID NO: 1963 - DNA, 1293 bp, Streptococcus genomosp.
gatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacacagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggccttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaacctcttccagtctcagttcggatgtaggctgcaactcgcctacagaagtcggaatcgctagtaatcgcagatcagcacgccgcggtgaatacgttcccgggccttgtacacaccgcccgtcacaccacgagagtttgtaacacccgaagtcggtaggttgccagccgcctaaggtgggatagatgattggggtg

SEQ ID NO: 1964 - DNA, 1294 bp, Streptococcus genomosp.
gatgaacgctggcggcgtgcctaatacatgcaagtagaacgagttgcgaacgggtgagtaacgcgtaggtaacctgcctcttagcgggggataactattggaaacgatagctaataccgcataaagaaagtcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaggctctgttgtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtg

SEQ ID NO: 1965 - DNA, 1327 bp, Streptococcus genomosp.
gacgaacgctggcggcgtgcctaatacatgcaagtagaacgagttgcgaacgggtgagtaacgcgtaggtaacctgcctggtagcgggggataactattggaaacgatagctaataccgcataataaaagtcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 1966 - DNA, 1554 bp, Streptococcus gordonii
tgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaagatgcaactgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1967 - DNA, 1546 bp, Streptococcus infantarius
tgagagtttgatcctggctcaggacgaacgctggcggcgtgcctaatacatgcaagtagaacgctgaaaactttagcttgctaaagtttgaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1968 - DNA, 1547 bp, Streptococcus infantis
tgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcatgacaacagttattgcatgataactgtttaaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggaagagtggaattccatgtgtagcggtgtaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgatcgcaaggttgaaactcaaaggaattgacgggggcccgcacaagcggtggagcatgtggtttaattcgaagcaacgcgaagaaccttaccaggtcttgacatccctctgaccgctctggagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttct

SEQ ID NO: 1969 - DNA, 1544 bp, Streptococcus intermedius
tttgatcctggttcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaaatgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagataagtctgaagttaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctt

SEQ ID NO: 1970 - DNA, 1473 bp, Streptococcus lutetiensis
tgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccggccttgtacacaccgcccgtcacaccacgagagtttgtaacacccgaagtcggtgaggtaaccttttaggagccagccgcctaaggtgggatagatgattggggtgaagtc

SEQ ID NO: 1971 - DNA, 1470 bp, Streptococcus massiliensis
gatgaacgctggcggcgtgcctaatacatgcaagtagaacgcagaggattggtgcttgcactaatctaatgagttgcgaacgggtgagtaacgcgtaggtaacctgcctggtagcgggggataactattggaaacgatagctaataccgcataatagtttatgactcatgttataaacttgaaagatacaactgtatcactaccagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgggagtaggagtggaaagcctactttgtgacggtacttaaccagaaagggacggctaactacgtgccagcagccgcggtaatacgtaggtcccgagcgttatccggatttattgggcgtaaagcgagcgcaggcggttagataagtctggagtaaaaggctatggctcaaccatagtgtgctctggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgtagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgtcctagagataggattttacttcggtacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacgacaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtg

SEQ ID NO: 1972 - DNA, 1430 bp, Streptococcus milleri
cgtagcttgctacaccatagactgtgagttgcgaacgggtgagtaacgcgtaggtaacctacctattagagggggataactattggaaacgatagctaataccgcataacagtatgtaacacatgttagatgcttgaaagatgcaattgcatcgctagtagatggacctgcgttgtattagctagtaggtagggtaatggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggccgcacaagcggtggagcatgtggtttaattcgaagcaacgcgaagaaccttaccaggtcttgacatcccagtgactgccctagagatagggtttcccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtggggatagatgattggggtgaagtc

SEQ ID NO: 1973 - DNA, 1560 bp, Streptococcus mitis
ccgccatgggcggccgcgggaaattcgattagagtttgattctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataacagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacaggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggcctgtggcttaaccatagtacgctttggaaactgtttaacttgagtgccaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaggcaacgcgaagaaccttaccaggtcttgacatccctctgaccgctctagagatagagttttccttcgggacagaggtgaccaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtgggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtaaccgtaaatcactagtgaattc

SEQ ID NO: 1974 - DNA, 1554 bp, Streptococcus mutans
tgagagtttgatcctggctcaggacgaacgctggcggcgtgcctaatacatgcaagtgggacgcaagagaacacactgtgcttgcacaccgtgttttcttgagtcgcgaacgggtgagtaacgcgtaggtaacctgcctattagcgggggataactattggaaacgatagctaataccgcataatattaattattgcatgataattgattgaaagatgcaagcgcatcactagtagatggacctgcgttgtattagctagttggtaaggtaagagcttaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagtcaagaacgtgtgtgagagtggaaagttcacacagtgacggtagcttaccagaaagggacggctaactacgtgccagcagccgcggtaatacgtaggtcccgagcgttgtccggatttattgggcgtaaagggagcgcaggcggtcaggaaagtctggagtaaaaggctatggctcaaccatagtgtgctctggaaactgtctgacttgagtgcagaaggggagagtggaattccatgtgtagcggtgaaatgcgtagatatatggaggaacaccagtggcgaaagcggctctctggtctgtcactgacgctgaggctcgaaagcgtgggtagcgaacaggattagataccctggtagtccacgccgtaaacgatgagtgctaggtgttaggccctttccggggcttagtgccggagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcttagagataggaagttacttcggtacatcggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggtcggtacaacgagttgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaaccttttaggggccagccgcctaaggtgggatggatgattggggtgaagtcgtaacaaggtagccgtatcggaaggtgcggctggatcacctcctttct

SEQ ID NO: 1975 - DNA, 1510 bp, Streptococcus oligofermentans
cggcgtgcctaatacatgcaagtagaacgctgaaggaaggagcttgctctttccggaagagttgcgaacgggtgagtaacgcgtaggtaacctaccttttagcgggggataactattggaaacgatagctaataccgcataagacattttactgcatggtaagatgttaaaagatgcaaatgcatcactaagagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcaccttctta

SEQ ID NO: 1976 - DNA, 1546 bp, Streptococcus oralis
tgagagtttgatcctggctcaggacgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1977 - DNA, 1545 bp, Streptococcus parasanguinis
tgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcaatatcgcatgatattgatttgaaaggtgcaaatgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacgctgtgacggtatcttaccagaaagggacggctaactacgtgccagcagccgcggtaatacgtaggtcccgagcgttatccggattattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttct

SEQ ID NO: 1978 - DNA, 1372 bp, Streptococcus pasteurianus
gaaatggagtttgatcctggctcaggacgaacgctggcggcgtgcctaatacatgcaagtagaacgagttgcgaacgggtgagtaacgcgtaggtaacctgcctactagcgggggataactattggaaacgatagctaataccgcataacgaaagtcactagtagatggacctgcgttgtattagctagttggtggggtaacggcccaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccacgccgtaaacgatgagtgctaggtgttaggcgcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggttggcaacgagtcgcaagtcggtgacggcaagcaaatctcttccaatctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctttct

SEQ ID NO: 1979 - DNA, 1543 bp, Streptococcus peroris
tgagagtttgatcctggctcaggatgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagcagttgttgcatgacagctgtttaaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacgctgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgccatttctagagataggaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttct

SEQ ID NO: 1980 - DNA, 1544 bp, Streptococcus pneumoniae
tgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtggatgttgcatgacatttgcttaaaaggtgcacttgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgctgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttcta

SEQ ID NO: 1981 - DNA, 1445 bp, Streptococcus porcinus
cgctggcggcgtgcctaatacatgcaagtagaacgcagaggacaggtgcttgcaccagtctaatgagttgcgaacgggtgagtaacgcgtaggtaacctaccttatagcgggggataactattggaaacgatagctaataccgcatgaaagtagaagacacatgtcatctacttaaaaggggcaaatgctctactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccgtcctagagataggatttcccttcggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaagg

SEQ ID NO: 1982 - DNA, 1376 bp, Streptococcus pseudopneumoniae
tgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttrcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtscggawttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaac

SEQ ID NO: 1983 - DNA, 1545 bp, Streptococcus pseudoporcinus
gagagtttgatcctggctcaggacgaacgctggcggcgtgcctaatacatgcaagtagaacgctgaggtctggtgcttgcactagaccaaggagttgcgaacgggtgagtaacgcgtaggtaacctacctcatagcgggggataactattggaaacgatagctaataccgcatgagactggggttcacatgaacccgagttaaaaggagcaaaagcttcactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattatgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttaggagcagaagagacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1984 - DNA, 1334 bp, Streptococcus ratti
  misc_feature (66)..(66): n is a, c, g, or t
  misc_feature (85)..(85): n is a, c, g, or t
  misc_feature (138)..(138): n is a, c, g, or t
  misc_feature (142)..(142): n is a, c, g, or t
  misc_feature (207)..(207): n is a, c, g, or t
  misc_feature (240)..(240): n is a, c, g, or t
  misc_feature (260)..(261): n is a, c, g, or t
  misc_feature (282)..(284): n is a, c, g, or t
  misc_feature (449)..(449): n is a, c, g, or t
  misc_feature (475)..(475): n is a, c, g, or t
  misc_feature (493)..(493): n is a, c, g, or t
  misc_feature (523)..(523): n is a, c, g, or t
  misc_feature (842)..(843): n is a, c, g, or t
  misc_feature (855)..(855): n is a, c, g, or t
  misc_feature (926)..(926): n is a, c, g, or t
  misc_feature (954)..(954): n is a, c, g, or t
  misc_feature (956)..(956): n is a, c, g, or t
  misc_feature (1018)..(1018): n is a, c, g, or t
  misc_feature (1070)..(1070): n is a, c, g, or t
  misc_feature (1121)..(1121): n is a, c, g, or t
  misc_feature (1295)..(1295): n is a, c, g, or t
  misc_feature (1304)..(1304): n is a, c, g, or t
gaacgggtgagtaacgcgtaggtaacctgcctattagcgggggataactattggaaacgatagctnataccgcataagagagttnaacacatgttagacgcttgaaagatgcaagagcatcactagtagatggacctncgtngtattagctagtaggtagggtaaaggcctacctaggcgacgatacatagccgacctgagagggtnaccggccacactgggactgagacacggcccagnctcctacgggaggcagcagnngggaatcttcggcaatggggnnnaccctgaccgagcaacgccgcgtgagtgaagaaggttttcggatcgtaaagctctgttgtcagagacgaacgtgtgtgagagtggaaagttcacacagtgacggtaactgaccagaaagggacggctaactacgtgccagcagccgcggtaatacgtaggtcccnagcgttgtccggatttattgggcgtnaagcgagcgcaggcggtnttgtaagtctgaagtcaaaggcagtggctnaaccattgtgtgctttggaaactgcaggacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgctgagtgctaggtgttaggccctttccggggcttagtgccggagctaacgcattaagcactccgcctggggagtacgaccgcaaggttgaaactcaaaggaattgacgggggccgcacaagnngtggagcatgtngtttaattcgaagcaacgcgaagaaccttaccaggtcttgacatcccgatgcccgctctagagatagagtnttactttcgtacatcggtgacaggtggngnatggttgtcgtcagctcgtgtcgtgagatgttgggttaagtcccgcaacgagcgcaaccctnattgttagttgccatcattgagttgggcactctagcgagactgccggtaatnaaccggaggaaggtggggatgacgtcaaatcatcatgccccttatgacctnggctacacacgtgctacaatggtcggtacaacgagtcgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtncacaccgcncgtcacaccacgagagtttgtaacacccga

SEQ ID NO: 1985 - DNA, 1555 bp, Streptococcus salivarius
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgactcatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 1986 - DNA, 1551 bp, Streptococcus sanguinis
tttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaattgattattgcatgataattgattgaaagatgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtatgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgttacaatggctggtacaacgagtcgcaagccggtgacggcaagctaatctctgaaagccagtctcagttcggattgtaggctgcaactcgcttacatgaagtcggaatcgctagtaatcgcggatcagcacgccgcggtgaatacgttcccgggcattgtacactccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttcta

SEQ ID NO: 1987 - DNA, 1510 bp, Streptococcus sinensis
agtttgatcctggctcaggacgaacgctggcggcgtgcctaatacatgcaagtggaacgcacaaggtgcaccgtagtttactacaccgtactttgtgagtcgcgaacgggtgagtaacgcgtaggtaacctaccttttagcgggggataactattggaaacgatagctaataccgcataagatatcttactgcatggtaagatattaaaagatgcaattgcatcactaagagatggacctgcgttgtattagctagtaggtgaggtaacggctcacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaag

SEQ ID NO: 1988 - DNA, 1478 bp, Streptococcus sp.
gacgaacgctggcggcgtgcctaatacatgcaagtaggacgcacagtctataccgtagcttgctacaccataggctgtgagttgcgaacgggtgagtaacgcgtaggtaacctgcctattagagggggataactattggaaacgatagctaataccgcataatagtatgtaacacatgttagatgcttgaaagatgcaattgcatcgctagtagatggacctgcgttgtattagctagtaggtagggtaaaggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaatgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtg

SEQ ID NO: 1989 - DNA, 1554 bp, Streptococcus sp.
tgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaaggtgcaaatgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 1990 - DNA, 1501 bp, Streptococcus sp.
gacgaacgctggcggcgtgcctaatacatgcaagtagaacgctgaggtcatgtgcttgcacaagaccaaggagttgcgaacgggtgagtaacgcgtaggtaacctgcctcatagcgggggataactattggaaacgatagctaataccgcatgagagtttttaacacatgttaggaacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatggaagtaggagtggaaagtctacttcgtgacggtaactaaccagaaagggacggctaactacgtgccagcagccgcggtaatacgtaggtcccgagcgttgtccggatttattgggcgtaaagcgagcgcaggcggttctataagtctgaagttaaaggcagtggctcaaccattgttcgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggagacaggtggtgcatggttgtcgtcagctcgtgtcgtgagatgttgggttaagtcccgcaacgagcgcaacccctattgttagttgccatcattcagttgggcactctagcaagactgccggtaataaaccggaggaaggtggggatgacgtcaaatcatcatgccccttatgacctgggctacacacgtgctacaatggttggtacaacgagtcgcaagtcggtgacgacaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaagg

SEQ ID NO: 1991 - DNA, 1395 bp, Streptococcus sp.
  misc_feature (39)..(40): n is a, c, g, or t
  misc_feature (44)..(44): n is a, c, g, or t
  misc_feature (89)..(89): n is a, c, g, or t
  misc_feature (831)..(831): n is a, c, g, or t
agttgcgaacgggtgagtaacgcgtaggtaacctacctnntagngggggataactattggaaacgatagctaataccgcataacagtangtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattnacgggggccgcacaagcggtggagcatgtggtttaattcgaagcaacgcgaagaaccttaccaggtcttgacatcccagtgactgccctagagatagggttttccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaagagccagccgcctaaggtgggatagatgattgggg

SEQ ID NO: 1992 - DNA, 1272 bp, Streptococcus sp.
gacgaacgctggcggcgtgcctaatacatgcaagtaggacgagttgcgaacgggtgagtaacgcgtaggtaacctgcctattagagggggataactattggaaacgatagctaataccgcataacgaaagtcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagatgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttaggtacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaa

SEQ ID NO: 1993 - DNA, 1262 bp, Streptococcus sp.
ggcggcgtgcctaatacatgcaagtagaacgagttgcgaacgggtgagtaacgcgtaggtaacctgccttgtagcgggggataactattggaaacgatagctaataccgcataacgaaagccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagatgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttggatattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggttggcaacgagttgcgagtcggtgacggcaagctaatctcttccaatctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaa

SEQ ID NO: 1994 - DNA, 1449 bp, Streptococcus sp.
  misc_feature (1361)..(1361): n is a, c, g, or t
acgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcgggtggaatncgttcccgggccttgtacacaccgcccgtcacaccacgagagtttgtaacacccgaagtcggtgaggtaaccgtaaggagccagccgc

SEQ ID NO: 1995 - DNA, 1360 bp, Streptococcus sp.
atacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataattcattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcaccagcggtggagcatgtggtttaatttgaagcaacgcgaagaaccttaccaggtcttgacatccctttgaccgctctagagaaagagttttccttcgggacagaggtgacaggtggtgcatggttgttgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaattttttaaagccagtctcagttcggattgtaggctgcaacttgcctacatgaagttggaatcgctagtaatcgcggatcagcacgccgcggtgaatacgttcccgggccttgtacacaccgccc

SEQ ID NO: 1996 - DNA, 1545 bp, Streptococcus sp.
tgagagtttgatcctggctcaggacgaacgctggcggcgtgcctaatacatgcaagtagaacgctgaagagaggagcttgctcttcttggaagagttgcgaacgggtgagtaacgcgtaggtaacctgccttgtagcgggggataactattggaaacgatagctaataccgcataacaatgggtgacccatgtcattcatttgaaaggggcaactgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttatggagccagccgcctaaggtgggatagatgattggggtgaagtcgtaacaaggtagccgtatcggaaggtgcggctggatcacctcctttct

SEQ ID NO: 1997 - DNA, 1427 bp, Streptococcus sp.
acgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataatccattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 1998 - DNA, 1432 bp, Streptococcus sp.
caggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgaaaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtga

SEQ ID NO: 1999 - DNA, 1434 bp, Streptococcus sp.
ggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgtcgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcc

SEQ ID NO: 2000 - DNA, 1439 bp, Streptococcus sp.
ggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataatccattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaa

SEQ ID NO: 2001 - DNA, 1432 bp, Streptococcus sp.
  misc_feature (203)..(203): n is a, c, g, or t
ggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataaaatggattatcgcatgataattcattgaaaggtgcaaatgcatcactaccagatggacntgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagc

SEQ ID NO: 2002 - DNA, 1421 bp, Streptococcus sp.
taatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagcc

SEQ ID NO: 2003 - DNA, 1261 bp, Streptococcus sp.
cgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagcca

SEQ ID NO: 2004 - DNA, 1544 bp, Streptococcus sp.
tgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagcagttattgcatgataactgtttgaaaggtgcaattgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttct

SEQ ID NO: 2005 - DNA, 1543 bp, Streptococcus sp.
tgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggcttaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttct

SEQ ID NO: 2006 - DNA, 1258 bp, Streptococcus sp.
acgaacgctggcggcgtgcctaatacatgcaagtaggacgagttgcgaacgggtgagtaacgcgtaggtaacctgcctattagagggggataactattggaaacgatagctaataccgcataacgaaagtcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagatgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcgaacaggattagataccctggtagtccacgccgtaaacgatgagtgctaggtgttaggtacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggta

SEQ ID NO: 2007 - DNA, 1365 bp, Streptococcus sp.
  misc_feature (336)..(336): n is a, c, g, or t
  misc_feature (373)..(373): n is a, c, g, or t
  misc_feature (697)..(697): n is a, c, g, or t
  misc_feature (1014)..(1014): n is a, c, g, or t
ggagtttgattatggctcaggatgaacgctggcggcgtgcctaatacatgcaagtagaacgagttgcgaacgggtgagtaacgcgtaggtaacctgcctggtagcgggggataactattggaaacgatagctaataccgcataacgaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgngtgagtgaagaaggttttcggatcgtaaagctctgtngtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatgtatggaggaacaccggtggcgaaagcggctctctggcttgactgacgctgaggctcgaaagcgtggggagcatacaggattagatancctggtagtccacgccgtaaacgatgagtgctaggtgttgggtactcagtgccgcagctaacgcattaagcactccgcctggggagtacgaccgcaaggttgaaactcaaaggaattgacaggggcccgcacaagcggtggagcatgtggtttaattcgaagcaacgcgatgaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagttggtgacggcaagctaatctcttccagtctcagttcggatgtagtctgcaactcgcctccagaagttggattcgctagtaatcgcggatcagccatggcgcggtgaatacgttcccgggccttgtacacaccgcccgtcacaccacgagagtttgtaacacccgaagtcggtaggtagccggccgcctaaggtgggatagatgattggggtgaagtcgtaacaaggtagccgtatcggaaggtgcggctggaacacctcctt

SEQ ID NO: 2008 - DNA, 1363 bp, Streptococcus sp.
  misc_feature (1014)..(1014): n is a, c, g, or t
  misc_feature (1059)..(1059): n is a, c, g, or t
  misc_feature (1084)..(1084): n is a, c, g, or t
  misc_feature (1123)..(1123): n is a, c, g, or t
  misc_feature (1136)..(1136): n is a, c, g, or t
  misc_feature (1148)..(1148): n is a, c, g, or t
  misc_feature (1160)..(1160): n is a, c, g, or t
  misc_feature (1285)..(1286): n is a, c, g, or t
  misc_feature (1348)..(1348): n is a, c, g, or t
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataataaaagtcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagaaaaaatgacggtatcttaccagaaagggacggctaactactcgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgancgggctacacacgtggtacgatggntggcaacgagtcgcaagccggtgacggcaagctaatctnttccagtctcagntcggatgtaggntgcaaatcgccnacagaagtcggaatcgctagtaatcgcggatcagcacgccgcggtgaatacgttcccgggccttgtacacaccgcccgtcacaccacgagagtttgtaacacccgaagtcggtaggtagccagcnncctaaggtgggatagatgattggggtgaagtcgtaacaaggtagccgtatcggaaggtacgnctgggacacctcctt

SEQ ID NO: 2009 - DNA, 1366 bp, Streptococcus sp.
  misc_feature (1016)..(1016): n is a, c, g, or t
ggagtttgattatggctcaggactaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatggacctgcgttgtattagctagttggtggggtaagggctcaccaaggcgacgatatatagccgacctgagagggtgatcggccacactgggactgagacacggcccagactcctacgggaggcagcagtagggaatcttcggcaatggacggaagtctgaccgagccacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtaccggtgaaatgggtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaaggaccttaccaggtcttgccatcgacaggtgatgcatggttgtcgtcagctcgtgtcgtgagatgttgggttaagtcccgcaacgagcgcaacccctattgttagttgccatcagttgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2010 - DNA, 1364 bp, Streptococcus sp.
  misc_feature (1014)..(1014): n is a, c, g, or t
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccacgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagtaaaaggctgtggcttaaccatagtacgctttggaaactgtttaacttgagtgcaagaggggagagtggaattccatgtgtagcggtgaaatgcgtagatatatggaggaacacccgtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 2011 - DNA, 1361 bp, Streptococcus sp.
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatgaacctgcgttgtattagctagttggtgaggtaacggctcaccaaggcgacgatacatagccgaactgagagggtgaacccccacactgggactgagacacggaccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagatacccggtagtccaccccgtaaacgatgagtgctaggtgttagacgtttagtaccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaaccctattgttagttgccatcatgggcactctagcgagactgccggtaataaaccggaggaaggtgggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2012 - DNA, 1358 bp, Streptococcus sp.
  misc_feature (59)..(59): n is a, c, g, or t
  misc_feature (457)..(457): n is a, c, g, or t
ggagtttgattatggctcagatgaacgctggcggcgtgcctaatacatgcaagtagaantagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgataaatagccgacctgagaggatgatccgccacactgggactgagacacggcccagactcctacgggaggcagcagtagggaatcttcgacaatggacgcaactgacccagcaacgccgcgtgactgaagaaggccttcggatcgtaaagcactgttgtaagagaagatgacggtaacttaccagaaagggacggctaactacgtgccagcagccgcggtaatacgtaggtcccgagcgttatcnggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaggctcgaaagcgtggggagcaaacaggattagataccctggtagtccaccccgtaaacgatgagtgctaggtgttgggtactcagtgccgcagctaacgcattaagcactccgcctggggagtaccaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaaccctattgttagttgccatcatgggcactctagcgagactgccggtaataaaccggaggaaggtgggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgttagtaatcgcggatcagcacgccgcggtgaatacgttcccgggccttgtacacaccgcccgtcacaccacgagagtttgtaacacccgaagtcggtaggtagtcagccgcctaaggtgggatagatgattggggtgaagtcgtaacaaggtagccgtatcggaaggtgcggctggatcacctcctt

SEQ ID NO: 2013 - DNA, 1359 bp, Streptococcus sp.
  misc_feature (1012)..(1012): n is a, c, g, or t
agtttgattatggctcaggatgaacgctggcggcgtgcctaatacatgcaagtagaacgagttgcgaacgggtgagtaacgcgtaggtaacctgcctggtagcgggggataactattggaaacgatagctaataccgcataacgaaagtcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaggacggtatcttaccagaaagggacggctaactacgtgccagcagctgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacatcggtggcgaaagcggctctctggcttgactgacgctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctatagttagttgccatcatgggcactctagcgagactgccggtaataaancggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcccacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctc

SEQ ID NO: 2014 - DNA, 1364 bp, Streptococcus sp.
  misc_feature (594)..(595): n is a, c, g, or t
ggagtttgatcatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtaccnncgaaatgcgtagatatatggaggaacaccggtggcgaaagcggctctctggcttgactgacgctgaggctcgaaagcgtggggagcaaacaggattagataccccggtagtccacgccgtaaatgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttagcaggtcttgacatcgacaggtggtgcatggttgtcgtcagctcgtgtcgtgagatattgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 2015 - DNA, 1564 bp, Streptococcus sp.
  misc_feature (445)..(445): n is a, c, g, or t
  misc_feature (936)..(936): n is a, c, g, or t
  misc_feature (939)..(939): n is a, c, g, or t
gacgttttgattcttggctcagtgaccaacgctggcggcgtgcctaatacatgcaagtagaacgctgaaggaggagcttgcttctccggatgacgttgcgaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcattgtgacggaagtcttgaccgagccaacgcctcggtgagtgaagaaggttttccggatcgtaaagctctgnttgtaagagacagaacgagttgtgagacgtggaaagttcacactggtgacggtatcttaccagaaagggacggctaactacgtgccagcagccgcggtaatacgtaggtcccaagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaaagcggctctctgggcttgtaactgacgctgaggctcgaaagcgtggggagcaaacaggattagataccctggtagtccacgccgtaaactgatgagtgctaggtgttagaccctttccggggtttagtgccgtagctaacgcattaagcactccgcctggggagtacgaccgcaaggttgaaactcaaaggaatngancgggggcccgcacaagcggtggagcatgtggtttaattcgatgcaacgcgaagaaccttacctggtcttgacatccctgtgaccgttctagagatggattgtttccttcgggagcagaggtgacaggtggtgcatggttgtcgtcagctcgtgtcgtgagatgttgggttaagtcccgcaacgagcgcaacccctattgcttaggtaaaactccccggggagttgggcactctagcgagactgccggtgataaaccggaggaaggtggggatgacgtcaagtcatcatggcccttatgacctgggctacacacgtgctacaatggcgtatacagagggaagcgatagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggctggaacacctccttc

SEQ ID NO: 2016 - DNA, 1366 bp, Streptococcus sp.
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgatggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcagttgggcgctctagcgagactgccggtaataaaccggaggaaggtggggatgacgtcaaatcatcatgccccttatgacctgggctacacacgtgctacaatggctggcaacgtgtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2017 - DNA, 1364 bp, Streptococcus sp.
  misc_feature (1076)..(1076): n is a, c, g, or t
  misc_feature (1078)..(1078): n is a, c, g, or t
  misc_feature (1298)..(1298): n is a, c, g, or t
  misc_feature (1318)..(1318): n is a, c, g, or t
  misc_feature (1357)..(1357): n is a, c, g, or t
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttctcggatcgtaaagctctgttgtaagagaagatgacggtatcttaccagacagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggatcagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgntncaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtggnatagatgattggggggaaancgtaacaaggtagccgtatcggaaggtgcggctggatcncttcctt

SEQ ID NO: 2018 - DNA, 1342 bp, Streptococcus sp.
  misc_feature (244)..(244): n is a, c, g, or t
  misc_feature (250)..(250): n is a, c, g, or t
gacgaacgctggcggcgtgcctaatacatgtaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacngcccanactcctacgggaggcagcagtagggaatcttcggcagtggacggaagtctgaccgagcacgccgcgtgagtgaagaaggtttccggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaatcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2019 - DNA, 1356 bp, Streptococcus sp.
  misc_feature (1143)..(1143): n is a, c, g, or t
  misc_feature (1343)..(1343): n is a, c, g, or t
ggagtttgatcctggctcaggacgaacgctggcggcgtgcctaatacatgcaagtagaacgagttacgaacgggtgagtaacgcgtaggtaacctgcctggtagcgggggataactattggaaacgatagctaataccgcataaaaaagtcactaccagatggacctgcgttgtattagctagttggtggggtaaaggcttaccaaggcgacgatacatagccgacctgagagggtgaacggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgccggtatcttaccagaaagggacggctaactacgtgccagcagccgcggtaatacgtaggtcccgagcgttgtccggatttattgggcgtaaagggagcgcaggcggttagaaaagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggatcaaacaggattagataccctggtagtccacgccgtaaacgctgagggctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctctgccagtctcagttcggatntaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcgaaagntgcggctggaaca

SEQ ID NO: 2020 - DNA, 1360 bp, Streptococcus sp.
  misc_feature (31)..(31): n is a, c, g, or t
  misc_feature (334)..(334): n is a, c, g, or t
  misc_feature (680)..(680): n is a, c, g, or t
  misc_feature (684)..(684): n is a, c, g, or t
ggagtttgattttggctcaggacgaacgctncggcgtgcctaatacatgcaagtagaacgagttgcgaactggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccngtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagtttaaggctgtggcttaaccatagtacgctttggaaactgtttaacttgagtgcaagaggggagagtggaattccatgtgtagcggtgaaatgcgtagatatatggaggaacaccggtggcgaaagcggctctccgcttgactgacgctgaggctcgaaagcgtggggagcanacangattagataccctggtagtcacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggatcacctcctt

SEQ ID NO: 2021 - DNA, 1363 bp, Streptococcus sp.
  misc_feature (544)..(544): n is a, c, g, or t
  misc_feature (634)..(634): n is a, c, g, or t
  misc_feature (697)..(697): n is a, c, g, or t
  misc_feature (727)..(727): n is a, c, g, or t
ggagtttgattatggctcaggatgaacgctggcggcgtgcctaatacatgcaagtagaacgagttgcgaacgggtgagtaacgcgtaggtaacctgcctcttagcgggggataactattggaaacgatagctaataccgcataagaaagacactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttgganactgtttaacttgagtgcagaaggggagagtggaattccatgtgtagcggtgaaatgcgtagatatatggaggaacaccggtggcgaaancggctctctggtctgactgacgctgaggctcgaaagcgtggggagcaaacaggattagatagnctggtagtccacgccgtaaacgatgagtgntaggtgttgggtactcagtgccgcagctaacgcattaagcactccgcctgaggagtacgacagcaaggttgaaactcaaaggaattgacgggggcccgcacaagcggtggagcatgtggtttaattcgaagcaacgcgaagaaccttaccaggtcttgacatctacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagcagcctaaggtgggatagatgattggggtgaagtcgtaacaaggtagccgtatcggaaggtgcggctggatcacctcctt

SEQ ID NO: 2022 - DNA, 1364 bp, Streptococcus sp.
  misc_feature (398)..(398): n is a, c, g, or t
  misc_feature (401)..(401): n is a, c, g, or t
  misc_feature (1014)..(1014): n is a, c, g, or t
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagacgatgacggtatcttancanaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagatacccagcaagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaancggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggttggaacacctcctt

SEQ ID NO: 2023 - DNA, 1365 bp, Streptococcus sp.
ggagtttgattatggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaccgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2024 - DNA, 1262 bp, Streptococcus sp.
  misc_feature (1065)..(1065): n is a, c, g, or t
  misc_feature (1067)..(1067): n is a, c, g, or t
  misc_feature (1137)..(1137): n is a, c, g, or t
  misc_feature (1223)..(1223): n is a, c, g, or t
  misc_feature (1250)..(1250): n is a, c, g, or t
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagctgccgcggtaatacgtaggtcccgagcgttgtccggatttattgggcgtaaagcgagcgcaggcggttagataagtctgaagttaaaggctgtggcttatccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataacctggtagtccacgccgtaaacgatgagtgctaggtgttagacgtttagtgccgcagctaacgcattaagcactccgcctggggagtacgaccgcaaggtggaaactcaaaggaattgacgggggcccgcacaagcggtggagcatgtggtttaattcgaagcaacgcgaagaaccttatccagtcttgacatcgacaggtggtgcatggttgtcgtcagctcgtgtcgtgagatgttgggttaagtcccgcaacgagcgcaacccctattgttagttcccatcatgggcactctagcgagactgccggtaataaaccggaggaaggtggggatgacgtcaaatcatcatgccccttatgactggaancncacacgtgctacaatggctggcaacgagtcgccaaccggtgacggcaagctaatctcttccagtctcagntcggatgtaggctgcaactcgcctacagaagtcggaatcgctagtaatcgcggatcagcacgccgcggtgaatacgttcccgggcnttgtacacgccgcccgtcacccccccngagtttgtaaca

SEQ ID NO: 2025 - DNA, 1362 bp, Streptococcus sp.
  misc_feature (587)..(587): n is a, c, g, or t
ggagtttgattctggctcaggacgaacgccggcggcgtgcctaatacatgcaagtagaacgagttgcgaacgggtgagtaacgcgtaggtaacctgcctggtagcgggggataactattggaaacgatagctaataccgcataaaaaagtcactaccagatggacctgcgttgtattagctagttggtggggtaacggctcaccaaggcgacgatacatagccgacttgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgngtagcggtgaaatgcgtaatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2026 - DNA, 1364 bp, Streptococcus sp.
  misc_feature (232)..(232): n is a, c, g, or t
  misc_feature (657)..(657): n is a, c, g, or t
  misc_feature (1122)..(1122): n is a, c, g, or t
ggagtttgattctggctcaggatgaacgctggcggcgtgcctaatacatgcaagtagaacgagttgcgaacgggtgagtaacgcgtaggtaacctgcctcttagcgggggataactattggaaacgatagctaataccgcataagaaagtcactaagagatggacctgcgttgtattagctagttggtgaggtaacggctcaccaaggcgacgatacatagccgacctgagngggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagatgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagctacgctttggaaactgtttaacttgagtgcagaaggggagagtggaattccatgtgtagcggtgaaatgcgtagatatatggaggaacaccggtggcgaaagcggctctctggtctgactgacnctgaggctcgaaagcgtggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcgagtcggtgacggcaagctaatntcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaagatgggatagatgattggggtgaagtcgtaacaaggtagccgtatcggaaggtgcggttggaacacctcctt

SEQ ID NO: 2027 - DNA, 1357 bp, Streptococcus sp.
  misc_feature (787)..(787): n is a, c, g, or t
ggagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataataaaagccactaccagatggacctgcgttgaattagctagttggtggggtaacggctcaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgtgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcgactctctggcttgactgacgctgaggctcgaaagcgtggggagcaaacaggattagataccccggtaatccacgccgtaaacaatgagtgctaggtgttagacgtttagtgccgtagctaacgcattaagcactccgcctggggagtacgnccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctatagttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacac

SEQ ID NO: 2028 - DNA, 1549 bp, Streptococcus sp.
  misc_feature (630)..(630): n is a, c, g, or t
  misc_feature (782)..(782): n is a, c, g, or t
  misc_feature (901)..(901): n is a, c, g, or t
  misc_feature (1305)..(1305): n is a, c, g, or t
tgctcatggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataatattgactattgcatgatagtcaattgaaaggtgcaaatgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttgngaaactgttaaacttggagtgcagaaggggagagtggaattcccatatgtagcggtaaaatgcgtagatatatgggaggaaccaccgctgggcgaaagcggctatctggtctgtgaactgacgctgagggctcgaaagcgtggggagcaaancaggattagataccacgggtagtccacgccgtaaacgatgagtgctaggtgttgggtcctttccgggactcagtgccgcagctaacgcattaagcactccgcctggggagtacgaccgncaaggttgaaactcaaaggaattgaccgcgggcccgcacaagcggtggagcatgtggtttaattcgaagcaacgcgaagaaccttaccaggtcttgacatcccggtgcccgtcctagagataggattttgcttcggcacacccggtgacaggtgggtgcatggttgtcgtcagctcgtgtcgtgagaatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcngttcggattgtaggctgcaactcgcctacatgaagccggaatcgctagtaatcgtggatcagcacgccgcggtgaatacgttcccgggtcttgtacacaccgcccgtcacaccacgagagtttgtaacacccaaagtcggtgaggtaacctttatggagccagccgcctaaggtgggatagatgattggggtgaagtcgtaacaaggtagccgtatcggaaggtgcggctggatcacctccttc

SEQ ID NO: 2029 - DNA, 1540 bp, Streptococcus sp.
gagagtttgatyctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatattgattattgcatgatagtcaattaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatggcctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctccttc

SEQ ID NO: 2030 - DNA, 1541 bp, Streptococcus sp.
gagagtttgattctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcgtaaaattgattattgcatgatagtcaattaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgcaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctccgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctccttc

SEQ ID NO: 2031 - DNA, 1363 bp, Streptococcus sp.
gagtttgattctggctcaggatgaacgcaggcggcgtgcctaatacatgcaagtagaacgagttgcgaacgggtgagtaacgcgtaggtaacctgcctggtagtgggggataactattggaaacgatagctaataccgcataatgaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcagacggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctactgttagttgccatcatgggcactctagcgagactgccggtaataaaccggaggaaggtggggatgacgtcaaatcatcatgccccttatgacctgggctacacacgtgctacaatggctggcaacgagtcgcaagtcggtgacgacaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgcggctggaacacctcctt

SEQ ID NO: 2032 - DNA, 1363 bp, Streptococcus sp.
gagtttgattctggctcaggacgaacgctggcggcgtgcctaatacatgcaagtagaacgagttgcgaacgggtgagtaacgcgtaggtaacctgcctggtagcgggggataactattggaaacgatagctaataccgcataacaaaagccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaaccccgcgtgagtgaagaaggttttcggatcgtaaaactctgttgttagagaagatgacggtatctaaccagaaagacacggctaactacgtgccagcagccgcggtaatacgtaggtggcaagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgactgacgctgaagctcgaaagcggggggagcaaacaggattagataccctggtagtccacgccgtaaacgatgagtgctaggtgttgggtactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagccgtaacaaggtagccgtatcggaaggtgcggctggaacacctcctt

SEQ ID NO: 2033 - DNA, 1324 bp, Streptococcus sp.
gacgaacgctggcggcgtgcctaatacatgcaagtagaacgagttgcgaacgggtgagtaacgcgtaggtaacctgcctggtagcgggggataactattggaaacgatagctaataccgcataatgaaagtcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaagg

SEQ ID NO: 2034 - DNA, 1322 bp, Streptococcus sp.
gacgaacgctggcggcgtgcctaatacatgcaagtagaacgagttgcgaacgggtgagtaacgcgtaggtaacctgcctggtagcgggggataactattggaaacgatagctaataccgcataaagaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagatgacggtatcttaccagaaagggacggctaactacgtgccagcagccgcggtaatacgtaggtcccgagcgttgtccggatttattgagcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaa

SEQ ID NO: 2035 - DNA, 1324 bp, Streptococcus sp.
gacgaacgttggtggcgtgcctaatacatgcaagtagaacgagttgcgaacgggtgagtaacgcgtaggtaacctgcctggtagcgggggataactattggaaacgatagctaataccgcataaagaaagtcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagcgaagaaggttttcggatcgtaaagctctgttgtaagagaagatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgactgacgctgaggctcgaaagcgtggggagcaaacaggattagataccctggtagtccacgccgtaaacgatgagtgctaggtgttagacgtttagtgccgcagctaacgcattaagcactccgcctggggagtacgacgcaggtgaaactcaaaggaattgacgggggcccgcacaagcggtggagcatgtggtttaattcgaagcaacgcgaagaaccttaccaggtcttgacatcgactggtggtgcatggttgtcgtcagcttgtgtcgtgagatgttgggttaagtcccgcaacgagcgcaacccctattgttagttgccatcatgggcactctagcgagactgccggtaataaaccggaggaaggtggggatgacgtcaaatcatcatgccccttatgacctgggctacacacgtgctacaatggctggcaacgagtcgcaagccggtgacggcaagctaatctcttccagtctcagttcggatgtaggctgcaactcgcctacagaagtcggaatcgctagtaatcgcggatcagcacgccgcggtgaatacgttcccgggccttgtacacaccgcccgtcacaccacgagagtttgtaacacccgaagtcggtaggtagccagccgcctaaggtgggatagatgattggggtgaagtcgtaacaaggtagccgtatcggaaggtgc

SEQ ID NO: 2036 - DNA, 1546 bp, Streptococcus sp.
tgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgatgattcattgaaaggtgcaaatgcatcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgtggctggatcacctcctttct

SEQ ID NO: 2037 - DNA, 1203 bp, Streptococcus sp.
gatgtacgctggcggcgtgcctgatacatgcaagtagcacgctgaagcttaggtgcttgcaccgagcggatgagttgcgaaccggggtgaggtcaaacggcggtagggtaaaccttgcccttcttagcgggggatatactaatgtgtgaaaacgaatagcttaatacccgcatcataagagactgatatcgcatgatattgatttgaaagatgcaattgcatcagctaagagatggacctgtgttgtattagctagttggtgaggtaacggctgcaccaaggcaacgatacatagccgacctgagagggtgatcggccacactgggactgagacacggcccagactcgtacgggaggcagcagtagggtatcttcggcaatgggggcaaccctgaaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtgtaattcgaagcaacgcgaagaaccttaccatgtcttgacatccctctgaccgctctagagatagagtgtcgcttcgggacagaggtgacaggtggtgcatgggtgtcgtcagctcgtgtcgtgagatgtggggttaagtccgcaacgagcgcacccctatgatagtgccatcattacgtgggcactctagcgaactgcgggtattaacccgaggaagggtgggaatacgtcaatatatg

SEQ ID NO: 2038 - DNA, 1216 bp, Streptococcus sp.
gacgaacgctggcggcgtgcctaatacatgcaagtggaacgctgaagagaggagcttgctcttcttggatgagttgcgaacgggtgagtaacgcgtaggtaacctgcctggtagcgggggataactattggaaacgatagctaataccgcatgaaatggattatcgcatgataatcgattgaaaggtgcaaatgcatcactaccagatggacctgcgttgtattagctagttggtgaggtaacggctcaccaaggcaacgatacatagccgacctgagagggtgatcggccacactggggctgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgcaactgacgctgaggctcgaaagcgtggggagcaaacaggattaggtaccctggtagtccacgccgtaaacgatgagtgctaggtgttagaccctttccggggtttagtgccgcagctaacgcattaagcactccgcctggggagtacgaccgcaaggttgaaactcaaaggaatagacgggggcccgcacaagcggtggagcatgtggtttaattcgaagcaacgcgaagaacctaccaggtcttgacatccctctgaccgctctagagatagagttttccctcgggacagaggtgacagggtggtgcatgggttgtcgtcagctcgtgtcgtgagatgtcggggttaggtccgccacgagcgcacccctattgttgttgccatcattagttgggcaccctagcggactgccggtatttacccgaaggagggtggggattacgtcaagttactatgccccctatgatcggggctacacgagtcctacatg

SEQ ID NO: 2039 - DNA, 1204 bp, Streptococcus sp.
gacgtacgctggcggtgtgcctgatacatgcaagtagcacgctgaagagaggtgcttgctcttcttggatgagttgcgaacgggtgagtcacgcgtaggtaacctgcctgatagcgggggctaactattgtaaacgatagctaataccgcatgaaatggattatcgcatgataatcgattgaaaggtgcagatgcatcactaccagatggacctgcgttgtattagctagttggtgaggtaacggctcaccacggcaacgatacatagccgacctgagagggtgatcggccacactgggactgagacacggccccagacacgtacggggaggcagcagtagggtatcttcggcaatggacggaagtactgaccgagcaacgccgcgtgagtgaagaaggtgttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggtggaaactcaaaggaattgacgggggcacgcacaagcggtggagcatgtggtttaattcgaagcaacgcgaagaaccttaccaggtcttgacatccctctgaccgctctagagatagagttttccctcgggacagaggtgacagggtggtgcatgggttgtcgtcagccgtgtcgtgagatgttcgggttaagtccgccacgagcgccacccctattgttagttgcccatcatttaggtgggtcaccttagcgagactgcccggtattaaccggagggagggtgggaatacgtcaaatatcatgccccttatacgtgg

SEQ ID NO: 2040 - DNA, 1447 bp, Streptococcus sp.
  misc_feature (84)..(84): n is a, c, g, or t
  misc_feature (126)..(126): n is a, c, g, or t
  misc_feature (311)..(311): n is a, c, g, or t
  misc_feature (1444)..(1444): n is a, c, g, or t
ttaatcatgagtcgcgaacgggtgagtaacgcgtaggtaacctgcctgatagcgggggataactattggaaacgatagctaatnccgcataagagtcgttaacacatgttaatgatttaaaaggancaattgcttcactatcagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatggacgaaagtctgaccgancaacgccgcgtgagtgaagaaggttttcggatcgtaaagctctgttataagcgaagaacgggagtaagagtggaaagtttactctgtgacggtagcttatcagaaagggacggctaactacgtgccagcagccgcggtaatacgtaggtcccgagcgttgtccggatttattgggcgtaaagcgagcgcaggtggtttaataagtctgaagttaaaggcattggctcaaccaatgtacgctttggaaactgttgaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccatcctagagataggatttcccttcggggcactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggtcggtacaacgagttgcgagctggtgacagtaagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggntgg

SEQ ID NO: 2041 - DNA, 1547 bp, Streptococcus suis
tgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttcta

SEQ ID NO: 2042 - DNA, 1543 bp, Streptococcus thermophilus
tgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgttccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctccttt

SEQ ID NO: 2043 - DNA, 1431 bp, Streptococcus uberis
agtagaacgctgaggactggtgcttgcactggtctaaggagttgcgaacgggtgagtaacgcgtaggtaacctacctcatagcgggggataactattggaaacgatagctaataccgcatgacaatagggtacacatgtaccctatttaaaaggggcaaatgcttcactatgagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatga

SEQ ID NO: 2044 - DNA, 1466 bp, Streptococcus urinalis
cgctggcggcgtgcctaatacatgcaagtagaacgctgaggtcatgtgcttgcacaagaccaaggagttgcgaacgggtgagtaacgcgtaggtaacctgcctcatagcgggggataactattggaaacgatagctaataccgcatgagagtttttaacacatgttaggaacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatggaagtaggagtggaaagtctacttcgtgacggtaactaaccagaaagggacggctaactacgtgccagcagccgcggtaatacgtaggtcccgagcgttgtccggatttattgggcgtaaagcgagcgcaggcggttctataagtctgaagttaaaggcagtggctcaaccattgttcgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggagacaggtggtgcatggttgtcgtcagctcgtgtcgtgagatgttgggttaagtcccgcaacgagcgcaacccctattgttagttgccatcattcagttgggcactctagcaagactgccggtaataaaccggaggaaggtggggatgacgtcaaatcatcatgccccttatgacctgggctacacacgtgctacaatggttggtacaacgagtcgcaagtcggtgacgacaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtga

SEQ ID NO: 2045 - DNA, 1545 bp, Streptococcus vestibularis
tgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttct

SEQ ID NO: 2046 - DNA, 1195 bp, Streptococcus viridans
gagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattaattgaaaggtgcaattgcaccactaccagatggacctgcgttgtactagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgttagagaagaacgggtgttagagtggaaagttcacactgtgacggtatcttaccagaaagggaccgctaactaagtgccagcagccgcggtaatacgtaggtcccgagcgttgtccggatttattgggcgtaaacgagcgcagccggttagataagtctgaagttaaaggctgtggcttaaccatagtacgctttggaaactgtttaacttgagtgcagaaggggagagtgaattccatgtgtagcggtaaatgcgtagatatatggaggaacaccggtggcgaaagcggctctctggtctgtaactgacgctgaggctcgagagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgaggtgttgggttaagtcccgcaacgagcgcaacccttattgttagttgccatcattcagttgggcactctagcgagactgccggtaataaaccggaggaaggtggggatgac

SEQ ID NO: 2047 - DNA, 1313 bp, Streptomyces albus
acgctggcggcgtgcttaacacatgcaagtcgaacgagtggcgaacgggtgagtaacacgtgggcaatctgccctgcactctgggacaagccctggaaacggggtctaataccggatatggaaaggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagatgacggtacctgcagaagaagcaccggctaactacgtgccagcagccgcggtaatacgtagggtgcgagcgttgtccggaattattgggcgtaaagagctcgtaggcggcttgtcgcgtcggatgtgaaagcccggggcttaaccccgggtctgcattcgatacgggcaggctagagttcggcaggggagattggaattcctggtgtagcggtgaaatgcgcagatatcaggaggaacaccggtggcgaaggcggatctctgggccgactgacgctgaggagcgaaagcgtggggagcgaacaggattagataccctggtagtccacgccgtaaacgttgggcactaggtgtgggcgcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatatacaggtggtgcatggctgtcgtcagctcgtgtcgtgagatgttgggttaagtcccgcaacgagcgcaacccttgtcctgtgttgccagcaattggggactcacgggagactgccggggtcaactcggaggaaggtggggacgacgtcaagtcatcatgccccttatgtcttgggctgcacacgtgctacaatggccggcaatgagctgcgatgccgtgaggtggagcgaatctcaaccggtctcagttcggatggggtctgcaactcgaccccagaagtcggagtcgctagtaatcgcagatcagcattgctgcggtgaatacgttcccgggccttgtacacaccgcccgtcacgtcacgaaagtcggtaacacccgaagccggtgcccagggaatcgtcgaaggtgggactggcgattgggacgaagtcgtaacaaggtagccg

SEQ ID NO: 2048 - DNA, 1533 bp, Streptomyces griseus
ttcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaagga

SEQ ID NO: 2049 - DNA, 1415 bp, Streptomyces sp.
tgcaagtcgacgatgaaccgctttcgggcggggattagtggcgaacgggtgagtaacacgtgggcaatctgccctgcactctgggacaagccctggaaacggggtctaataccggatactcactgccttgggcatccttggcggtggaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaatgcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgat

SEQ ID NO: 2050 - DNA, 1436 bp, Streptomyces sp.
  misc_feature (6)..(7): n is a, c, g, or t
  misc_feature (9)..(9): n is a, c, g, or t
  misc_feature (15)..(15): n is a, c, g, or t
  misc_feature (1300)..(1300): n is a, c, g, or t
atgaanncntttcgntgggggattagtggcgaacgggtgagtaacacgtgggcaatctgccctgcactctgggacaagccctggaaacggggtctaataccggatacgaccgcttcgggcatccgatggtggtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaactccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagtcgctagtaatcgcagatcaacattgctgcggtgaatacgttcccnggccttgtacacaccgcccgtcacgtcacgaaagtcggtaacacccgaaaccggtggcccaaccccttgtgggaaggagctgtccaaggtgggactggcgattgggacgaatcgtaacaaggtacctaccggaagg

SEQ ID NO: 2051 - DNA, 1447 bp, Streptomyces sp.
  misc_feature (23)..(23): n is a, c, g, or t
caagtgcaacgatgaaccacttnggtggggattagtggcgaacgggtgagtaacacgtgggcaatctgccctgcactctgggacaagccctggaaacggggtctaataccggatactgagcctcgcaggcatctgcggggttcgaaagctccggcggtgcaggatgagcccgcggcctatcagcttgttggtgaggtaacggctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtaccgtaccggaagg

SEQ ID NO: 2052 - DNA, 1405 bp, Streptomyces sp.
  misc_feature (1385)..(1385): n is a, c, g, or t
caagtcgaacgatgaacctccttcgggaggggattagtggcgaacgggtgagtaacacgtgggcaatctgccctgcactctgggacaagccctggaaacggggtctaataccggatacgacatcctcgggcatccgatggatgtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagctctggagacagagcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtggganggagctgtcgaagtgggact

SEQ ID NO: 2053 - DNA, 1441 bp, Streptomyces sp.
cgatgaacccacttcggtgggggattagtggcgaacgggtgagtaacacgtgggcaatctgccctgcactctgggacaagccctggaaacggggtctaataccggatacgaccactttaggcatctgatggtggtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcaccatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgttgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacacccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgttacaaggtagccgtaccggaagg

SEQ ID NO: 2054 - DNA, 1483 bp, Streptomyces thermoviolaceus
gacgaacgctggcggcgtgcttaacacatgcaagtcgaacgatgaagccccttcgggggtggattagtggcgaacgggtgagtaacacgtgggcaatctgccctgcactctgggacaagccctggaaacggggtctaataccggatacgacacagggaggcatctcctctgtgtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaactccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcagcattccacgttgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgc

SEQ ID NO: 2055 - DNA, 1428 bp, Subdoligranulum variabile
  misc_feature (1189)..(1189): n is a, c, g, or t
tgcaagtcgaacggagttatttcggttgaagttttcggatggatactggtttaacttagtggcgaacgggtgagtaacgcgtgagtaacctgccctggagtgggggacaacagttggaaacgactgctaataccgcataagcccacgatccggcatcggattgagggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgaatcttgacggtacctaacaagaaagcaccggctaactacgtgccagcagccgcggtaaaacgtagggtgcaagcgttgtccggaattactgggtgtaaagggagcgcaggcggaccggcaagttggaagtgaaatctatgggctcaacccataaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacaggattagataccctggtagtccatgccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagtgcagagatgcatgaagtccttcgggacatcgagacaggtggtgcatggttgtcgtcagctcgtgtcgtgagatgttgggttaagtcccgcaacgagcgcaacccttattgccagttactacgcaagaggactctggcgagactgccgttgacaaaacggaggaaggtggggatgacgtcaaatcatcatgccctttatgacctgggctacacacgtactacaatggcgtttaacaaagagangcaagaccgcgaggtggagcaaaactcaaaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccgggggggacccgaagtcggtaagtaagtctaaccgcaaggaggacgccgccgaaggtaaaactggtgattgggtg

SEQ ID NO: 2056 - DNA, 1514 bp, Succinatimonas hippei
tgaagagtttgatcatggctcagattgaacgctggcggcaggcttaatacatgcaagtcgaacggtaacatagcgaaagcttgcttttgctgatgacgagtggcggacgggtgagtagtatctgggaaactgccctgaagagggggacaacagctggaaacggctgctaataccgcataaaccctgcgggggaaaggaaggcaacttccgcttcaggatgtgcccagaagggattagctagtaggtgaggtaaaggctcacctaggcgacgatctctagccggtctgagaggatgaccggccacatcgggactgagacacggcccggactcctacgggaggcagcagtagggaatattgcacaatggggggaaccctgatgcagccatgccgcgtgtgtgaagaaggccttcgggttgtaaagcactttcagcggggaggaaattaagttagacgttacccgcagaagaagcaccggctaactccgtgccagcagccgcggtaatacggagggtgcgagcgttaatcggaataactgggcgtaaagggcacgcaggcgggctgataagtaaggtgtgaaataccggggctcaacctcggggctgcattttaaactgtcagtctagagtattgcagagggagacggaattccgggtgtagcggtgaaatgcgtagatatccggaagaacaccggaggcgaaggcggtcttctgggcaaatactgacgctcaggtgcgaaagcgtggggagcaaacaggattagataccctggtagtccacgccgtaaacgatgtcgattaggagattgagcagaagcttggttttcggagcaaacgcgctaaatcgaccgcctggggagtacggccgcaaggttaaaactcaaatgaattgacgggggcccgcacaagcggtggagcatgtggtttaattcgatgcaacgcgaagaaccttacctgaccttgacatctgaggaatgcctgagagatttaggcagtgccttcgggagcctcaagacaggtgctgcatggctgtcgtcagctcgtgtcgtgagatgttgggttaagtcccgcaacgagcgcaacccttgtcctttgttgccagcgcgtgatggcgggaactcaaaggagactgccggtgacaaaccggaggaaggcagggatgacgtcaagtcatcatggcccttacggtcagggctacacacgtgctacaatggggcgtacagagggaagcgaggccgtgaggcggagcggagcccacaaagcgtcccacagttcggattggagtctgcaactcgactccatgaaggcggaatcgctagtaatcgcaaatcagaatgttgcggtgaatacgttcccgggccttgtacacaccgcccgtcacaccatgggagtggattgcaccagaagtggcttgcctaacccgtaagggagggcggttaccacggtgtggtttatgactggggtgaagtcgtaacaaggtaaccctaggggaacctggggttggatcacctcctta

SEQ ID NO: 2057 - DNA, 1391 bp, Sutterella morbirenis
cacatgcaagtcgaacggcagcacgaggagcttgctccttggtggcgagtggcgcacgggtgagtaatatatcggaacgtgtcctattgtgggggataactagccgaaaggttagctaataccgcataagacctgagggtgaaagcgggggatcttcggacctcgcgcagttggagcggccgatagccgattagctagttggtagggtaatggcctaccaaggcaacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggaagaaaagtttagagcgaataactctgaatgctgacggtacctgaagaataagcaccggctaactacgtgccagcagccgcggtaatacgtagggtgcaagcgttaatcggaattactgggcgtaaagcgtgcgcaggcggttctgtaagatgggtgtgaaagccccgggctcaacctgggaattgcattcatgactgcaggactagagttcaccagaggggggtggaattccaagtgtagcagtgaaatgcgtagatatttggaagaacaccgatggcgaaggcagccccctggggtgcgactgacgctcatgcacgaaagcgtggggagcaaacaggattagataccctggtagtccacgccctaaacgatgtctactggttgttggggatttatatccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcgagaatcccgaagagatttgggagtgcccgcaagggaattcgaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggcagggatgacgtcaagtcctcatggcccttatggctagggcttcacacgtcatacaatggtcggaacagagggcagcgaagccgcgaggtggagccaatcccagaaaaccgatcgtagtccggattggagtctgcaactcgactccatgaagtcggaatcgctagtaatcgcggatcagcatgccgcggtgaatacgttcccgggtcttgtacacaccgcccgtcacaccatgggagtggggttcaccagaagacgttagtttaacc

SEQ ID NO: 2058 - DNA, 1489 bp, Sutterella parvirubra
attgaacgctggcggcatgctttacacatgcaagtcgaacggcagcacagggagcttgctcccgggtggcgagtggcgcacgggtgagtaagacatcggaacgtgtcctcttgtgggggataactacccgaaagggtggctaataccgcataagtcctgagggagaaagcgggggatcttcggacctcgcgcgagaggagcggccgatggccgattagctagttggtgaggtaaaggctcaccaaggcgacgatcggtagctggtctgagaggacgaccagccacactgggactgagacacggcccagactcctacgggaggcagcagtggggaattttggacaatgggcgaaagcctgatccagccatgccgcgtgtgggatgaaggccttcgggttgtaaaccacttttgtcagggacgaaaaggttcaggcyaataccttgaactgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggcttaaccttggaattgcatttatgactgcaggactcgagtttgtcagaggggggtggaattccaagtgtagcagtgaaatgcgtagatatttggaagaacaccgatggcgaaggcagccccctgggacatgactgacgctcatgcacgaaagcgtggggagcaaacaggattagataccctggtagtccacgccctaaacgatgtctactggttgttggggacgatttggtccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcggaaagctctgagagatcggagygtgcccgcaagggaatccgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgcaaggaggacggcgtccacggtgggtttcatgactggggtgaagtcgtaacaaggtagccgtaccggaagg

SEQ ID NO: 2059 - DNA, 1457 bp, Sutterella sanguinus
attgaacgctggcggcatgctttacacatgcaagtcgaacggcagcacgaggagcttgctccttggtggcgagtggcgcacgggtgagtaatatatcggaacgtgtcctattgtgggggataactagccgaaaggttagctaataccgcataagacctgagggtgaaagcgggggatcttcggacctcgcgcagttggagcggccgatagccgattagctagttggtagggtaatggcctaccaaggcaacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggaagaaaagtttagagcgaataactctgaatgctgacggtacctgaagaataagcaccggctaactacgtgccagcagccgcggtaatacgtagggtgcaagcgttaatcggaattactgggcgtaaagcgtgcgcaggcggttctgtaagatgggtgtgaaagccccgggctcaacctgggaattgcattcatgactgcaggactagagttcaccagaggggggtggaattccaagtgtagcagtgaaatgcgtagatatttggaagaacaccgatggcgaaggcagccccctggggtgcgactgacgctcatgcacgaaagcgtggggagcaaacaggattagataccctggtagtccacgccctaaacgatgtctactggttgttggggatttatatccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcgagaatcccgaagagatttgggagtgcccgcaagggaattcgaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggcagggatgacgtcaagtcctcatggcccttatggctagggcttcacacgtcatacaatggtcggaacagagggcagcgaagccgcgaggtggagccaatcccagaaaaccgatcgtagtccggattggagtctgcaactcgactccatgaagtcggaatcgctagtaatcgcggatcagcatgccgcggtgaatacgttcccgggtcttgtacacaccgcccgtcacaccatgggagtggggttcaccagaagacgttagtttaaccgcaaggaggacgacgtccacggtgggcttcatgactggggtg

SEQ ID NO: 2060 - DNA, 1320 bp, Sutterella sp.
attgaacgctggcggcatgccttacacatgcaagtcgaacgagtggcgaacgggtgagtaatacatcggaacgtgtccgtttgtgggggacaaccagccgaaaggttggctaataccgcataaggaaaggcgcagacggagcggccgatgattgattagcttgttggcggggtaaaggcccaccaaggcgacgatcaatagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgatgacggtacctgaagaataagcaccggctaactacgtgccagcagccgcggtaatacgtagggtgcaagcgttaatcggaattactgggcgtaaagcgtgcgcaggcggttgggtaagacagatgtgaaatccccgggcttaacctgggaactgcatttgtgactgtccgactggagtacgtcagaggggggtggaattccgcgtgtagcagtgaaatgcgtagatatgcggaagaacaccgatggcgaaggcagccccctgggacgactgacgctcatgcacgaaagcgtggggagcaaacaggattagataccctggtagtccacgccctaaacgatgtctgccggttgttggggcttcagtaacgaagctaacgcgtgaagcagaccgcctggggagtacggtcgcaagattaaaactcaaaggaattgacggggacccgcacaagcggtggatgatgtggattaattcgatgcaacgcgaaaaaccttacctagccttgacatgcacaggtgctgcatggctgtcgtcagctcgtgtcgtgagatgttgggttaagtcccgcaacgagcgcaacccttgtcatcagttgctacggcactctgatgagactgccggtgacaaaccggaggaaggtggggatgacgtcaagtcctcatggcccttatggctagggcctcacacgtcatacaatggtcggcagagggcagcgaagccgcgaggtgaagccaatcccagccgatcgtagtccggatgcagtctgcaactcgactgcagaagtcggaatcgctagtaatcgcggatcagcatgccgcggtgaatacgttcccgggtcttgtacacaccgcccgtcacaccatgggagtggggttcaccagaaggcgttgcccaaggcggcgcccacggtgggtttcatgactggggtgaagtcgtaacaaggtagtcgtaccggaagg

SEQ ID NO: 2061 - DNA, 1455 bp, Sutterella stercoricanis
ggcggcatgctttacacatgcaagtcgaacggcagcacagggagcttgctcctgggtggcgagtggcgcacgggtgagtaatacatcggaacgtgtcctattgtgggggataactgtcggaaagggtggctaataccgcataagacctgagggtgaaagcgggggatcgcaagacctcgcgcaattggagcggccgatgcccgattagctagttggtgaggtaatagcttaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaaggattgtgctaataccatgatctgctgacggtacctgaagaataagcaccggctaactacgtgccagcagccgcggtaatacgtagggtgcaagcgttaatcggaattactgggcgtaaagcgtgcgcaggcggttctgtaagacagatgtgaaatccccgggctcaacctgggaattgcatttgtgactgcaggactagagttcatcagaggggggtggaattccaagtgtagcagtgaaatgcgtagatatttggaagaacaccaatggcgaaggcagccccctgggatgcgactgacgctcatgcacgaaagcgtggggagcaaacaggattagataccctggtagtccacgccctaaacgatgtctactggttgttggggattaatatccttggtaacgaagctaacgcgtgaagtagaccccctggggagagcggtcgcaagattaaaactcaaaggaattgacggggacccgcacaagcggtggatgatgtggattaattcgatgcaacgcgaaaaaccttacgtagccttgacatgccaggaatcctgaagagatttgggagtgcccgcaagggaatctggacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatggctagggcctcacacgtcatacaatggtcggaacagagggcagcgaagccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtctaaccgtaaggaaggacggcgtccacggtgggtttcatgactggggtgaagtcgt

SEQ ID NO: 2062 - DNA, 1537 bp, Sutterella wadsworthensis
ttgaactaaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgcattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggtctgagagatcaggccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggtgaagtcgtaacaaggtagccgtaccggaaggtgcggctggatcacctccttt

SEQ ID NO: 2063 - DNA, 1328 bp, Synergistes genomosp.
gacgaacgctggcggcgtgcttaacacatgcaagttgagcgagcagcggacgggtgagtaaagcacaaggacttgtccgaaagagagggacacctgcgggaaaccggagctaatacctaataaaaaaggcgcttttggagagacttgtgtcctatcaggcagttggtgaggtaacggctcaccaaaccgaagacgggtagccggactgagaggtcgaccggccacattggaactgagagacggtccagactcctacgggaggcagcagtggggaatattgggcaatgggcgcaagcctgacccagcgacgccgcgtgagggaagacagccttcgggttgtaaacctctgttgcaggggaagatgacggtaccctgcgaggaagctccggctaactacgtgccagcagccgcggtaatacgtagggagcgagcgttgtccggaattactgggcgtaaagggcgcgtaggcggcgcttcaagtcgtctgtcaaaagccgaggctcaacctcggtgcgcagacgaaactggagagcttgagaagcagagaggcaaacagaattcctggtgtagcggtgaaatgcgtagatatcaggaagaataccagtggcgaaggcggtttgctggctgctctaacgctgaagcgcgaaagccaggggagcaaacgggattagataccccggtagtcctggcagtaaacgatgtatgctgggtgtgggacgttccgtgccgaagttgacgcgataagcataccgcctggggagtacggtcgcaagattgaaactcaaaggaattgacgggggcccgcacaagcggtggagcacgtggtttaattcgatgcaaaccgaagaaccttacctggacttgacatcaacaggtgctgcatggctgtcgtcagctcgtgtcgtgagatgttgggttaagtcccgcaacgagcgcaacccctattgccggttgctaccagctgagcactccggcgagactgccatcgacaagatggaggaaggtggggacgacgtcaagtcatcatggcccatatgtccagggcgacacacatgctacaatggatggcagagagaagcgagaccgaaaggagaagcagatcccaaccatccccagttcggatgcagtctgcaactcgactgcagaagttggaatcgctagtaatcgcggatcagccaagccgcggtgaatacgttcccgggccttgtacacaccgcccgtcacaccatccgagtcgggtgctctcaaagccggagcctaaggatccgcctaaagagtgtccggtgaggggggtgaagtcgtaacaaggtagccgtacgggaacgtgc

SEQ ID NO: 2064 - DNA, 1412 bp, Synergistes sp.
tggcgaacgaagacctagaggagcttgctttaatatggttttagtggcggacgggtgagtaacgcgtgaggacttgtcgagtacagggggacaacaggtggaaacgtctgctaataccccataagccttcgggtaaaaggagcgatccggtacacgagagacttgtgtcctatcagctagtaggtggggtaacgagcccacccaggccaagacggatagccggactgagaggtcgatcggccacactggaactgagacacggtccagactcctacgggaggcagcagtggggaatattgggcaatgggggcaaccctgacccagcgacgccgcgtgagkgaagamakccytcgggwtgtaaamctctgttgcwgtgggaagataggacgtgacggtaccactrcgaggaagccccggcaaactacgtgccagcagccgcggtaatacgtagggagcgagcgttatccggaattactgggcgtaaagcggcgcgtaggctggtgttcaagtcgttcgttaaatattgaggcttaacctcaaggagctggccgaaactgagacactggagacacagagaggcaaacagaattcctggtgtagcggtgaaatgcgtagatatcaggaagaataccggtggcgaaggcggtttgcttggatgtgatctgacgcttgaagcgcgaaagccgggggagcgaacgggattagataccccggtagtcccggcagtaaactgatgtatgctgggtgtggccgtagcgatacagccgtgccgaagttaacgcgataagcataccgcctggggagtactggtcgcaagattgaaactcaaaggaattgacgggggcccgcacaagcggtggagcacgtggtttaattcgatgcaaaccgaagaaccttacctggacttgacatacacgtagtagcgaatcgaaagaggagcgaggatgtagcaatacattcagcgtgaacaggtgctgcatggcttgtcgtcagctcgtgtcgtgagatgttgggttaagtcccgcaacgagcgcaaccccttgttgccggttgctaacgcgcaaaggcgagcactccggcgagactgccatcgacaagatggaggaaggtggggacgacgtcaagtcatcatggcccttatgtccagggcgacacacatgctacaatggctggtacagagagaagcgaagccgagaggccgagcagatcccatcaaagccagtcccagttcggattgcagtctgcaactcgactgcatgaagttggaatcgctagtaatcgcggatcagccaagccgcggtgaatacgttcccgggccttgtacacaccgcccgtcacaccatccgagttgggtgctctcgaagtcggaggcttaaccgcaaggaaaagatccgcctaaagagtgtccggtg

SEQ ID NO: 2065 - DNA, 1432 bp, Synergistetes bacterium
gaagcgacgctggcggcgtgcctaacacatgcaagttgagcggagagttttcgaagaagacttcggttggaattggaaacgatcagcagcggacgggtgagtaaagcacaaggacgtatccttttgagggggacaactgcgggaaaccggagctaatagcccataagccgagaggtgaaagcgcgcaagcgcgcaagaggagcgacttgtgtcctatcaggcagttggtgaggtaagagctcaccaaaccgaagacgggtagccggactgagaggttgtacggccacattggaactgagagacggtccagactcctacgggaggcagcagtggggaatattgggcaatgggggcaaccctgacccagcgacgccgcgtgagggaagacagccttcgggttgtaaacctctgttgcaggggaagaaggacgtgacggtaccctgcgaggaagctccggctaactacgtgccagcagccgcggtaatacgtagggagcgagcgttatccggaattactgggcgtaaagggcgcgtaggcggtgtttcaagtcgttcgttaaatattgaggcttaacctcaaggagcggccgaaactgagacactggagacacagagaggcaaacagaattcctggtgtagcggtgaaatgcgtagatatcaggaagaataccggtggcgaaggcggtttgctggatgtgatctgacgctgaagcgcgaaagccgggggagcgaacgggattagataccccggtagtcccggcagtaaacgatgtatgctgggtgtggccgtagcgatacagccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctggacttgacatacacgtagtagcgaatcgaaagaggagcgaggatgtatcaatgcattcagcgtgaacaggtgctgcatggctgtcgtcagctcgtgtcgtgagatgttgggttaagtcccgcaacgagcgcaacccctgttgccggttgctaacgcgcaaaggcgagcactccggcgagactgccatcgacaagatggaggaaggtggggacgacgtcaagtcatcatggcccctatgtccagggcgacacacatgctacaatggctggtacagagagaagcgaagccgagaggccgagcagatcccatcaaagccagtcccagttcggattgcagtctgcaactcgactgcatgaagttggaatcgctagtaatcgcggatcagccaagccgcggtgaatacgttcccgggccttgtacacaccgcccgtcacaccatccgagttgggtgctctcgaagtcggaggcttaaccgcaaggaaagatccgcctaaag

SEQ ID NO: 2066 - DNA, 1447 bp, Synergistetes bacterium
cccggacgacgctggcggcgtgcctaacacatgcaagtcgaacgaaattacgaagaaagcttgctttaatcgtaatttagtggcggacgggtgagtaacgcgtgaggacttgtcggatacagggggacaacagatggaaacgtctgctaataccccataagccttcgggtaaaaggagcaatccggtatttgagagactcgcgttctatcagctagtaggtggggtaacggcccacctaggccaagacggatagccggactgagaggtcgaccggccacactggaactgagagacggtccagactcctacgggaggcagcagtggggaatattgggcaatgggggcaaccctgacccagcgacgccgcgtgggtgaagaaatccttcgggatgtaaagccctgttgtgtgggaagataatgacggtaccacacgaggaagccccggcaaactacgtgccagcagccgcggtaatacgtagggggcaagcgttgttcggaattactgggcgtaaagcgcacgcaggctgaccgttaagtctgtcgtcaaaggcggaggctcaacctccgttctacgatagatactgtcggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatacaagtggtactgagatgaaagttgagggactgtagcttgctacagagcttgaacaggtgctgcatggctgtcgtcagctcgtgtcgtgagatgttgggttaagtcccgcaacgagcgcaacccctatgtccagttgctaacaagtgaagttgagcactctggagagactgccgccgacaaggcggaggaaggtggggatgacgtcaagtcatcatggcctttatgcccagggcgacacacgtgctacaatggccggcacagaaggcagcttgctagtgatagttggcgaatccttaaaagccggtcccagttcggattgtagtctgcaacccgactacatgaagccggaatcgctagtaatcgcagatcagccaagctgcggtgaatacgttcccgggccttgtacacaccgcccgtcacaccacccgagttgggggcacccgatagccgcaggctataaccgcagtaagggaaagaagcgtctaaggtgcgcgcgagtaacagcatctc

SEQ ID NO: 2067 - DNA, 1474 bp, Synergistetes bacterium
gacgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataatagcagttattgcatgataactgtttgaaaggtgcaaatgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgggagacttgagtgcagaagaggagagcggaattccatgtgtagcggtgaaatgcgtagatatatggaggaacaccagtggcgaaggcggctctctggtctgtaactgacgccgaggctcgaaagcgtggggagcaaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcctcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggact

SEQ ID NO: 2068 - DNA, 1453 bp, Synergistetes bacterium
gatgaacgctggcggcgtgcgtaacacatgcaagttggacgacgatgccatgaagtggtaacacggaatggtatacggagtagcggacgggtgagtaaaacatgaggagctgtcctgttgagggggataacgttcggaaacggaccctaataccccataggccgagaggttaaaggcagagatgcgcgacaggaggcactcgtgtcctatcagctggttggtgaggtaacggctcaccaaggcgacgacgggtagccggcctgagagggtgaccggccacactggaactgagacacggtccagactcctacgggaggcagcagtggggaatattgggcaatgggaggaatcctgacccagcgacgccgcgtgaacgaagacggccttcgggttgtaaagttcttttatgtgggaagaatgaagtgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcagttgagactgaggtgctggaataccggagaggcaagtggaattcccagtgtagcggtgaaatgcgtagatattgggaagaacatcggtggcgaaggcgacttgctggacggtaactgacgctgaggtgcgaaagccagggtagcgaacgggattagataccccggtagtcctggccgtaaacgatgaatgctaggtgtgcgagcagagatgttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgtatgtggtaggagatggaaacattgacgacgctgctttcgggcagtgagcatacacaggtgctgcatggctgtcgtcagctcgtgtcgtgagatgttgggttaagtcccgcaacgagcgcaacccctgcgattagttgccagcgagttaagtcgggcactctaatgggactgccatcgacaagatggaggaaggtggggatgacgtcaagtcatcatggcccttatgtccagggcgacacacgtgctacaatggccggtacagagggaagcgaggctgtgaggttgagcggatcccataaagccggtctcagtccggattgaagtctgcaattcgacttcatgaagctggaatcgctagtaatcgcagatcagccaagctgcggtgaatacgttcccgggccttgtacacaccgcccgtcacaccacccgagccgggtgtacccgaagccggtggcctaaccttatgggaggagccgtcgaaggtgtgtctggtgaggagggtgaagtcgtaa

SEQ ID NO: 2069 - DNA, 1337 bp, Synergistetes bacterium
gatgaacgctggcggcgtgcgtaacacatgcaagttgaacgacggtgccatgaagtggtaacacggagtggtatacggagtagcggacgggtgagtaaagcatgagaatctgtcctgtcgagggggatagcgttcggaaacggaccctaataccccatagtccgagaggttaaaggcagcgatgcgcggcaggaggagctcgtgtcctatcagctggttggtgaggtaacggctcaccaaggcaacgacgggtagccggcctgagagggtgaccggccacactggaactgagaaacggtccagactcctacgggaggcagcagtggggaatattgggcaatgggaggaatcctgacccagcgacgccgcgtgaacgaagacggccttcgggttgtaaagttcttttatgtgggaagaaggaagtgacggtaccacatgaataagccccggctaactacgtgccagcagccgcggtaatacgtagggggcgagcgttgtccggaattactgggcgtaaagggcacgcaggctgtgcttcaagtcagctgtaaaaggatgcggcttaaccgtgttatgcggctgagactgaggtgctggagtaccggagaggcaagtggaattcccagtgtagcggtgaaatgcgtagatattgggaagaacatcggtggcgaaggcgacttgctggacggtaactgacgctgaggtgcgaaagccagggtagcgaacgggattagataccccggtagtcctggccgtaaacgatgaatgctaggtgtgcgagcagagatgttggtgtgccgcagttaacgcgataagcattccgcctggggagtacggtcgcaagattgaaactcaaaggaattgacgggggcccgcacaagcggtggagcatgtggtttaattcgatggtacgcgaggaaccttacctgggtttgacatagtatctgatgccgtagagatacggcagcgtagcaatacgaggtacaacgggtgctgcatggctgtcgtcagctcgtgtcgtgagatgttaggttaagtcctgcaacgagcgcaaccctcgtcgtatattgccagcggttcggccgggcactctggcaggactgccatcgacaagattggaggaaggtggggatgacgtcagtcatcatggcccatatgtccagggcgacacacgtgctacaatgggcggtacagagggaagcgacactgcgaggtgaagcggatcccattaaagccgctctcagttcggattgaagtctgcaattcgacttcatgaagttggaatcgctagtaatcgcagatcagccaagctgcggtgaatccgttcccgggccttg

SEQ ID NO: 2070 - DNA, 1535 bp, Syntrophococcus sucromutans
agagtttgatcatggctcaggatgaacgctggcggcgtgcttaacacatgcaagtcgagcgaagcacttttgatttcttcggattgaaggagtgactgagcggcggacgggtgagtaacgcgtggggaacctgccccataccgggggataacagttggaaacgactgctaataccgcataagcgcacaggaaggcatcttccagtgtgaaaaactccggtggtatgggatggacccgcgttggattagccagttggtggggtaacggcctaccaaagcgacgatccatagccggcctgagagggcgaccggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaagacgacggtacctgactaagaagccccggctaactacgtgccagcagccgcggtaatacgtagggggcaagcgttatccggatttactgggtgtaaagggagcgcagacggcagtgcaagtctgaagtgaaaacccgaggctcaaccacgggattgctttggaaactgtacagctagagtgtcggaggggtaagcggaattcctagtgtagcggtgaaatgcgtagatattaggaggaacaccggtggcgaaggcggcttactggacgataactgacgttgaggctcgaaagcgtggggagcaaacaggattagataccctggtagtccacgcggtaaacgatgaatactaggtgttggcacgcaaggcgtgtcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccggccggtaacgcggcccttccttcgggacaggcgagacaggtggtgcatggttgtcgtcagctcgtgtcgtgagatgttgggttaagtcccgcaacgagcgcaacccttatcctcagtagccagcacgaaaggtgggcactctggggagactgccagggagaacctggaggaaggtggggatgacgtcaaatcatcatgccccttatgatttgggctacacacgtgctacaatggcgtgaacagagggaagcgaaggggcgatccggagcaaatctcaaaaaacacgtcccagttcggactgcaggctgcaacccgcctgcacgaagctggaatcgctagtaatcgcagatcagaatgctgcggtgaatatgttcccgggtcttgtacacaccgcccgtcacaccatgggagtcggtaatgcccgaagcctgtgacccaaccagcaatggagggagcagtcgaaggcagggccggtgactggggtgaagtcgtaacaaggtagccgtatcggaaggtgcggctggatcacctccttaagcttggtacccggg

SEQ ID NO: 2071 - DNA, 1295 bp, Syntrophomonadaceae genomosp.
acgaacgctggcggcgtgcttaacacatgcaagtcgaacgagtggcgaacgggtgagtaacgcatgagtaatctgcccataagcgggggataccaaatggaaacatttgctaataccgcatacggaaagccacttatggatgagctcgcgtctgattagctggttggcagggtaaaggcctaccaaggcaacgatcagtagccggcctgagagggtgaccggccacactgggactgagacacggcccagactcctacgggaggcagcagtggggaatattgcgcaatgggggaaaccctgacgcagcgacgccgcgtgagcgaagaaggccttagggttgtaaagctctgttttaagggacgaagacggtaccttaagaggaagccccggctaactacgtgccagcagccgcggtaagacgtagggggcgagcgttgtccggaatcactgggtgtaaagggcacgcaggcgggtgtttaagtcattcgtgaaataccgcagcttaactgcggggttgcgagtgaaactggaaatcttgagggcaagagaggacagtagaattcctggtgtagcggtgaaatgcgtagaaatcaggaggaataccggtggcgaaggcgactgtctggattgcctgacgctgaggtgcgaaagcgtgggtagcaaacaggattagataccctggtagtctacgctgtaaacgatggatactaggtgtaggagcttctgtgccggagcaaacgcaataagtatcccacctggggagtacgatcgcaaggttgaaactcaaaggaattgacgggggcccgcacaagcggtgagcatgtggtttaattcgatgcaacgcgaagaaccttaccaggtcttaacatcgacaggtggtgcatggttgtcgtcagctcgtgtcgtgagatgttgggttaagtcccgcaacgagcgcaacccctgccattagttactaacaattgaggactctaatgggaccgcctgtgacaagcaggaggaaggtggggatgacgtcaaatcatcatgccctttatgatctgggctacacacgtgctacaatggatggcaaagagcagcaaagcagcgatgccgagccaatctcatccattcccagttcggatggagtctgcaactcgacttcagaagcaggaatcgctagtaatcgtggatcagcatgccacggtgaatgcgttcccgggccttgtacacaccgcccgtcacaccacgaaagtcggcaacacccgaagccggtagctaggcagccgttgaaggtggggttggtgattggggtg

SEQ ID NO: 2072 - DNA, 1451 bp, Tannerella forsythia
agcgataggcttaacacatgcaagtcgaggggcatcgagggtagcaatacctgtcggcgaccggcgcacgggtgagtaacgcgtatgtaacctgcccgcaacagagggataacccggcgaaagtcggactaatacctcataaaacaggggttccgcatggggctatttgttaaagatttattggttgcggatgggcatgcgtaccattaggtagttggtgaggtaacggctcaccaagccatcgatggttaggggttctgagaggaaggtcccccacactggtactgagacacggaccagactcctacgggaggcagcagtgaggaatattggtcaatgggcgagagcctgaaccagccaagtcgcgtgaaggatgactgccctatgggttgtaaacttcttttacaggggaataaaatgagatacgtgtattttattgcatgtaccttgtgaataagcatcggctaactccgtgccagcagccgcggtaatacggaggatgcgagcgttatccggatttattgggtttaaagggtgcgtaggtgggctgttaagtccgcggtgaaagtttgtcgcttaacgataaaattgccgttgaaactggtagtcttgagtatagatgaagtaggcggaatgcgtggtgtagcggtgaaatgcatagagatcacgcagaactccgattgcgaaggcagcttactaaggtataactgacactgaagcacgaaagcgtgggtatcaaacaggattagataccctggtagtccacgcagtaaacgatgattactaggagtttgcgatatagtgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggattgaaatgtagacgacggagagtgagagctttcttcccttcggggcgtctatgtaggtgctgcatggttgtcgtcagctcgtgccgtgaggtgtcggcttaagtgccataacgagcgcaaccctgactgtcagttgctaacaggtaaagctgaggactctggcgggactgccggcgtaagctgtgaggaaggttgggatgacgtcaaatcagcacggcccttacatccggggcgacacacgtgttacaatggcagggacaaagggcagctaccgggcgaccggatgccaatctccaaaccctgtctcagttcggatcggagtctgcaactcgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaagg

SEQ ID NO: 2073 - DNA, 1517 bp, Tannerella sp.
agagtttgatcctggctcaggatgaacgctagcgacaggcctaacacatgcaagtcgaggggcaacatggtatcagcttgctgataccgatggcgaccggcgcacgggtgagtaacgcgtatgtaatctacctgtaacagagggataacccggagaaatccggactaatacctcatagcacatattattcgcatgaattttatgttaaagagactcggttacagatgaacatgcgttccattagctggttggcggggtcacggcccaccaaggcaacgatggataggggttctgagaggaaggtcccccacactggtactgagacacggaccagactcctacgggaggcagcagtgaggaatattggtcaatgggcgaagcctgaaccagccaagtcgcgtggaggaagacggccctacgggttgtaaactccttttacctgggaataacgggcgctacgtgtagcgctgtgcatgtaccgggagaataagcatcggctaattccgtgccagcagccgcggtaatacggaagatgcgagcgttatccggatttattgggtttaaagggtgcgtaggcggaaggataagtcagcggtgaaatgcttcagctcaactggagaattgccgatgaaactgtttttctagagtataaaagaggtatgcggaatgcgtggtgtagcggtgaaatgcatagatatcacgcagaaccccgattgcgaaggcagcatactgggctataactgacgctgaagcacgaaagcgtgggtatcgaacaggattagataccctggtagtccacgccgtaaacgatgaatactaactgtttgcgatataatgtaagcggtacagcgaaagcgttaagtattccacctggggagtacgccggcaacggtgaaactcaaaggaattgacgggggcccgcacaagcggaggaacatgtggtttaattcgatgatacgcgaggaaccttacccgggctcaaacgacaggggaataatcccgaaaaggattagccagcaatggccgctgtcgaggtgctgcatggttgtcgtcagctcgtgccgtgaggtgtcggcttaagtgccataacgagcgcaacccttaccggtagttactaacaggtcaagctgaggactctaccgggactgccagcgcaagctgtgaggaaggtggggatgacgtcaaatcagcacggcccttacgtccggggcgacacacgtgttacaatggcaggtacagagagtcgcggcgtagcaatacgtagccaatcccgaaaaacctgtctcagttcggatcggagtctgcaacccgactccgtgaagctggattcgctagtaatcgcgcatcagccatggcgcggtgaatacgttcccgggccttgtacacaccgcccgtcaagccatgggagccgggagtacctgaagtatgcaaccgcaaggagcgtcctagggtaatactggtgactggggctaagtcgtaacaaggtagccgtaccggaaggtgcggctggaacacct

SEQ ID NO: 2074 - DNA, 1474 bp, Tatlockia micdadei
  misc_feature (5)..(5): n is a, c, g, or t
  misc_feature (12)..(14): n is a, c, g, or t
  misc_feature (29)..(30): n is a, c, g, or t
  misc_feature (37)..(37): n is a, c, g, or t
  misc_feature (48)..(48): n is a, c, g, or t
  misc_feature (80)..(80): n is a, c, g, or t
  misc_feature (82)..(88): n is a, c, g, or t
  misc_feature (117)..(117): n is a, c, g, or t
  misc_feature (130)..(130): n is a, c, g, or t
  misc_feature (136)..(137): n is a, c, g, or t
  misc_feature (163)..(163): n is a, c, g, or t
  misc_feature (169)..(169): n is a, c, g, or t
  misc_feature (176)..(176): n is a, c, g, or t
  misc_feature (179)..(179): n is a, c, g, or t
  misc_feature (222)..(224): n is a, c, g, or t
  misc_feature (229)..(229): n is a, c, g, or t
  misc_feature (249)..(249): n is a, c, g, or t
  misc_feature (304)..(304): n is a, c, g, or t
  misc_feature (335)..(335): n is a, c, g, or t
  misc_feature (420)..(420): n is a, c, g, or t
  misc_feature (426)..(426): n is a, c, g, or t
  misc_feature (452)..(452): n is a, c, g, or t
  misc_feature (479)..(479): n is a, c, g, or t
  misc_feature (508)..(508): n is a, c, g, or t
  misc_feature (552)..(552): n is a, c, g, or t
  misc_feature (571)..(571): n is a, c, g, or t
  misc_feature (589)..(591): n is a, c, g, or t
  misc_feature (598)..(598): n is a, c, g, or t
  misc_feature (625)..(625): n is a, c, g, or t
  misc_feature (652)..(653): n is a, c, g, or t
  misc_feature (828)..(828): n is a, c, g, or t
  misc_feature (886)..(886): n is a, c, g, or t
  misc_feature (945)..(945): n is a, c, g, or t
  misc_feature (957)..(959): n is a, c, g, or t
  misc_feature (983)..(983): n is a, c, g, or t
  misc_feature (993)..(993): n is a, c, g, or t
  misc_feature (1042)..(1042): n is a, c, g, or t
  misc_feature (1092)..(1092): n is a, c, g, or t
  misc_feature (1117)..(1117): n is a, c, g, or t
  misc_feature (1213)..(1213): n is a, c, g, or t
  misc_feature (1276)..(1276): n is a, c, g, or t
  misc_feature (1287)..(1287): n is a, c, g, or t
  misc_feature (1296)..(1296): n is a, c, g, or t
  misc_feature (1302)..(1302): n is a, c, g, or t
aactnaagagtnnnatcctggctcagatnnaacgctngcggcatgctnaacacatgcaagtcgaacggcagcacggtctngnnnnnnnatgggtgacgagtggcgaacgggtgagtnacgcgtaggaatntgcctnnaagtgtgggataacttggggaaactnaagctnataccgnatnagctctaaggaggaaagctggggaccgcgaggcctgcgcgctnnnagatnagcctgcgtccgattagctngttggtgggggaagggcctaccaaggcgacgatcggtagctggtctgagaggatnatcagccacactgggactgagacacggcccngtctcctacgggaggcagcagtggggaatattggacaatggggggaaccctratccagcaatgccgcgtgtgtgaagaaggcctnagggtngtaaagcactttcagtggggaggagngrtgataggttaagagctaattatctngacgttacccacagaagaagcaccggctnactccgtgccagcagccgcggtaatacggagggtgcgagcgttnatcggaattactgggcgtnaagggtgcgtaggtggtnnnataagtnatctgtgaaattcctgggctcaacctngggtggtcagataagactgtgagactnngagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactngttgttggccttatgaatgaggttagtgacgaagcaaacgcgataagttgaccgcctngggagtacggtcgcaagatyaaaactcaaaggaattgacgggggcccgcacaagcggtngagcatgtggtnnnattcgatgcaacgcgaagaacctnacctaccctngacatacagtgaattctgcagagatgtggaagtgccgcgaggagcactnatacaggtgctgcatggctgtcgtcagctcgtgtcgtgagatgttgggtnaagtcccgtaacgagcgcaaccctngtycttagttgccagcgcgtagatggyggggactctaaggagactgccggtgacaaaccggaggaaggcggggatgacgtcaagtcatcatggccnttacgggtagggctacacacgtgctacaatggccggtacagagggcggcgaaggggagacctngagcaaatctntgaaagctngtcgtngtccggattgaagtctgcaactcgactkcatgaagtcggaatcgctagtaatcgcgaatcagcatgtcgcggtgaatacgttcccgggccttgtacacaccgcccgtcacaccatgggagtgggttgcaccagaagtagatagtctaaccaatgggggacgtataccacggt

SEQ ID NO: 2075 - DNA, 1480 bp, Tatumella ptyseos
ggcggcaggcctaacacatgcaagtcgaacggtagcacagaggagcttgctccttgggtgacgagtggcggacgggtgagtaatgtctgggaaactgcctgatggagggggataactactggaaacggtagctaataccgcataatgtcgcaagaccaaagcgggggaccttcgggcctcgcaccatcggatgtgcccagatgggattagcttgtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtcgtgttaatagcacgattgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcagactagagtcttctagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggattggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaaccgtagggg

SEQ ID NO: 2076 - DNA, 1479 bp, Tessaracoccus sp.
agagtttgatcctggctcaggacgaacgctggcggcgtgcttaacacatgcaagtcgaacggtaaggccctttcgggggtacacgagtggcgaacgggtgagtaacacgtgagtaacctgcccttgactctgggataacatctggaaacaggtgctaatactggatattctgcgatgcctgcatgggtgtcgttggaaagttccggcggtcagggatggactcgcggcctatcagcttgttggtgaggtagtggctcaccaaggcttcgacgggtagccggactgagaggttgaccggccacattgggactgagatacggcccaaactcctacgggaggcagcagtggggaatattgcacaatggacggaagtctgatgcagcaacgccgcgtgcgggatgacggccttcgggttgtaaaccgctttcatccatgacgaagcgagagtgacggtagtgggagaagaagcaccggctaactacgtgccagcagccgcggtgatacgtagggtgcgagcgttgtccggatttattgggcgtaaagagcttgtaggcggtttgttgcgtcgggagtgaaaactcagggcttaaccctgagcctgctttcgatacgggcagacttgaggaaggtaggggagaatggaattcctggtgaagcggtggaatgcgtagatatcaggaggaacaccagtggcgaaggcggttctctggacctttcctgatgctgagaagcgaaagcgtggggagcaaacaggcttagataccctggtagtccacgccgtaaacggtgggtactaggtgtgggggacattccacgttctccgtgccgcagctaacgcattaagtaccccgcctggggagtacggccgcaaggctaaaactcaaaggaattgacggggccccgcacaagcggcggagcatgcggattaattcgatgcaacgcggagaaccttacctgggtttgacatatgccggaaacatctagagataggtgcccctttttggtcggtataccggtggtgcatggctgtcgtcagctcgtgtcgtgagatgttgggttaagtcccgcaacgagcgcaaccctcgtcctatgttgccagcgggtaatgccggggactcataggagaccgccggggtcaactcggaggaaggtggggatgacgtcaagtcatcatgccccttatgtccagggcttcacgcatgctacaatggccggtacaaagagctgcgaacctgtgagggtgagcgaatctcaaaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaaccccttgtgggagggagctgtcgaaggtgggaccggtaattaggactaagtcgtaacaaggt

SEQ ID NO: 2077 - DNA, 1562 bp, Tetragenococcus halophilus
tcaagatgagagtttgatcctggctcaggacgaacgctggcggcgtgcctaatacatgcaagtcgaacgctgcttaagaagaaacttcggttttttcttaagtggagtggcggacgggtgagtaacacgtggggaacctatccatcagcgggggataacacttggaaacaggtgctaataccgcatacggctttttttcacctgaaagaaagctcaaaggcgctttacagcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagcaaagaacaggagaaagaggaaatgctttttccatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccagctcaactggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgccctagagatagggtttccccttcgggggcaaagtgacaggtggtgcatggttgtcgtcagctcgtgtcgtgagatgttgggttaagtcccgtaacgagcgcaacccttattgttagttgccagcattgagttgggcactctagcaagactgccggtgacaaaccggaggaaggcggggatgacgtcaaatcatcatgccccttatgacctgggctacacacgtgctacaatgggaagtacaacgagcaagccaagccgcaaggcctagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtcggtgcggcaacccttaggggagccagccgcctaaggtgggacgaatgattggggtgaagtcgtaacaaggtagccgtatcggaaggtgcggctggatcacctcctttct

SEQ ID NO: 2078 - DNA, 1492 bp, Tetragenococcus koreensis
ctcaggacgaacgctggcggcgtgcctaatacatgcaagtcgaacgctgcttcgatcgaaacttcggtttcttttgaagcggagtggcggacgggtgagtaacacgtggggaacctatccatcagcgggggataacacttggaaacaggtgctaataccgcataaggctttctttcgcctgaaagaaagctaaaaggcgctttttgcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtcagtaaagaacaggaaaaagaggcaatgctttttctatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccggctcaaccggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacgcgagagatcgcgtttccccttcgggggcaaagtgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatgggaagtacaacgagcaagccaagccgcaaggccgcgcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtccggtgcggcaacctcattagaggagccagccgcctaaggtgggatgaatgattggggtgaagt

SEQ ID NO: 2079 - DNA, 1454 bp, Thermoanaerobacter pseudethanolicus
agttgagtgccggatagcggcggacgggtgagtaacgcgtgggcaacctacccttaagaccgggataacacctcgaaaggggtgctaatactggataagctccttgtagggcatcctatgaggagggaaggtagcgggagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcgatagtgtgggaagaagggatgacggtaccacacgaaagccccggctaactacgtgccagcagccgcggtaagacgtagggggcgagcgttgtccggaattactgggcgtaaagggcgcgtaggcggccgttcaagtcaggtgtaaaatacccgggctcaacccggggatagcacttgaaactgggcggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgaccttaccttaaaggtgaggagcctgcacaggtggtgcatggttgtcgtcagctcgtgtcgtgagatgttgggttaagtcccgcaacgagcgcaacccctgcctctagttgccagcgggtgaagccgggcactctagagggactgccgtggacaacacggaggaaggtggggatgacgtcaaatcatcatgccctatatgccctgggccacacacgtgctacaatggccggtacagagggaagcgaagccgcgaggtggagcgaaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaaccgggaaggagggagccgtcgaaggtggggcagatgattggggtgaagtcgtaacaaggtagccgtatcggaaggtgcggctggatcacctccttt

SEQ ID NO: 2080 - DNA, 1542 bp, Thermobifida fusca
ggagagtttgatcctggctcaggacgaacgctggcggcgtgcttaacacatgcaagtcgagcggtaaggccccttcgggggtacacgagcggcgaacgggtgagtaacacgtgagtaacctgcccctgactctgggataagcctgggaaactgggtctaataccggatatgacctcgtgccgcatggtgtggggtggaaaggtgtttttccggtcagggatgggctcgcggcctatcagcttgttggtggggtaacggcctaccaaggcgatgacgggtagccggcctgagagggcgaccggccacactgggactgagacacggcccagactcctgcgggaggcagcagtggggaatattgcgcaatgggcggaagcctgacgcagcgacgccgcgtgggggatgaaggccttcgggttgtaaacctcttttaccactcacgaaggcccctggttttctgggggttgacggtaggtggtgaataaggaccggctaactacgtgccagcagccgcggtaatacgtagggtccgagcgttgtccggaattattgggcgtaaagagctcgtaggcggcctgtcgcgtctgctgtgaaagtccggggcttaactccgggtgtgcagtggatacgggcaggcttgaggtaggtaggggagactggaattcctggtgtagcggtgaaatgcgcagatatcaggaggaacaccggtggcgaaggcgggtctctgggccttacctgacgctgaggagcgaaagcgtggggagcgaacaggattagataccctggtagtccacgccgtaaacgttgggcgctaggtgtggggactttccacggtttccgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggcttgacatcaccggtaatcctccagagatggggggtccttcggggatcggtgacaggtggtgcatggctgtcgtcagctcgtgtcgtgagatgttgggttaagtcccgcaacgagcgcaacccctgtcccatgttgccagcacgtggtggtggggactcatgggagactgccggggtcaactcggaggaaggtggggatgacgtcaagtcatcatgccccttatgccttgggctgcaaacatgctacaatggccggtacagagggcgtgcgatgtcgtgaggcggagcgaatctcttaaagccggtctcagttcggattggggtctgcaactcgaccccatgaaggtggagtcgctagtaatcgcggatcagcaacgccgcggtgaatacgttcccgggccttgtacacaccgcccgtcacgtcacgaaagtcggcaacacccgaaacacgtggcctaaccctttgtgggggggagcgtgtgaaggtggggctggcgattgggacgaagtcgtaacaaggtagccgtaccggaaggtgcggctggatcacctcctttctaaggagc

SEQ ID NO: 2081 - DNA, 1503 bp, Thermofilum pendens
actccggttgatcctgccggacccgaccgctatcggggtggggctaacccatggaagtctaggagccggggctacggccggctccggcggacggctcagtagcacgtggctaacctaccctcgggagggggataaccccgggaaactggggataaacccccataggcgcggacacctggaatgggtccgcgctgaaagggccacggtaccatgcttaccgtggccgcccgaggatggggctgcgccctatcaggtagttggcggggtaacggcccgccaagccgataacgggtgggggccgtgagagcgggagccccgagatgggcactgagacaagggcccaggccctacggggtgcaccaggggcgaaacttccgcaatgcgggaaaccgtgacggagtcaccccgagtgccacccgaagagggtggcttttgcccggtctaaaaagccgggcgaataagcggggggcaagcttggtgtcagccgccgcggtaataccaaccccgcgagtggtcgggacgtttattgggcctaaagcgtccgtagccggcccggtaagtccctccttaaagcccacggctcaaccgtgggagcggagggatactgccgggctagggggcgggagaggccgggggtactcctggggtaggggcgaaatcctataatcccaggaggaccaccagtggcgaaggcgcccggctagcacgcgcccgacggtgagggacgaaagctgggggagcaaaggggattagatacccccgtagtcccagctgtaaacgatgcgggctaggtgttggacgggcttcgagcccgtccagtgccgtagggaagccgttaagcccgccgcctggggagtacggccgcaaggctgaaacttaaaggaattggcgggggagcaccacaaggggtgaagcttgcggtttaattggagtcaacgccggaaaccttaccgggggcgacagcaggatgaaggccaggctgacgaccttgccagacgagctgagaggaggtgcatggccgtcgccggctcgtgccgtgaggtgtcctgttaagtcagggaacgagcgagacccccgcccctagttgctacccagcccttcggggctggggcactctagggggactgccggcgataagccggaggaaggtgggggctacggcaggtcagtatgccccgaaacccccgggctacacgcgagctgcaatggcggggacagcgggttccgaccccgaaagggggaggtaatcccttaaaccccgcctcagtaggaatcgagggctgcaactcgccctcgtgaacgtggaatccctagtaaccgcgtgtcaccaacgcgcggtgaatacgtccctgctccttgcacacaccgcccgtcgctccacccgagggaggcctaggtgaggcctcctgccgacgaggtgggaggtcgaacctgggcctcccaaggggggagaagtcgtaacaaggtggccgtaggggaacctgcggccggatcacctccttt

SEQ ID NO: 2082 - DNA, 1470 bp, Thermus aquaticus
gctcagggtgaacgctggcggcgtgcctaagacatgcaagtcgtgcgggccgtggggtatctcacggtcagcggcggacgggtgagtaacgcgtgggtgacctacccggaagagggggacaacatggggaaacccaggctaatcccccatgtggacacatcctgtggggtgtgtttaaagggttttgcccgcttccggatgggcccgcgtcccatcagctagttggtggggtaagagcccaccaaggcgacgacgggtagccggtctgagaggacggccggccacaggggcactgagacacgggccccactcctacgggaggcagcagttaggaatcttccgcaatgggcgcaagcctgacggagcgacgccgcttggaggaggaagcccttcggggtgtaaactcctgaacccgggacgaaacccccgatgaggggactgacggtaccggggtaatagcgccggccaactccgtgccagcagccgcggtaatacggagggcgcgagcgttacccggatttactgggcgtaaagggcgtgtaggcggcttggggcgtcccatgtgaaaggccacggctcaaccgtggaggagcgtgggatacgctcaggctagacggtgggagagggtggtggaattcccggagtagcggtgaaatgcgcagataccgggaggaacgccgatggcgaaggcagccacctggtccactcgtgacgctgaggcgcgaaagcgtggggagcaaaccggattagatacccgggtagtccacgccctaaacgatgcgcgctaggtctctgggttatctgggggccgaagctaacgcgttaagcgcgccgcctggggagtacggccgcaaggctgaaactcaaaggaattgacgggggcccgcacaagcggtggagcatgtggtttaattcgaagcaacgcgaagaaccttaccaggccttgacatgctagggaacctgggtgaaagcctggggtgccccgcgaggggagccctagcacaggtgctgcatggccgtcgtcagctcgtgtcgtgagatgttgggttaagtcccgcaacgagcgcaacccctgccgttagttgccagcgggtgaagccgggcactctaacgggactgcctgcgaaagcaggaggaaggcggggacgacgtctggtcatcatggcccttacggcctgggcgacacacgtgctacaatgcccactacagagcgaggcgacctggcaacagggagcgaatcgcaaaaaggtgggcgtagttcggattggggtctgcaacccgaccccatgaagccggaatcgctagtaatcgcggatcagccatgccgcggtgaatacgttcccgggccttgtacacaccgcccgtcacgccatgggagcgggttctacccgaagtcgccgggagccttagggcaggcgccgagggtagggcccgtgactggggcgaagtcgtaacaaggtagctgtaccg

SEQ ID NO: 2083 - DNA, 1400 bp, Tissierella praeacuta
ggctcaggacgaacgctggcggcgtgcctaacacatgcaagtcgagcgaagtttttaaagaagatttcttcggaatgaaactttaattatcttagcggcggacgggtgagtaacgcgtgagaaacctgccttttacaaagggatagcctcgggaaactgggattaataccttatgacactgtcgcatgagatttaagtcaaagcgtaaagcggtaaaagatggtctcgcgtcccattagttagttggtgaggtaaaggctcaccaagacagcgatgggtagccggcctgagagggtgaacggccacactggaactgagacacggtccagactcctacgggaggcagcagtggggaatattgcacaatggaggaaactctgatgcagcgacgccgcgtgaacgatgaaggctttcgggtcgtaaagttctgtcctaagggacgataatgacggtaccttaggaggaagccccggctaactacgtgccagcagccgcggtaatacgtagggggcaagcgttgtccggatttattgggcgtaaagggtgcgtaggcggccttttaagtcagatgtgaaagatcacggctcaaccgtggtaagcatttgaaactgaaaggcttgagttaaggagaggaaagtggaattcctagtgtagcggtgaaatgcgtagatattaggaggaataccagtggcgaaggcgactttctggacttatactgacgctgaggcacgaaagcgtggggagcgaacaggattagataccctggtagtccacgccgtaaacgatgagtgctaggtgttgggggtcaaacctcggtgccgcagctaacgcattaagcactccgcctggggagtacgtacgcaagtatgaaactcaaaggaattgacggggacccgcacaagcagcggagcatgtggtttaattcgaagcaacgcgaagaaccttaccagggcttgacatgcccctgaccgtcctagagatagggctttaccttcgggtacaggggacacaggtggtgcatggttgtcgtcagctcgtgtcgtgagatgttgggttaagtcccgcaacgagcgcaacccttgcctttagttgctaacagataagctgagcactctagagggactgccgatgacaaatcggaggaaggtggggatgacgtcaaatcatcatgccctttatgtcctgggctacacacgtgctacaatggtcggtacaacgagcagctacttagcgataagatgctaatctcttaaagccgatcccagttcggattgcaggctgcaactcgcctgcatgaagtcggagttgctagtaatcgcggatcagaatgtcgcggtgaatgcgttcccgggtcttgtacacaccgcccgtcacaccatgggagttggcaatacccgaag

SEQ ID NO: 2084 - DNA, 1441 bp, Trabulsiella guamensis
acgctggcgcagccttacacatgcaagtcgagcggcagcgggggaaagctgctttcccgccggcgagcggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccagagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgttttaatttcgatgcaacgcgaagaaccttacctggtcttgacacccacagaaccctgtagagatacgggggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatgcatatacaagagaagcgacctcgcgagagcaagcggcctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccacttgtgatta

SEQ ID NO: 2085 - DNA, 1297 bp, Treponema genomosp.
aacgaacgctggcggcgcgtcttaagcatgcaagtcgaacgagtggcggactggtgaggaacacgtgggtaatctacccttaagatggggatagctgttagaaatagcaggtaataccgaatacagaaagtcgcttgaggatgagcttgcgtcccattagctagttggtgaggtaacggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgttgatgaagatgacggtagtcggtgaataagccccggctaattacgtgccagcagccgcggtaacacgtaaggggcgagcgttgttcggaattattgggcgtaaagggcatgtaggcggttatgtaagcctgatgtgaaatcctggggcttaaccccagaatagcattgggtactgtgtaactcgaattacggaagggaaactggaattccaagtgtaggggtggaatctgtagatatttggaagaacaccggtggcgaaggcgggtttctggccgaattgacgctgagatgcgaaagtgtggggatcgaacaggattagataccctggtagtccacaccgtaaacgatgtacactaggtgttggggcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatcgacaggtgctgcatggctgtcgtcagctcgtgccgtgaggtgttgggttaagtcccgcaacgagcgcaacccctactgccagttactaacagctgaggactctggcggaactgccgatgacaaatcggaggaaggtggggatgacgtcaagtcatcatggcccttatgtccagggctacacacgtgctacaatggttgccaaagcgacgcgagaccgtaaggtggagcaaaccgcaagcgatcgtagttcggatgaagtctgaaactcgacttcagaagttggaatcgctagtaatcgcgcatcagcacggcgcggtgaatacgttcccgggccttgtacacaccgcccgtcacaccatccgagttgggggtacccgaagtcgctgtctaggacggtgccgaaggtacgcttggtaaggagggtg

SEQ ID NO: 2086 - DNA, 1297 bp, Treponema genomosp.
aacgaacgctggcggtgcgttttaagcatgcaagtcgaacgagtggcggactggtgagtaacgcgtgggtgatctacctttaagatggggatagcttttagaaataagagataataccgaatatggaaagccgcttgaagatgagcctgcgtcccattagctagttggtggggtaaaggcctaccaaggcaatgatgggtatccggcctgagagggtgaccggacacattgggactgagatacggcccaaactcctacgggaggcagcagctgagaatcttccgcaatggacgaaagtctgacggagcgacaccgcgtgaatgatgaaggccgaaaggttgtaaagttcttttgcagacaaagatgacggtagtttgcgaataagccccggctaattacgtgccagcagccgcggtaatacgtaaggggcgagcgttgttcggaattattgggcgtaaagggcatgtaggcggtttagtaagcctgatgtgaaatctacgagcttaactcgtaaactgcattgggtactgcttaactagagttatggaggggaaactggaattccaagtgtaggggtggaatctgtagatatttggaagaacaccggtggcgaaggcgggtttctagccaaactgacgctgatatgcgaaggtgcggggagcaaacaggattagataccctggtagtccgcacagtaaactatgtacactagatgttggggactcagtgttgaagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgctgcatggctgtcgtcagctcgtgccgtgaggtgttgggttaagtcccgcaacgagcgcaacccctactgccagttactaacagctgaggactctggcggaactgccggtgataaaccggaggaaggtgggggtgacgtcaagtcatcatggcccttatgtccagggctacacacgtgctacaatggttgtcaaagtgatgcgaagtcgcgagacggagcgaaacgcatgcaatcgtagtccggatggaatctgaaacctgattccagaagctggaatcgctagtaatcgcatatcagcacgatgcggtgaatacgttcctgggccttgtacacaccgcccgtcacaccatccgagtcgagggtacccgaagatgctgtctaggacggtggcgaaggtacgtttggtaaggagggtg

SEQ ID NO: 2087 - DNA, 1297 bp, Treponema genomosp.
aacgaacgctggcggtgcgtcttaagcatgcaagtcgaacgagtggcggactggtgagtaacgcgtggatgatctacctttgagatggggatagcttctagaaataggaggtaataccgaataacaaaagccgctcgaagatgagtctgcgtcccattagctagttggtgaggtaaaggcccaccaaggcgacgatgggtacccggcctgagagggtgaacgggcacattgggactgagatacggcccaaactcctacgggaggcagcagctgagaatcttccgcaatggacgaaagtctgacggagcgacaccgcgtgaacgatgaaggccggaaggttgtaaagttcttttgcagacaaagatgacggtagtttgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaaattgacgctaaggtgcgagggtgcggggagcaaacaggattagataccctggtagtccgcacagtaaacgatgtacactaggtgttggggactcagtgccggagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgctgcatggctgtcgtcagctcgtgccgtgaggtgttgggttaagtcccgcaacgagcgcaacccctactgccagttactaacagctgaggactcaggcggaactgccggtgatataccggaggaaggtggggatgacgtcaagtcatcatggcccttatgtccagggctacacacgtgctacaatggttgtcaaagtgaggcgaagccgcgaggttaagcgaatcgcaagcaatcgtagtccggatggaatctgaaacctgattccagaagctggaatcgctagtaatcgcatatcagcacgatgcggtgaatacgttcctgggccttgtacacaccgcccgtcacaccatccgagtcgaaggtacccgaagatgctgtctaggacggtggcgaaggtacgtttggtaaggagggtg

SEQ ID NO: 2088 - DNA, 1297 bp, Treponema genomosp.
aacgaacgctggcggtgcgttttaagcttgcaagtcgaacgagtggcggactggtgagtaacgcgtaggtgatctacctttaagactgggacagcctttagaaataaggggtaataccggatgtgggaagccgcttagagatgagcctgcgtcccattagctagttggtaaggtaacggcctaccaaggcgatgatgggtatccgacctgagagggtgatcggacacattgggactgagatacggcccaaactcctacgggaggcagcagctgagaatcttccgcaatggacgaaagtcggacggagcgacaccgcgtgaatgatgaaggccgaagggttgtaaagttcttttgcagacaaagatgacggtagtttgcgaataagccccggctaattacgtgccagcagccgcggtaatacgtaaggggcgagcgttgctcggaattattgggcgtaaagggcatgtaggcggttgggtaagcctgatgtgaaatctacgagcttaactcgtaaactgcattgggtactgctcatcttgaatcatagagggggaactggaattccaagtgtaggggtggaatctgtagatatttggaagaacaccggtggcgaaggcgggttcctagctaaattgacgctgatgtgcgaaggtgcggggagcaaacaggattagataccctggtagtccgctcagtaaacgatgtacactaggtgttggggactcagtgccggcgcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcgacaggtgcagcatggctgtcgtcagctcgtgccgtgaggtgttgggttaagtcccgcaacgagcgcaacccctactgccagttactaacagctgaggactctggcggaactgccggtgataaaccggaggaaggtggggatgacgtcaagtcatcatggcccttatgtccagggctacacacgtgctacaatggttgtcaaagtgatgcgaagtcgcgagacggagcgaaacgcatgcaatcgtagtccggatggaatctgaaacctgattccagaagctggaatcgctagtaatcgcatatcagcacgatgcggtgaatacgttcctgggtcttgtacacaccgcccgtcacaccatccgagtcgagggtacccgaagatgctgtctaggacggtggcgaaggtacgtttggtaaggagggtg

SEQ ID NO: 2089 - DNA, 1547 bp, Treponema phagedenis
tggagagtttgatcctggctcagaacgaacgctggcggcgcgtcttaagcatgcaagtcgaacggcaagggaggagcttgcttctcccctagagtggcggactggtgagtaacgcgtgggtgatctacccttaagatggggatagctcctagaaataggaggtaataccgaatacgcttatacggataaagccgtataaggaaaggaggctgcggccttgcttgaggatgagcccgcgtcccattatgcttgttggtgaggtaacggcttaccaaggcgacgatgggtatccggcctgagagggtggacggacacattgggactgagatacggcccaaactcctacgggaggcagcagctaagaatattccgcaatggacggaagtctgacggagcgacgccgcgtggacgaagaaggccgaaaggttgtaaagttcttttgccgatgaagaataagaggatgagggaatgcgtccttgatgacggtagtcgagcgaataagccccggctaattacgtgccagcagccgcggtaacacgtaaggggcgagcgttgttcggaattattgggcgtaaagggcacgcaggcgggttggtaagcctgatgtgaaatactcaagcttaacttgagaattgcattgggtactgccagtcttgaatcacggaggggaaaccggaattccaagtgtaggggtggaatctgtagatatttggaagaacaccggtggcgaaggcgggtttctggccgatgattgacgctgaggtgcgaaggtgtggggagcaaacaggattagataccctggtagtccacacagtaaacgatgtacactaggtgttggggcaagagcttcagtgccggcgcaaacgcaataagtgtaccgcctggggagtatgcccgcaagggtgaaactcaaaggaattgacgggggcccgcacaagcggtggagcatgtggtttaattcgatgatacgcgaggaatcttacctgggtttgacatcaaaagcaatattatagagatatggtagcgtagcaatacggcttttgacaggtgctgcatggctgtcgtcagctcgtgccgtgaggtgttgggttaagtcccgcaacgagcgcaacccctactgtcagttgctaacaggtaaagctgaggactctggcggaactgccgatgacaaatcggaggaaggtggggatgacgtcaagtcatcatggcccttatgtccagggctacacacgtgctacaatggttgctacaaagtgaagcgagactgtgaggttaagcaaatcgcaaaaaagcaatcgtagttcggattgaagtctgaaactcgacttcatgaagttggaatcgctagtaatcgcacatcagcacggtgcggtgaatacgttcccgggccttgtacacaccgcccgtcacaccatccgagttgagggtacccgaagtcgccagtctaacccgtaagggagggcggtgccgaaggtatgtttggcaaggagggtgaagtcgtaacaaggtagccgtaccggaaggtgcggctggatcacctcctttct

SEQ ID NO: 2090 - DNA, 1498 bp, Treponema sp.
cggcgcgtcttaaccatgcaagtcgagcggcaggcagcaatgccgagagcggcggactggtgagtaacacgtggataacgtaccccgatgcccgggacagcctgtagaaatagagggtaataccggataggtcaccatattcgcaagggatatggcgggaaaggagcttcggctccgcgccgggaacggtctgcggcccatcagctggacggcggggtaaaagcccgccgtggcgaggacgggtatccggcctgagagggcggacggacacattgggactgagatacggcccagactcctacgggaggcagcaggtaagaatattccgcaatggggggaaccctgacggagcgacgccgcgtgaacgaagaaggccggaaggttgtaaagttcttttctgttcgaggaataagtgtaggaggaaatgcctgcatggtgacggtagggcaggaataagcaccggctaattacgtgccagcagccgcggtaacacgtaaggtgcgagcgttgttcggaattattgggcgtaaagggcatgcaggcgggtcgccaagcttgatgagaaataccggggctcaactccggagctatattgagaactggcgagctagagttgccgaagggtatccggaattccgcgtgaaggggtgaaatctgtagatatgcggaagaacaccgatggcgaaggcaggataccggcggacgactgacgctgaggtgcgaaggtgcggggagcaaacaggattagataccctggtagtccgcacagtcaacgatgtacactgggcgtgtgcgcaagagcgtgcgtgccgaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatacacagcaatcatatagagatatgtgagcgtagcaatacggctgtgaacaggtgctgcatggctgtcgtcagctcgtgccgtgaggtgttgggttaagtcccgcaacgagcgcaacccctactgccggttactaacaggtaaagctgaggactcaggcggaactgcctgcgacaagcaggaggaaggcggggacgacgtcaagtcatcatggcccttatgtccagggctacacacgtgctacaatggccgccacagagcggggcgaagccgagaggcggagcagaacgcagaaaagcggtcgtagtccggattgaagtctgaaactcgacttcatgaagctggaatcgctagtaaccgcacatcagcacggcgcggtgaatacgttcccgggccttgtacacaccgcccgtcacaccatccgagcagggggtacccgaagccggcagtccaaccgcaagggggacgctgtcgaaggtacgctttgtgaggggggtgaagtcgtaacaaggtagtcgtaccggaaggtgcggctggawcacctccttc

SEQ ID NO: 2091 - DNA, 1404 bp, Treponema sp.
  misc_feature (821)..(821): n is a, c, g, or t
  misc_feature (831)..(831): n is a, c, g, or t
  misc_feature (840)..(841): n is a, c, g, or t
  misc_feature (843)..(843): n is a, c, g, or t
  misc_feature (886)..(886): n is a, c, g, or t
tagagtggcggactggtgagtaacgcgtgggtgatctgcccttaagatggggatagctcctagaaataggaggtaataccgaatacgcttatacggataaagccgtataaggaaaggaggctacggccttgcttgaggatgagcccgcgtcccattatgcttgttggtgaggtaacggcttaccaaggcgacgatgggtatccggcctgagagggtggacggacacattgggactgagatacggcccaaactcctacgggaggcagcagctaagaatattccgcaatggacggaagtctgacggagcgacgccgcgtggacgaagaaggccgaaaggttgtaaagttcttttgccgatgaagaataagaggatgagggaatgcgtccttgatgacggtagtcgagcgaataagccccggctaattacgtgccagcagccgcggtaacacgtaaggggcgagcgttgttcggaattattgggcgtaaagggcacgcaggcgggttggtaagcctgatgtgaaatactcaagcttaacttgagaattgcattgggtactgccagtsttgaatcacggaggggaaaccggaattccaagtgtaggggtggaatctgtagatatttggaagaacaccggtggcgaaggcgggtttctggccgatgattgacgctgaggtgcgaaggtgtggggagcaaacaggattagataccctggtagtccacacagtaaacgatgtacactaggtgttgggcaagagcttcagtgccggcgcaaacgcaataagtgtaccgcctggggagtatgcccgcaagggtgaaactnaaaggaattnacgggggcnngnacaagcggtggagcatgtggtttaattcgatgatacgcgaggnatcttacctgggtttgacatcaaaagcaatattatagagatatggtagcgtagcaatacggcttttgacaggtgctgcatggctgtcgtcagctcgtgccgtgaggtgttgggttaagtcccgcaacgagcgcaacccctactgtcagttgctaacaggtaacgctgaggactctggcggaactgccgatgacaaatcggaggaaggtggggatgacgtcaagtcatcatggcccttatgtccagggctacacacgtgctacaatggttgctacaaagtgaagcgagactgtgaggttaagcaaatcgcaaaaaagcaatcgtagttcggattgaagtctgaaactcgacttcatgaagttggaatcgctagtaatcgcacatcagcacggtgcggtgaatacgttcccgggccttgtacacaccgcccgtcacaccatccgagttgagggtacccgaagtcgccagtctaacccgtaagggagggcggtgccgaaggtatgtttggcaaggagggtg

SEQ ID NO: 2092 - DNA, 1327 bp, Treponema sp.
ggagtttgatcctggctcagaacgaacgctggcggcgcgtcttaaacatgcaagtcgaacgagtggcggactggtgagtaacacgtgggtgatataccttttagttggggatagctgttagaaatagcaggtaataccgaatgtggaaagccgctagaagaatggctcgcggcccattagctcgttggtgaggtaacggcccaccaaggcaatgatgggtatccggcctgagagggtgaacggacacattgggactgagatacggcccagacttctacgggaggcagcagttaagaatattccgcaatggacgaaagtctgacggagcgacgccgcgtggatgaagaatgccgaaaggttgtaaaatccttttaagcctgaggatgacagtagggcttgaataagcaacggctaattacgtgccagcagccgcggtaacacgtaagttgcgagcgttgttcggaattattgggcgtaaagggcatgtaggcggatatgcaagcttggtgtgaaatactgcagcttaactgcggaactgcattgagaactgcacatcttgaattactgaagggtaaccagaattccacgtgtaggggtgaaatctgtagatatgtggaagaataccaatggcgaaggcaggttaccggcagaattgacgctgaggtgcgaaagtgcggggagcgaacaggattagataccctggtagtccgcaccgtaaacgatgtacactaggtgtccggcgctgggtgccaaagcaaacgtgataagtgtaccgcctggggagtatgcccgcaagggtgaaactcaaaggaattgacgggggcccgcacaagcggtggagcatgtggtttaattcgatggtacgcgaggaaccttacctgggtttgacataaacaggtgctgcatggctgtcgtcagctcgtgccgtgaggtgttgggttaagtcccgcaacgagcgcaacccctactgccagttactaacagctgaggactctggcggaactgccggtgacaaaccggaggaaggtggggatgacgtcaagtcatcatggcccttatgtccagggctacacacgtgctacaatggtaggcaaagtgaggcgaagctgtaaagcggagcaaaacgcaaactatcgtagtccggatggagtctgaaactcgactccagaagttggaatcgctagtaatcgcgcatcagcacggcgcggtgaatacgttcccgggccttgtacacaccgcccgtcacaccatccgagtagagggtacccgaagtcggtgtctaggacgctgccgaaggtatgttttgtaaggagggtgaagtcgtaac

SEQ ID NO: 2093 - DNA, 1327 bp, Treponema sp.
ggagtttgatcctggctcagaacgaacgctggcggcgcgtcttaagcatgcaagtcgaacgagtggcggactggtgagtaacacgtgggtgatctacccttgagatggggatagccgttaggaatagcgggtaataccgaatacagaaagtcgctcgaggatgagcttgcgtcccattagctagttggtgaggtaagggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgctgatgaagatgacgataatcggcgaataagccccggctaattacgtgccagcagccgcggtaacacgtaaggggcgagcgttgttcggaattattgggcgtaaagggcatgtaggcggttatgtaagcctgatgtgaaatgctggggctcaaccccagaactgcattgggtactgcgtagcttgaattacggaagggaaactggaattccaagtgtaggggtggaatctgtagatatttggaagaacaccggtggcgaaggcgggtttctggccgaattgacgctgagatgcgaaagtgtggggatcgaacaggattagataccctggtagtccacaccgtaaacgatgtacactaggtgctggagcttcagtgccaaagcaaacgtgataagtgtaccgcctggggagtatgcccgcaagggtgaaactcaaagggattgacgggggcccgcacaagcggtggagcatgtggtttaattcgatggtacgcgaggaaccttacctgggttcgacatcgacaggtgctgcatggctgtcgtcagctcgtgccgtgaggtgttgggttaagtcccgcaacgagcgcaacccctactgccagttactagcagctgaggactctggcggaactgccgatgacaaatcggaggaaggtggggatgacgtcaagtcatcatggcccttatgtccagggctacacacgtgctacaatggttgccaaagcgaagcgatgctgtgaggctaagcaaaccgcaagcaatcgtagttcggatgaagtctgaaactcgacttcagaagttggaatcgctagtaatcgcgcatcagcacggcgcggtgaatacgttcccgggccttgtacacaccgcccgtcacaccatccgagttgagggtacccgaagtcgctgtctaggacggtgccgaaggtacgtttggtaaggagggtgaagtcgtaac

SEQ ID NO: 2094 - DNA, 1295 bp, Treponema sp.
aacgaacgctggcggcgcgtcttaagcatgcaagtcgaacgagtggcggactggtgagtaacgcgtgggtgacctgccctgaagatggggatagctagtagaaatattagataataccgaatgtggaaagccgcttcaggatgggcctgcgtcccattagctggttggtgaggtaaaggctcaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagatgacggtaatctgcgaataagccccggctaattacgtgccagcagccgcggtaacacgtaaggggcgagcgttgttcggaattattgggcgtaaagggtatgtaggcggttaggtaagcctggtgtgaaatctacgagctcaactcgtaaactgcatcgggtactgcttgacttgaatcacggaggggaaaccggaattccaagtgtaggggtggaatctgtagatatttggaagaacaccggtggcgaaggcgggtttctggccgaattgacgctgatatacgaaggtgcggggagcaaacaggattagataccctggtaatccgcacagtaaacgatgtacactaggtgtcggagcttcggtgccgacgcaaacgcattaagtgtaccgcctgggaagtatgcccgcaagggtgaaactcaaaggaattgacgggggcccacacaagcggtggagcatgtggtttaattcgatgatacgcgagaaaccttacctgggttgacatcgacaggtgctgcatggctgtcgtcagctcgtgccgtgaggtgttgggttaagtcccgcaacgagcgcaacccctactgccagttactaacagctgaggactctggcggaactgccgatgacaaatcggaggaaggtggggatgacgtcaagtcatcatggcccttacgtccagggctacacacgtgctacaatggttgccaaatcgaagcgacaccgcgaggtcaagcaaaacgcagcaatcgtagtccggatgaagtctgaaactcgacttcagaagttggaatcgctagtaatcgcacatcagcacggtgcggtgaatacgttcctgggccttgtacacaccgcccgtcataccatccgagtcgagggtacccgaagtcgctgtctaggacggtgccgaaggtacgtttggtaaggagggtg

SEQ ID NO: 2095 - DNA, 1460 bp, Treponema sp.
aacgaacgctggcggcgcgtcttaagcatgcaagtcgaacggcaagagaggagcttgcttctctcctagagtggcggactggtgaggaacgcgtgggtaatctacccttaagatggggatagccgctagaaatagcgggtaataccaatagacttatagctgagaaagaagtgataaggaaaggaagctaaggcttcgcttaaggatgagcctgcgtcccattagctagttggtaaggtaacggcctaccaaggcgacgatgggtatccggcctgagagggtgaacggacacattgggactgagatacggcccaaactcctacgggaggcagcagctaagaatattccgcaatggacgaaagtctgacggagcgacgccgcgtggatgaagaaggctgaaaagttgtaaaatccttttgttgatgaagaataagggtgagagggaatgttcatctgatgacggtaatcagcgaataagccccggctaattacgtgccagcagccgcggtaacacgtaaggggcgagcgttgttcggaattactgggcgtaaagggcatgtaggcggttatgtaagcctgatgtgaaatcctgaggcttaacctcagaatagcattgggtactgtgtaacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagtaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgtcttagagataaggcagtgtagcaatacaccgctagacaggtgctgcatggctgtcgtcagctcgtgccgtgaggtgttgggttaagtcccgcaacgagcgcaacccctactgccagttactaacaggtaaagcttgagactctggcggaactgccgatgacaaatcggaggaaggtggggatgacgtcaagtcatcatggcccttatgtccagggctacacacgtgctacaatggttgctacaaagcgaagcgagaccgtaaggtggagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtgcccgaagtcgcttgtctaacccgcaagggagacggtgccgaaggtacgcttggta

SEQ ID NO: 2096 - DNA, 1423 bp, Treponema sp.
aacgaacgctggcggcgcgtcttaagcatgcaagtcgaacggcaagagaggagcttgcttctctcctagagtggcggactggtgaggaaccgtgggtaatctacccttaagatggggatagcgtagaaatagcgtaataccgaatactggaggaaagggctaggctcgctaggatgagcgcgtcccattagctagttggtaggtaaggccaccaaggcgacgatgggtatccggcctgagagggtgacggacacattgggactgagatacggcccaaactcctacgggaggcagcagctaagaatattccgcaatggacggtctgacggagcgacgccgcgtggatgaagaaggctgaaaagttgtaaaatccttttgttgatgaggaataagggtgagagggaatgctcatctgatgacggtaatcgacgaataagccccggctaattacgtgccagcagccgcggtaacacgtaaggggcgagcgttgttcggaattattgggcgtaaagggcatgtaggcggttatgtaagcctgatgtgaaatcctggggcttaaccctagaatagcattgggtactgtataacttgaattacggaaggggaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgccttagagataaggtagtgtagtttactacaccgctagacaggtgctgcatggctgtcgtcagctcgtgccgtgaggtgttgggttaagtcccgcaacgagcgcgacccctattgccagttactaacaggtaaagcttgaggactctggcggaactgccgatgacaaatcggaggaaggtggggatgacgtcaagtcatcatggcccttatgtccagggctacacacgtgctacaatggctgctacaaagcgaggcgagactgtgaaggtgagcaaaccgcaaaaaagcagccgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgctcgtctaacccgtaagggaggacggtgccgaaggtacgcttggtg

SEQ ID NO: 2097 - DNA, 1439 bp, Treponema sp.
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcagataataccgaatacactcggcgcttcataagaggcgttgaggaaaggaagctacggcttcgcttgaggatgagcttgcgtcccattagctagttggtgaggtaacggcccaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaagatccttttgttgatgaagaataaggatgagagggaatgctcatctgatgacggtaatcgacgaataagccccgttacgtgccagcagccgcggtaacacgtaaggggcgagcgttgttcggaattattgggcgtaaagggcatgtaggcggttatgtaagcctgtgtgaaatctgggcttaaccctgaaagcattgggtactgttacttgaattacggaagggaactgaattccaagtgtaggggtggaatctgtgatatttggaagaacaccggtggcgaaggcgggtttctggccgataattgacgctgagtgcgaaagtgtggggatcgaacaggattagataccctggtagtccacactgtaaacgatgtacactaggtgttgggaagagcttcagtgccaaagaaacggataagtgtaccgcctggggagtatgcccgcaagggtgaaactcaaaggaattgacgggggcccgcacaagcggtggagcatgtggtttaattcgatggtacgcgaggaaccttacctgggtttgacatctaggagtagagataagtagcaataccgctagacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttctacaaagcgagcaaccgtaggggagcaaaccgcaaaaaagcaatcgtagttcggattgaagtctgaaactcgacttcatgaagttggaatcgctagtaatcgcgcatcagcacggtgcggtgaatacgttcccgggccttgtacacaccgcccgtcacaccatccgagttgggggtacccgaagtcgcttgtctaaccgcaaggggacggtgccgaggtacgcttggtaaggagggtgaagtcgtaacaa

SEQ ID NO: 2098 - DNA, 1482 bp, Treponema sp.
aacgaacgctggcggcgcgtcttaagcatgcaagtcgaacggcaagagaggagcttgcttctctcctagagtggcggactggtgaggaacgcgtgggtaatctacccttaagatggggatagccgctagaaatagcgggtaataccgaatagacttatagctgagaaagaagtgataaggaaaggaagctaaggcttcgcttaaggatgagcctgcgtcccattagctagttggtaaggtaacggcctaccaaggcgacgatgggtatccggcctgagagggtgaacggacacattgggactgagatacggcccaaactcctacgggaggcagcagctaagaatattccgcaatggacggaagtctgacggagcgacaccgcgtggatgaagaaggctgaaaagttgtaaaattcttttgctgatgaagaataaagataagagggaatgcttatcagatgacggtagtcggcgaataagccccggctaattacgtgccagcagccgcggtaacacgtaaggggcgagcgttgttcggaattattgggcgtaaagggcatgcaggcggttgtgtaagcctgatgtgaaatcctgaggcttaaccttggggctgcattgggtactgcacgacttgaattacggaaggggaactggaattccaagtgtaggggtggaatctgtagatatttggaagaacaccggtggcgaaggcgggtttctggccgataattgacgctgagatgcgaaagtgtggggatcgaacaggattagataccctggtagtccacactgtaaacgatgtacactaggtgttggggtaacaatctcagtgccgaagcaaacgtgataagtgtaccgcctggggagtatgcccgcaagggtgaaactcaaaggaattgacgggggcccgcacaagcggtggagcatgtggtttaattcgatggtacgcgaggaatcttacctgggtttgacatctagtgggatactttagagataaggtagtgtagcaatacaccgctagacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggctgctacaaagcgaggcgagactgtgaaggtgagcaaaccgcaaaaaagcagccgtagttcggattgaagtctgaaactcgacttcatgaagttggaatcgctagtaatcgcgcatcagcacggcgcggtgaatacgttcccgggccttgtacacaccgcccgtcacaccatccgagttgagggtacccgaagtcgcttgtctaacccgcaagggaggacggtgccgaaggtatgcttggtgaggagggtgaagtcgtaac

SEQ ID NO: 2099 - DNA, 1480 bp, Treponema sp.
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcagataataccgaatacactcaatttttcataagaggagttgaggaaagaggctacggcctcgcttaaggatgagcttgcgtcccattagctagttggtgaggtaaaggctcaccaaggcgacgatgggtatccggcctgagagggtgaacggacacattgggactgagatacggcccaaactcctacgggaggcagcagctaagaatattccgcaatggacggaagtctgacggagcgacgccgcgtggatgaagaaggctgaaaagttgtaaaatccttttgttgatgaagaataagggtaagagggaatgcttgcctgatgacggtaatcggcgaataagccccggctaattacgtgccagcagccgcggtaacacgtaaggggcgagcgttgttcggaattattgggcgtaaagggcatgtaggcggttatgtaagcctgatgtgaaatgccggggcttaaccccggaacagcattgggtactgtataacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagaggaatactgtagagatacggtagcgtagcaatacgccgctagacaggtgctgcatggctgtcgtcagctcgtgccgtgaggtgttgggttaagtcccgcaacgagcgcaacccctactgccagttactaacaggtaacgcttgaggactctggcggaactgccgatgacaaatcggaggaaggtggggatgacgtcaagtcatcatggcccttatgtccagggctacacacgtgctacaatggttgctacaaagcgaagcaagaccgtaaggtggagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgcttgtctaacctgcaaagggggacggtgccgagggtacgcttggtaaggagggtgaagtcgtaa

SEQ ID NO: 2100 - DNA, 1461 bp, Treponema sp.
aacgaacgctggcggcgcgtcttaagcatgcaagtcgaacggcaagagaggagcttgcttctctcctagagtggcggactggtgaggaacacgtgggtaatctacccttaagatggggatagctgctagaaatagcaggtaataccgaataccctcacgttcataaagggatgtgaggaaaggaagctacggcttcgctcgaggatgagcctgcgtcccattagctagttggtgaggtaaaggcccaccaaggcgacgatgggtatccggcctgagagggtgatcggacacattgggactgagatacggcccaaactcctacgggaggcagcagctaagaatattccgcaatggacggaagtctgacggagcgacgccgcgtggatgaagaaggctgaaaagttgtaaaatccttttgctgatgaagaataagggtaggagggaatgcctatctgatgacggtaatcggcgaataagccccggctaattacgtgccagcagccgcggtaacacgtaaggggcgagcgttgttcggaattattgggcgtaaagggcatgtaggcggttatgtaagcctgatgtgaaatactggggctcaaccccagaactgcattgggtactgcgtagcttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgctggagtggaagcttcagtgccaaagcaaacgtgataagtgtaccgcctggggagtatgcccgcaagggtgaaactcaaaggaattgacgggggcccgcacaagcggtggagcatgtggtttaattcgatggtacgcgaggaaccttacctgggtttgacatctagtggaatgttttagagataagacagtgtagcaatacaccgctagacaggtgctgcatggctgtcgccagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttgctacaaagcgaagcgatgctgtgaggctaagcaaaccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgagggtacccgaagtcgctcgtctaacctgcaaaggaggacggtgccgaaggtacgtttggta

SEQ ID NO: 2101 - DNA, 1463 bp, Treponema sp.
aacgaacgctgacggcgcgtcttaagcatgcaagtcgaacggtaagagaggagcctaggtgttctcctagagtggcggactggtgagtaacgcgtgggtgacctgccctaaagatggggatagctagtagaaatattagataataccgaatgtgctcatttacataaaggtagatgaggaaagggggctacggctccgctttaggatgggcccgcgtcccattagctcgttggtgaggtaacggcccaccaaggcaacgatgggtatccggcctgagagggtgaacggacacattgggactgagatacggcccaaactcctacgggaggcagcagctaagaatcttccgcaatggacgaaagtctgacggagcgacgccgtgtgaatgaagaaggccgaaaggttgtaaaattcttttgcagatgaagaataaggataagagggaatgcttgtccgatgacggtagttatgcgaataagccccggctaattacgtgccagcagccgcggtaacacgtaaggggcgagcgttgttcggaattattgggcgtaaagggcatgtaggcggttaggtaagcctgatgtgaaatctacgagcttaactcgtaaactgcattgggtactgcttgacttgaatcacggaggggaaaccggaattccaagtgtaggggtggaatctgtagatatttggaagaacaccggtggcgaaggcgggtttctggccgatgattgacgctgatatgcgaaggtgcggggagcaaacaggattagataccctggtagtccgcacagtaaacgatgtacactaggtgttggggcaagagcttcagtgcctaagcaaacgcaataagtgtaccgcctgggaagtatgcccgcaagggtgaaactcaaaggaattgacgggggcccacacaagcggtggagcatgtggtttaattcgatgatacgcgaggaaccttacctgggtttgacatcaagagcaatactatagagatatggtagcgtagcaatacggctcttgacaggtgctgcatggctgtcgtcagctcgtgccgtgaggtgttgggttaagtcccgcaacgagcgcaacccctactgccagttactaacaggtaaagcttgaggactctggcggaactgccgatgacaaatcggaggaaggtggggatgacgtcaagtcatcatggcccttacgtccagggctacacacgtgctacaatggttgctacaaatcgatgcaaaaccgtgaggtcaagcaaaacgcaaaaaagcaatcgtagtccggattgaagtctgaaactcgacttcatgaagttggaatcgctagtaatcgcacatcagcacggtgcggtgaatacgttcctgggccttgtacacaccgcccgtcacaccatccgagtcgagggtacccgaagtcgccagtctaacctgcaaagggggacgacgccgaaggtacgcttggta

SEQ ID NO: 2102 - DNA, 1470 bp, Treponema sp.
aacgaacgctggcggtgcgtcttaagcatgcaagtcgaacggtaagaggggagcttagctcccttcctagagtggcggactggtgagtaacgcgtggatgatctacctttgagatggggatagcttctagaaataggagataataccgaataaccttattgcgttttgatgtagtaagaaaaggagcgtcagctccgcttaaagatgagtctgcgtcccattagctagttggtaaggtaaaggcctaccaaggcgacgatgggtacccggcctgagagggtgaacgggcacattgggactgagatacggcccaaactcctacgggaggcagcagctgagaatcttccgcaatggacgaaagtctgatggagcgacaccgcgtgaacgatgaaggccggaaggttgtaaagttcttttgcagacaaagaataaggatagaaggaaatgactatctgatgacggtagttatgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaatgattgacgctaaggtgcgaaggtgcggggagcaaacaggattagataccctggtagtccgcacagtaaacgatgtacactaggtgttggggtaagactcagtgccgaaagcaaacgcaataagtgtaccgcctggggagtatgcccgcaagggtgaaactcaaaggaattgacgggggcccacacaagcggtggagcatgtggtttaattcgatgatacgcgaggaaccttacctgggtttgacatcaagagggatactgtagagatatggtagcgtagcaatacgactcttgacaggtgctgcatggctgtcgtcagctcgtgccgtgaggtgttgggttaagtcccgcaacgagcgcaacccctactgccagttactaacaggtaaagcttgaggactctggcggaactgccggtgataaaccggaggaaggtggggatgacgtcaagtcatcatggcccttatgtccagggctacacacgtgctacaatggttgttacaaagtgaagcgaagccgcgaggttaagcgaatggcaaaaaagcaatcgtagtccagattggaatctgaaacctgattccatgaagctggaatcgctagtaatcgcatatcagcacgatgcggtgaatacgttcctgggccttgtacacaccgcccgtcacaccatccgagtcgaaggtacccgaagacgctagtctaaccgtaaggaggacggtggcgaaggtacgtttggtaaggagggtgaa

SEQ ID NO: 2103 - DNA, 1461 bp, Treponema sp.
aacgaacgctggcggtgcgtcttaagcatgcaagtcgaacggtaagaagagagcttgctcttttcctagagtggcggactggtgagtaacgcgtggatgatctacctttaagatggggatagcttctagaaataggagataataccgaataaccttatcgtgttatgacgtgataagaaaatggagcgttagctccgcttgaagatgagtctgcgtcccattagctagttggtagggtaaaggcttaccaaggcgatgatgggtatccggcctgagagggtgaacggacacattgggactgagacacggcccaaactcctacgggaggcagcagctgagaatcttccgcaatggacgaaagtctgacggagcgacaccgcgtgaacgatgaaggccggaaggttgtaaagttcttttgcagacaaagaataaggatagaaggaaatgactatctgatgacggtagttatgcgaataagccccggctaattacgtgccagcagccgcggtaatacgtaaggggcgagcgttgttcggaattattgggcgtaaagggcatgtaggcggttaggtaagcctgatgtgaaatgtatgagcttaactcataaactgcattgggtactgcttgacttgaatcatggaggggaaactggaattccaagtgtaggggtggaatctgtagatatttggaagaacaccggtggcgaaggcgggtttctagccaatgattgacgctaaggtgcgaaggtgcggggagcaaacaggattagataccctggtagtccgcacagtaaacgatgtacactaggtgttggggtaagactcagtgccaaagcaaacgcaataagtgtaccgcctggggagtatgcctgcaagggtgaaactcaaaggaattgacgggggcccacacaagcggtggagcatgtggtttaattcgatgatacgcgaggaaccttacctgggtttgacatcaagagggatgctatagagatatggtagcgtagtaatacgtctcttgacaggtgctgcatggctgtcgtcagctcgtgccgtgaggtgttgggttaagtcccgcaacgagcgcaacccctactgccagttactaacaggtaaagctgaggactcaggcggaactgccggtgataaaccggaggaaggtggggatgacgtcaagtcatcatggcccttatgtccagggctacacacgtgctacaatggttgttacaaagtgaagcgaagccgcgaggttgagcgaatcgcaaaaaagcaatcgtagtccggattggaatctgaaacctgattccatgaagctggaatcgctagtaatcgcatatcagcacgatgcggtgaatacgttcctgggccttgtacacaccgcccgtcacaccatccgagtcgaaggtacccgaagacgctagtctaaccgtaaggaggacggtggcgaaggtatgtttggtaagga

SEQ ID NO: 2104 - DNA, 1382 bp, Treponema sp.
aacgaacgctggcggtgcgtcttaagcatgcaagtcgaacggcaagaaagtgcttgcactttcctagagtggcggactggtgagtaacgcgtgggtgatctacctttaagatggggatagcttttagaaataagagataataccgaatgtgcttgcgatgctttggcgttgcaaggaaaggagcgtttgctcgcttaaagatgagcctgcgtcccattagctagttggtgaggtaatggcccaccaaggcgatgatgggtatccgacctgagagggtgatcggacacattgggactgagatacggcccaaactcctacgggatgcagcagctgagaatcttccgcaatggacgaaagtctgacggagcgacaccgcgtgaatgatgaaggccgaaaggttgtaaaattcttttgcagacaaagaataagtgtaggaggaaatgcctacatgatgacggtagttatgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaagccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 2105 - DNA, 1456 bp, Treponema sp.
aacgaacgctggcggcgcgtcttaagcatgcaagtcgaacggtaagaaggagcttgcttcttcctagagtggcggactggtgagtatcgcgtggatgacgtacccttttgacggggatagccgatagaaatatcagataataccggataatctcttttggggtaaagacgaaagaggaaagcagcttcggctgcgcaggaggaacggtccgcgtcctatcagctagtcggcagggtaaaggcctgccgaggcgacgacgggtatccggcctgagagggtggacggacacattgggactgagatacggcccagactcctacgggaggcagcagctaagaatattccgcaatggacgaaagtctgacggagcgacgccgcgtggacgatgaaggccggagggttgtaaagtccttttatccgtgaagaagaagcgtaagaggaaatgcttgcgtggtgacggtagcggatgaataagcaccggctaattacgtgccagcagccgcggtaacacgtaaggtgcgagcgttgttcggaattattgggcgtaaagggcatgcaggcggtcaggcaagcccggcgtgaaaggcgggggctcaactcccgaactgcgctgggaactgcagggcttgagtttctgaagggtagccggaattccacgtgtaggggtgaaatctgtagatatgtggaagaacaccaatggcgaaggcaggctactggcagaagactgacgctgaggtgcgaaggtgcggggagcaaacaggattagataccctggtagtccgcacagtcaacgatgtgcactagatgtctgtccacgaggatgggtgtcaaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacagtgattatgtagagatatataagcgcagcaatgcgactgtgaacaggtgctgcatggctgtcgtcagctcgtgccgtgaggtgttgggttaagtcccgcaacgagcgcaacccctactgccagttaccagcatgtaatgatggggactctggcggaactgcctgcgacaagcaggaggaaggcggggatgacgtcaagtcatcatggcccttatgtccagggctacacacgtgctacaatggttgggacaaagcggagcgagtgcgagagtatgagcagaacgcagaaagccgatcgtagtccggattggagtctgaaactcgactccatgaagttggaatcgctagtaatcgcatatcagcacgatgcggtgaatacgttcccgggccttgtacacaccgcccgtcacaccatccgagtggagagtacccgaagccggcagtctaaccgcaagggggacgctgtcgaaggtatgcttcgtg

SEQ ID NO: 2106 - DNA, 1522 bp, Treponema sp.
gagtttgatcctggctcagaacgaacgctggcggcgcgtcttaagcatgcaagtcgaatggcaagattggtgcttgcactgatcctagaatggcggactggtgagtaacgcgtgggtgacgtaccctttggacggggatagctgctagaaatagcagataataccggataaggtggcctgtgtcagaggcaggtcaggaaaggaacatttgttccgccgaaggaacggctcgcgagctattagctagttggtgaggtaacggcccaccaaggcgatgatagctacccggcctaagagggtgaacgggcacattgggactgagatacggcccagactcctacgggaggcagcagctaagaatattccgcaatggacgaaagtctgacggagcgacgccgcgtggatgatgaaggtcggaagattgtaaaatccttttatgactgaagaataagtatggtgagagaaacgccgtatggtgacagtaggtcatgaataagcaacggctaattacgtgccagcagccgcggtaacacgtaagttgcgagcgttgttcggaattattgggcgtaaagggcatgcaggcggaattgcaagcttggtgtgaaataccggggcttaactccggaatagcattgagaactgcaaaactagagtcactgaggggcaatcagaattccaggtgtaggggtgaaatctgtagatatctggaagaataccaatggcgaaggcaggttaccagcagatgactgacgctgaggtgcgaaggtgcggggagcaaacaggattagagaccctggtagtccgcacagtcaactatgtgcactagatgtctggtcgacagaccgggtgtcgaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacaggaattatatagagatatgtaagcgcagcaatgcgcctgtgaacaggtgctgcatggctgtcgtcagctcgtgccgtgaggtgttgggttaagtcccgcaacgagcgcaacccctgctgccagttactaacacgtaaaggtgaggactctggcggaactgccggtgacaaaccggaggaaggcggggatgacgtcaagtcatcatggcccttatgtccagggctacacacgtgctacaatgggagatacagagtgaagcgaagcagcgatgcggagcaaaacgcagaaaacctctcgtagtccggattggagtctgaaactcgactccatgaagttggaatcgctagtaatcgcacatcagcacggtgcggtgaatacgttcccgggccttgtacacaccgcccgtcacaccatccgagtagattctacccgaagccggcagtctaaccgcaaggaggacgctgtcgaaggtaggatttgtgaggggggtgaagtcgtaacaaggtagtcgtaccggaaggtgcgg

SEQ ID NO: 2107 - DNA, 1475 bp, Treponema sp.
aacgaacgctggcggcgcgtcttaagcatgcaagtcgaacggcaaggaagtgcttgcacttccctagagtggcggactggtgagtaacacgtgggtaacatgccttttagttggggatagctactagaaatagtagataataccgaatacgattttacagggtaaggctgtaaaaggaaaggagctacggctctgctgaaagattggctcgcggcccattagctagttggtgaggtaaatgcttaccaaggcaatgatgggtatccggcctgagagggtgaacggacacattgggactgagatacggcccagactcctacgggaggcagcagctaagaatgttccgcaatggagggaactctgacggagcgacgccgcgtggatgaagaaggtcgaaagattgtaaagttcttttgagatggaagaataagtattgcagggaatggcagtatggtgacagtacattttgaataagaggcggctaattacgtgccagcagccgcggtaacacgtaagcctcgagcgttgttcggaattattgggcgtaaagggcatgtaggcggtcataaaagcttggtgtgaaatctatgggcttaacccataaactgcgttgagaactgtatgacttgagttactgaagggaaactagaattccaggtgtaggggtggaatctgtagatatctggaagaataccaatggcgaaggcaagtttctggcagataactgacgctgaggtgcgaaggtgcggggagcaaacaggattagataccctggtagtccgcacagtaaactatgtacactaggtgtctgacataagtctgggtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatagtacttaatagagtagagatactttagcgtagcaatacgaagtactacaggtgctgcatggctgtcgtcagctcgtgccgtgaggtgttgggttaagtcccgcaacgagcgcaacccctactgccagttactaacaggaaagctgaggactctggcggaactgccggtgacaaaccggaggaaggtggggatgacgtcaagtcatcatggcccttatgtccagggctacacacgtgctacaatggtagaaacagagtgaagcgaagcggcgacgtggagcaaaacgcaaaaaagctatcgtagttcggattggagtctgaaactcgactccatgaagttggaatcgctagtaatcgcacatcagcacggtgcggtgaatacgttcccgggccttgtacacaccgcccgtcacaccatccgagtagaggatacccgaagccggtagtctaaccgcaaggaggacgctgtcgaaggtatgctttgtaaggagggtgaagtcgtaacaa

SEQ ID NO: 2108 - DNA, 1381 bp, Treponema sp.
aacgaacgctggcggtgcgtcttaagcatgcaagtcgaacggcaagaaagtgcttgcactttcctagagtggcggactggtgagtaacgcgtgggtgatctacctttaagatggggatagcttttagaaataagagataataccgaatgtgcttacggtgttttgacattgtaaggaaaggagcgtttgctccgcttaaagatgagcctgcgtcccattagctagttggtgaggtaaaggctcaccaaggcgatgatgggtatccggcctgagagggtgaccgacacattgggactgagatacggcccaaactcctacgggaggcagcagctgagaatcttccgcaatggacgaaagtctgacggagcgacaccgcgtgaatgatgaaggccgaaaggttgtaaaattcttttgcagacaaagaataaggatagtaggaaataactgtctgatgacggtagttacgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaaccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 2109 - DNA, 1383 bp, Treponema sp.
aacgaacgctggcggtgcgttttaagcatgcaagtcgaacggcaggaaggtgcttgcactttcctagagtggcggactggtgagtaacgcgtaggtgatctacctttaagactgggacagcctttagaaataaggggtaataccggatgtgcttattatgttttgacgtagtaagggaaggagcgtttgctccgcttagagatgagcctgcgtcccattagctagttggtaaggtaacggcctaccaaggcgatgatgggtatccgacctgagagggtgatcggacacattgggactgagatacggcccaaactcctacgggaggcagcagctgagaatcttccgcaatggacgaaagtctgacggagcgacaccgcgtgaatgatgaaggccgaaaggttgtaaagttcttttgcagacaaagaataaggatagaaggaaatgtctatttgatgacggtagttatgcgaataagccccggctaattacgtgcggggcgagcgttttcggaattattgggcgtaaagggcatgtaggcggtttaagcctgtgtgaatctacgagcttaactcgtaaatgcattgggtactgcttgaatcagaggggaactggaattccaagtgtaggggtggaatctgtagatatttggaagaacaccggtggcgaaggcgggtttctagcatgattgacgctatgcgaaggtgggggagcaaacaggattagataccctggtagtccgcacagtcatgtacactagtgggggtaagactcagtgggcaaacgcataagtgtaccgcctggggagtatgcccgcaaggtgaaactcaaaggaattgacgggggcccacacaagcggtggagcatgtggtttaattcgatgtacgcgaggaaccttacctgggtttgacataaggattatagagatatggtagcgtagatacgctttacaggtgctgcatggctgtcgtcagctcgtgccgtgaggtgttgggtaagtcccgcaacgagcgcaaccctactgccagttactaacaggtaaagtgaggactcggcggaactgccggtgataaaccggaggaaggtggggatgacgtcaagtcatcatggcccttatgtccagggctacacacgtgctacaatggttgttacaaagtgaagcgaagccgcgaggtgagcgaatgcaaaagcaatcgtagtcgattggaatctgaaacctgattcatgaagctggaatcgctagtaatcgctatcagcacgatgcggtgaatacgttcctgggccttgtacacaccgcccgtcacaccatccgagtcgaggtacccaagagctagtctaacgagggacggtggcgaaggtacgtggtaaggagggtgaagtcgtaac

SEQ ID NO: 2110 - DNA, 1405 bp, Treponema sp.
aacgaacgctggcggcgcgtcttaagcatgcaagtcggacggcaagaaggggctcgccccttcctagagtggcggactggtgagtaacgcgtggacgacgcgcccacccgacggggacagccggtagaaataccggataataccggatgatctcttttggaataaaggcgaaagaggaaagcggctccggccgcgcgggtggagcggtccgcgtcctatcagctagtcggcggggtgaaggcctgccgaggcgacgacgggtatccggcctgagagggtggacggacacattgggactgagatacggcccagactcctacgggaggcagcagctaagaatattccgcaatggggggaaccccgacggagcgacgccgcgtggacgacgaaggccggaaggttgtaaagtccttttttccgcgaggaataaggccgggagggaatgcccggccggtgacggtagcggaggaataagcaccggctaattacgtgctaacacgtaaggtgcgagcgttgttcggaattattgggcgtaaagggcatgcaggcggtcgcaagcccggcgtgaaaggggggctaactcccatgcgctgggaactgaggcttgagtttctgaagggagcggaattccacgtgtaggggtgaaatctgtagatatgtggaagaacaccaatggcgaaggcaggtcggcgaagactgacgctgaggtgcgaaggtgcggggagcaaacaggattagatccctggtagtccgcacagtcaacgatgtgcactagatgtctgtccaaggatgggtgtcaaagcaaacgcgataagtgcaccgcctggggagtatgcccgcaagggtgaaactcaaaggaattgacgggggcccgcacaagcggtggagcatgtggtttaattcgatggtacgcgaggaaccttacctgggtttgacatacacagattattagagatattaagcgcagcaatgctctgtgacaggtgctgcatggctgtcgtcagctcgtgccgtgaggtgttgggttaagtcccgcaacgagcgcaacccctactgcagttaccagcgtagggggactctggcggaactgcctgcgacaagcaggaggaaggggggatgacgtcaagtcatcatggcccttatgtccagggcacacacgtgctacaatggttgggacaagcgagcgagtgcgagagtaagcagaacgcagaaaccgatcgtagtccggattggagtctgaaactcgactccatgaagttggaatcgctagtaatcgcaatcagcacgtgcggtgaatacgttcccgggccttgtacacaccgcccgtcacaccatccgagtgggggtacccgaagccggcagtctaaccgcaagggggacgctgtcgaaggtatgcttcgtgagg

SEQ ID NO: 2111 - DNA, 1543 bp, Treponema sp.
agagtttgatcatggctcagaacgaacgctggcggcgcgtcttaagcatgcaagtcgaacggcaagagaggagcttgcttctctcctagagtggcggactggtgaggaacacgtgggtaatctacccttaagatggggatagctgctagaaatagcaggtaataccgaatatactcagtgcttcataaggggtattgaggaaaggaagctacggcttcgcttgaggatgagcttgcgtcccattagctagttggtgaggtaaaggcccaccaaggcgacgatgggtatccggcctgagagggtgatcrgacacattgggactgagatacggcccaaactcctacgggaggcagcagctaagaatattccgcaatggacggaagtctgacggagcgacgccgcgtggatgaagaaggctgaaaagttgtaaaatccttttgttgatgaagaataagggtgagagggaatgctcatctgatgacggtaatcgacgaataagccccggctaattacgtgccagcagccgcggtaacacgtaaggggcgagcgttgttcggaattattgggcgtaaagggcatgtaggcggttatgtaagcctgatgtgaaatcctggggcttaaccccagaatagcattgggtactgtgtaacttgaattacggaagggaaactggaattccaagtgtaggggtggaatctgtagatatttggaagaacaccggtggcgaaggcgggtttctggccgataattgacgctgagatgcgaaagtgtggggatcgaacaggattagataccctggtagtccacaccgtaaacgatgtacactaggtgttggggcaagagcttcagtgccaaagcaaacgcgataagtgtaccgcctggggagtatgcccgcaagggtgaaactcaaaggaattgacgggggcccgcacaagcggtggagcatgtggtttaattcgatggtacgcgaggaaccttacctgggtttgacatctagtagaaggtcttagagataaggccgggtagcaataccctgctagacaggtgctgcatggctgtcgtcagctcgtgccgtgaggtgttgggttaagtcccgcaatgagcgcaacccctactgccagttactaacaggtaaagcttgaggactctggcggaactgccgatgacaaatcggaggaaggtggggatgacgtcaagtcatcatggcccttatgtccagggctacacacgtgctacaatggttgctacaaagcgaagcaagaccgtaaggtggagcaagccgcaaaaaagcaatcgtagttcggattgaagtctgaaactcgacttcatgaagttggaatcgctagtaatcgcgcatcagcacggcgcggtgaatacgttcccgggccttgtacacaccgcccgtcacaccatccgagttgggggtacccgaagtcgcttgtctaacctgcaaaggaggacggtgccgaaggtacgcttggtaaggagggtgaagtcgtaacaaggtagccgtaccggaaggtgcggctggatcacctcctta

SEQ ID NO: 2112 - DNA, 1530 bp, Tropheryma whipplei
ttattatggagagtttgatcctggctcaggacgaacgctggcggcgtgcttaacacatgcaagtcgaacggaaatcagggagcttgctccctgtgattagtggcgaacgggtgagtaacacgtgagcaacctgcccctaactttgggataacttcgggaaaccggggctaataccaaatacgacccatgagggcatcctctgtgggtggaaagaatttcggttggggatgggctcgcggcctatcagcttgttggtggggtaacggcctaccaaggcatcgacgggtagccggcctgagagggtgatcggccacactgggactgagacacggcccagactcctacgggaggcagcagtggggaatattgcacaatgggcgcaagcctgatgcagcaacgccgcgtgggggaagaaggccttcgggttgtaaacctcttttggcagggaagaagcgaaagtgacggtacctgcagaaaaagcgccggctaactacgtgccagcagccgcggtaatacgtagggcgcgagcgttgtccggaattattgggcgtaaagagctcgtaggcggtttgtcacgtctgccgtgaaaatccgaggctcaacctcggacctgcggtgggtacgggcaggctagagtgcgataggggagagcggaattcctggtgtagcggtgaaatgcgcagatatcaggaggaacaccgatggcgaaggcagctctctgggtcgctactgacgctgaggagcgaaagcgtggggagcgaacaggattagataccctggtagtccacgccgtaaacgttgggcgctagacgtgggggtggttccaccgcttccgtgtcgcagctaacgcattaagcgccccgcctggggagtacggccgcaaggctaaaactcaagggaattgacgggggcccgcacaagcggcggagcatgcggattaattcaatgcaacgcgaagaaccttaccaaggcttgatatataccggaaaggcgtagagatacgccccccgcaaggtcggtatacaggtggtgcacggttgtcgtcagctcgtgtcgtgagatgttgggttaagtcccgcaacgagcgcaaccctcgtcctgtgttgccagcgcgtaatggcggggactcacaggagactgccggggtcaactcggaggaaggtggggatgacgtcaaatcatcatgcccttcggtcttgggcttcacgcgtgctacaatggctggtacagagggttgcaatatcgcaaggtggagcgaatctcaaaaagccagtctcagttcggattggggtctgcaactcgaccccatgaagtcggagtcgctagtaatcgcagatcagcaatgctgcggtgaatacgttcccgggccttgtacacaccgcccgtcaagtcatgaaagctggtaacacccgaagccggtgacttaaccttttttggagagagccgtcgaaggtgggattggtgattgggactaagtcgtaacaaggtagccgtaccggaaggtgcggctggatcacctcctttctaagg

SEQ ID NO: 2113 - DNA, 1323 bp, Trueperella pyogenes
  misc_feature (1119)..(1119): n is a, c, g, or t
  misc_feature (1154)..(1154): n is a, c, g, or t
  misc_feature (1237)..(1237): n is a, c, g, or t
  misc_feature (1276)..(1276): n is a, c, g, or t
  misc_feature (1279)..(1279): n is a, c, g, or t
ggcgtgcttaacacatgcaagtcgaacgatgaagccggggctttttgttttggtggattagtggcgaacgggtgagtaatacgtgagtaacctgcccttgtctttgggataagcctgggaaactgggtctaataccggatattctgcttttgccgcatggtgggggttggaaagattttttggatggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacgcaagtctgatgcagcgacgccgcgtgggggatgaaggctttcgggttgtaaactcctttcagtacagaagaagcatttttgtgacggtatgtgcagaagaagcgccggctaactacgtgccagcagccgcggtaatacgtagggcgcgagcgttgtccggaattattgggcgtaaagagctcgtaggcggtttgttgcgcctgctgtgaaagaccggggcttaacttcggggttgcagtgggtacgggcagactagagtgtggtaggggtaattggaattcctggtgtagcggtggaatgcgcagatatcaggaggaacaccgatggcgaaggcaggttactgggccattactgacgctgaggagcgaaagcgtgggtagcgaacaggattagataccctggtagtccacgctgtaaacgttgggcactaggtgtggggccttttccacgggttctgcgccgtagctaacgctttaagtgccccgcctggggagtacggccgcaaggttaaaactcaaaggaattgacgggggcccgcacaagcggcggagcatgcggattaattcgatgcaacgcgaagaaccttaccaaggcttgacatacactgcgatgtgccagagatggtgcagccttcggggtggtgtacaggtggtgcatggttgtcgtcagctcgtgtcgtgagatgttgggttaagtcccgcaacgagcgcaacccttgtcctgtgttgccagcatgttgtggtggggactcacgggagactgccggggttaactcgnaggaaggtggggatgacgtcaaatcatcatgcccnttatgtcttgggcttcacgcatgctacaatggccggtacagagggttgcgagcctgtgagggtgagctaatcccttaaagctngtctcagttcggattggggtctgcaactcgaccccatgnagncggagtcgctagtaatcgcagatcagcaacgctgcggtgaatac

SEQ ID NO: 2114 - DNA, 1486 bp, Tsukamurella paurometabola
cctggctcaggacgaacgctggcggcgtgcttaacacatgcaagtcgaacggtaaggccctttcgggggtacacgagtggcgaacgggtgagtaacacgtgggtgacctgccctgtactttgggataagcctgggaaactgggtctaataccggatatgaccttctcctgcatgggggttggtggaaagcttttgcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggacgaagcgcaagtgacggtacctacagaagaagcaccggccaactacgtgccagcagccgcggtaatacgtagggtgcaagcgttgtccggaattactgggcgtaaagagctcgtaggcggtttgtcacgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatacaccatcgccgcagagatgtggtttgccttgtgccttctatacaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggattggcgattgggacgaagtcgtaacaaggtagccgtaccggaaggtgcgg

SEQ ID NO: 2115 - DNA, 1417 bp, Tsukamurella tyrosinosolvens
ggctcaggacgaacgctggcggcgtgcttaacacatgcaagtcgaacggtaaggccctttcgggggtacacgagtggcgaacgggtgagtaacacgtgggtgacctgccctgtacttcgggataagcctgggaaactgggtctaataccggatatgaccttctcctgcatgggggttggtggaaagtttttgcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggacgaagcgcaagtgacggtacctacagaagaagcaccggccaactacgtgccagcagccgcggtaatacgtagggtgcgagcgttgtccggatttactgggcgtaaagagctcgtaggcggtttgtccgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatagaggatcgccggagagattcggtttgccttgtgccttctatacaggtggtgcatggctgtcgtcagctcgtgtcgtgagatgttgggttaagtcccgcaacgagcgcaacccttgtctcatgttgccagcacgtaatggtggggactcgtgagagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggggcctaaccccttgtgggaggga

SEQ ID NO: 2116 - DNA, 1508 bp, Turicibacter sanguinis
agagtttgatcatggctcaggatgaacgctggcggcgtgcctaatacatgcaagtcgagcgaaccacttcggtggtgagcggcgaacgggtgagtaacacgtaggttatctgcccatcagacggggacaacgattggaaacgatcgctaataccggataggacgaaagtttaaaggtgcttcggcaccactgatggatgagcctgcggcgcattagctagttggtagggtaaaggcctaccaaggcgacgatgcgtagccgacctgagagggtgaacggccacactgggactgagacacggcccagactcctacgggaggcagcagtagggaatcttcggcaatgggcgaaagcctgaccgagcaacgccgcgtgaatgatgaaggccttcgggttgtaaaattctgttataagggaagaatggctctagtaggaaatggctagagtgtgacggtaccttatgagaaagccacggctaactacgtgccagcagccgcggtaatacgtaggtggcgagcgttatccggaattattgggcgtaaagagcgcgcaggtggttgattaagtctgatgtgaaagcccacggcttaaccgtggagggtcattggaaactggtcaacttgagtgcagaagagggaagtggaattccatgtgtagcggtgaaatgcgtagagatatggaggaacaccagtggcgaaggcggcttcctggtctgtaactgacactgaggcgcgaaagcgtggggagcaaacaggattagataccctggtagtccacgccgtaaacgatgagtgctaagtgttgggggtcgaacctcagtgctgaagttaacgcattaagcactccgcctggggagtacggtcgcaagactgaaactcaaaggaattgacggggacccgcacaagcggtggagcatgtggtttaattcgaagcaacgcgaagaaccttaccaggtcttgacataccagtgaccgtcctagagataggattttcccttcggggacaatggatacaggtggtgcatggttgtcgtcagctcgtgtcgtgagatgttgggttaagtcccgcaacgagcgcaacccctgtcgttagttgccagcattcagttggggactctaacgagactgccagtgacaaactggaggaaggtggggatgacgtcaaatcatcatgccccttatgacctgggctacacacgtgctacaatggttggtacaaagagaagcgaagcggtgacgtggagcaaacctcataaagccaatctcagttcggattgtaggctgcaactcgcctacatgaagttggaatcgctagtaatcgcgaatcagcatgtcgcggtgaatacgttcccgggtcttgtacacaccgcccgtcacaccacgagagtttacaacacccgaagtcagtggcctaaccgcaaggagggagctgcctaaggtggggtagatgattggggtgaagtcgtaacaaggtatccctaccggaaggtggggttggatcacctcctt

SEQ ID NO: 2117 - DNA, 1561 bp, Ureaplasma parvum
tgttctttgaaaactaaatagaatccgtcaattttaaagagtttgatcctggctcaggattaacgctggcggcatgcctaatacatgcaaatcgaacgaagccttttaggcttagtggtgaacgggtgagtaacacgtatccaatctacccttaagttggggataactagtcgaaagattagctaataccgaataataacatcaatatcgcatgagaagatgtagaaagtcgctctttgtggcgacgcttttggatgagggtgcgacgtatcagatagttggtgaggtaatggctcaccaagtcaatgacgcgtagctgtactgagaggtagaacagccacaatgggactgagacacggcccatactcctacgggaggcagcagtagggaatttttcacaatgggcgcaagccttatgaagcaatgccgcgtgaacgatgaaggtcttatagattgtaaagttcttttatatgggaagaaacgctaaaataggaaatgattttagtttgactgtaccatttgaataagtatcggctaactatgtgccagcagccgcggtaatacataggatgcaagcgttatccggatttactgggcgtaaaacgagcgcaggcgggtttgtaagtttggtattaaatctagatgcttaacgtctagctgtatcaaaaactgtaaacctagagtgtagtagggagttggggaactccatgtggagcggtaaaatgcgtagatatatggaagaacaccggtggcgaaggcgccaacttggactatcactgacgcttaggctcgaaagtgtggggagcaaataggattagataccctagtagtccacaccgtaaacgatcatcattaaatgtcggcccgaatgggtcggtgttgtagctaacgcattaaatgatgtgcctgggtagtacattcgcaagaatgaaactcaaacggaattgacggggacccgcacaagtggtggagcatgttgcttaatttgacaatacacgtagaaccttacctaggtttgacatctattgcgatgctatagaaatatagttgaggttaacaatatgacaggtggtgcatggttgtcgtcagctcgtgtcgtgagatgttgggttaagtcccgcaacgagcgcaacccctttcgttagttacttttctagcgatactgctaccgcaaggtagaggaaggtggggatgacgtcaaatcatcatgccccttatatctagggctgcaaacgtgctacaatggctaatacaaactgctgcaaaatcgtaagatgaagcgaaacagaaaaagttagtctcagttcggatagagggctgcaattcgtcctcttgaagttggaatcactagtaatcgcgaatcagacatgtcgcggtgaatacgttctcgggtcttgtacacaccgcccgtcaaactatgggagctggtaatatctaaaaccgcaaagctaaccttttggaggcatgcgtctagggtaggatcggtgactggagttaagtcgtaacaaggtatccctacgagaacgtggggatggatcacctcctttcttcggagtaaatt

SEQ ID NO: 2118 - DNA, 1517 bp, Ureaplasma urealyticum
caattttaaagagtttgatcctggctcaggattaacgctggcggcatgcctaatacatgcaaatcgaacgaagccttttaggcttagtggtgaacgggtgagtaacacgtatccaacctacccttaagttggggataactagtcgaaagattagctaataccgaataataacatcaatatcgcatgagaagatgtagaaagtcgcgtttgcgacgcttttggatgggggtgcgacgtatcagatagttggtgaggtaatggctcaccaagtcaatgacgcgtagctgtactgagaggtagaacagccacaatgggactgagacacggcccatactcctacgggaggcagcagtagggaatttttcacaatgggcgcaagccttatgaagcaatgccgcgtgaacgatgaaggtcttatagattgtaaagttcttttatatgggaagaaacgctaagataggaaatgattttagtttgactgtaccatttgaataagtatcggctaactatgtgccagcagccgcggtaatacataggatgcaagcgttatccggatttactgggcgtaaaacgagcgcaggcgggtttgtaagtttggtattaaatctagatgcttaacgtctagctgtatcaaaaactgtaaacctagagtgtagtagggagttggggaactccatgtggagcggtaaaatgcgtagatatatggaagaacaccggtggcgaaggcgccaacttggactatcactgacgcttaggctcgaaagtgtggggagcaaataggattagataccctagtagtccacaccgtaaacgatcatcattaaatgtcggctcgaacgagtcggtgttgtagctaacgcattaaatgatgtgcctgggtagtacattcgcaagaatgaaactcaaacggaattgacggggacccgcacaagtggtggagcatgttgcttaatttgacaatacacgtagaaccttacctaggtttgacatctattgcgacgctatagaaatatagttgaggttaacaatatgacaggtggtgcatggttgtcgtcagctcgtgtcgtgagatgttgggttaagtcccgcaacgagcgcaacccctttcgttagttgcttttctagcgatactgctaccgcaaggtagaggaaggtggggatgacgtcaaatcatcatgccccttatatctagggctgcaaacgtgctacaatggctaatacaaactgctgcaaaatcgtaagatgaagcgaaacagaaaaagttagtctcagttcggatagagggctgcaattcgccctcttgaagttggaatcactagtaatcgcgaatcagacatgtcgcggtgaatacgttctcgggtcttgtacacaccgcccgtcaaactatgggagctggtaatatctaaaaccgcaaagctaaccttttggaggcatgcgtctagggtaggatcggtgactggagttaagtcgtaacaaggtatccctacgagaacgtggggatggatcacctcctttct

SEQ ID NO: 2119 - DNA, 1515 bp, Ureibacillus composti
agagtttgatcctggctcaggacgaacgctggcggcgtgcctaatacatgcaagtcgagcgaaccgattgaaagcttgctttcatgaggttagcggcggacgggtgagtaacacgtgggtaacctgccctatagactgggataactcgcggaaacgtgagctaataccggataacacatctttgcgcatgcttagatgttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagtgcagtagtaactgactgcaccctgacggtaccttactagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcaggagagggaagtggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaggtgttagggggtttccaccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggagacatggctttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaacccttcgggagccagccgccgaaggtgggacagatgattggggtgaagtcgtaacaaggtagccgta

SEQ ID NO: 2120 - DNA, 1480 bp, Ureibacillus suwonensis
ggctcaggacgaacgctggcggcgtgcctaatacatgcaagtcgagcggaccaattagaaagcttgctttttaattggttagcggcggacgggtgagtaacacgtgggtaacctgccctatagaccgggataactcgcggaaacgcgtgctaataccggataacacgccgaagcgcatgcttcggggttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagcgcagcagtcactggctgcgccctgacggtaccttactagaaagccacggctaactacgtgccagcagccgcagtaatacgtaggtggcaagcgttgtccggaattattgggcgtaaagcgcgcgcaggcggtctcttaagtctgatgtgaaagcccccggctcaaccggggagggtcattggaaactgggagacttgagtgcaggagagggaagtggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaggtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggagacatggccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggtggtacaaagggcagcgaacccgcgagggggagcgaatcccaaaaagccactctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctccgggagccagccgccgaaggtgggacagatgattgggg

SEQ ID NO: 2121 - DNA, 1489 bp, Ureibacillus terrenus
  misc_feature (382)..(382): n is a, c, g, or t
tggcggcgtgcctaatacatgcaagtcgagcggacctcataggaagcttgctttttatgaggttagcggcggacgggtgagtaacacgtgggtaacctgccctatagaccgggataactcgcggaaacgcgtgctaataccggataacacagcggagcgcatgctccggtgttgaaaggtggttctgctaccgctataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagngaagaaggtcttcggatcgtaaagctctgttgtaagggaagaacaagtgcggtagtaactgaccgcaccctgacggtaccttacgagaaagccacggctaactacgtgccagcagccgcggtaatacgtaggtggcgagcgttgtccggaattattgggcgtaaagcgcgcgcaggcggtctcttaagtctgatgtgaaagcccccggctcaaccggggagggtcattggaaactgggagacttgagtgcaggagagggaagcggaattccatgtgtagcggtgaaatgcgtagagatatggaggaacaccagtggcgaaggcggcttcctggcctgtaactgacgctgaagcgcgaaagcgtggggaccaaacaggattagataccctggtagtccacgccgtaaacgatgagtgctaagtgttagggggcttgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgccatggagacatggccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaacccttccgggagccagccgccgaaggtgggacagatgattggggtgaagtcgtaacaaggtagccgtatc

SEQ ID NO: 2122 - DNA, 1509 bp, Ureibacillus thermophilus
agagtttgatccctgctcaggacgaacgctggcggcgtgcctaatacatgcaagtcgagcggaccaattaagaagcttgctttttgattggttagcggcggacgggtgagtaacacgtgggtaacctgccctatagacygggataactcgcggaaacgcgagctaataccggataacacatcgaagcgcatgcttcgatgttgaaagatggttctgctatcactataggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagcgcagcagtaactggctgcgccctgacggtaccttactagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgagtgcaggagagggaagtggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaggtgttagggggtttccaccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcagatcagcatgctgcggtgaatacgttcccgggccttgtacacaccgcccgtcacaccacgagagtctgtaacacccgaagtcggtgaggtaaccctccgggagccagccgccgaaggtgggacagatgattggggtgaagtcgtaacaagg

SEQ ID NO: 2123 - DNA, 1540 bp, Ureibacillus thermosphaericus
tagagtttgatcatggctcaggacgaacgctggcggcgtgcctaatacatgcaagtcgagcgaaccaattgaaagcctagctttcatgaggttagcggcggacgggtgagtaacacgtgggtaacctgccctatagactgggataactcgcggaaacgcgtgctaataccggataacacatcaaagtgcatgctttgatgttgaaagatggttctgctatcactataggatgggcccgcggcgcattagcttgttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagtgcagtagtaactggctgcaccttgacggtaccttactagaaagccacggctaactacgtgccagcagccgcggtaatacgtaggtggcaagcgttgtccggaattattgggcgtaaagcgcgcgcaggcggtctcttaagtctgatgtgaaagcccccggcttaaccggggagggtcattggaaactgggagacttgagtgcaggagagggaagcggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaagtgttagggggtttccaccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatggacggtacaaacggtcgcgaagtcgcgagacggagccaatccgaaaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctttcgggagccagccgccgaaggtgggacagatgattggggtgaagtcgtaacaaggtagccgtatcggaaggtgcggctggatcac

SEQ ID NO: 2124 - DNA, 1469 bp, Vagococcus fluvialis
acgaacgctggcggcgtgcctaatacatgcaagtcgaacgctttgattttcaccggagcttgctccaccgaaaatcaaagagtggcggacgggtgagtaacacgtgggcaacctgcccaacagagggggataacacttggaaacaggtgctaataccgcataatttgttttcccgcatgggagaataataaaagacgcttcggtgtcactgttggatgggcccgcgctgcattagttagttggtggggtaatggcctaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagccctcggctcaaccgaggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacggtacaatgagtcgcgagaccgcgaggtttagctaatctcttaaagccgttctcagttcggattgtaggctgcaactcgcctacatgaagccggaatcgctagtaatcgtggatcagcacgccacggtgaatacgttcccgggccttgtacacaccgcccgtcacaccacgagagtttgtaacacccaaagtcggtgaggtaaccttttggagccagccgcctaaggtgggatagat

SEQ ID NO: 2125 - DNA, 1562 bp, Veillonella atypica
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 2126 - DNA, 1562 bp, Veillonella dispar
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggattacctcctttct

SEQ ID NO: 2127 - DNA, 1296 bp, Veillonella genomosp.
gacgaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcgatgatcagtagccggtctgagaggatgaacggccacattgggactgagacacggcccagactcctacgggaggcagcagttgggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctatgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctacacacgtactacaatgggagttagacggaagcgaaaccgcgaggtggagcagacccgagactctctcagttcggatgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggtaaagtcgatgattggggtg

SEQ ID NO: 2128 - DNA, 1409 bp, Veillonella montpellierensis
gagcacgggagcttgctcctatgaatcttagtggcgaacgggtgagtaacgcgtaatcaacctgccctacaatgggggacaacagttggaaacgactgctaataccgcatacgacctacggttggcatcaatcgtaggtgaaaggtggcctctacatgtaagctatcgttgtaggaggggattgcgtctgattagctagttggaggggtaacggcccaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgacggtcttcggattgtaaagctctgttaatcgggacgaatggtttgtgtgcaaatagtgcatagacatgacggtaccggaatagaaagccacggctaactacgtgccagcagccgcggtaatacgtaggtggcaagcgttgtccggaattattgggcgtaaagcgcgcgcaggcggactagccagtcagtcttaaaagttcggggcttaaccccgtgatgggattgaaactactagtctagagtatcggagaggaaagtggaattcctagtgtagcggtgaaatgcgtagatattaggaagaacaccagtggcgaaggcgactttctggacgaacactgacgctgaggcgcgaaagccaggggagcgaacgggattagataccccggtagtcctggccgtaaacgatgggtactaagtgtgggaggtatcgaccccttccgtgctgcagttaacgcaataagtaccccgcctggggagtacggtcgcaagactgaaactcaaaggaattgacgggggcccgcacaagcggtggagtatgtggtttaattcgacgcaacgcgaagaaccttaccaggtcttgacattgatggacagaactagagatagtttttcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaataaagagaagcgaaaccgcgaggtggagcgaacctcacaaacactctctcagttcggattgcaggctgcaactcgcctgcatgaagtcggaatcgctagtaatcgcaggtcagcatactgcggtgaatacgttcccgggccttgtacacaccgcccgtcacaccacgaaagtcggaagtacccaaagccggtggggtaaccttcgggagc

SEQ ID NO: 2129 - DNA, 1564 bp, Veillonella parvula
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcaggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 2130 - DNA, 1564 bp, Veillonella sp.
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaaaggtggggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 2131 - DNA, 1562 bp, Veillonella sp.
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 2132 - DNA, 1264 bp, Veillonella sp.
ggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctacacacgtactacaatgggagttagacggaagcgaaaccgcgaggtggagcaaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaa

SEQ ID NO: 2133 - DNA, 1209 bp, Veillonella sp.
agtggcgaacgggtgagtaacgcgtaatcaacctgcccttcagagggggacaacagttggaaacgactgctaataccgcatacggaaagtcactgaaggaggggattgcgtctgatcagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccttatcttatgttgccagcacgtggggactcatgagagactgccgcagacaatgcggaggaaggcggggatgacgtcaaatcatcatgccccttatgacctgggctacacacgtactacaatgggagttagacggaagcgaagccgcgaggtggagcgaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtacccaaa

SEQ ID NO: 2134 - DNA, 1466 bp, Veillonella sp.
cctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaattcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagc

SEQ ID NO: 2135 - DNA, 1460 bp, Veillonella sp.
acgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtct

SEQ ID NO: 2136 - DNA, 1405 bp, Veillonella sp.
cttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctgacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcc

SEQ ID NO: 2137 - DNA, 1344 bp, Veillonella sp.
cgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgcgaatagttagaggaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtgg

SEQ ID NO: 2138 - DNA, 1441 bp, Veillonella sp.
  misc_feature (9)..(9): n is a, c, g, or t
  misc_feature (150)..(150): n is a, c, g, or t
tcgcgtctnccatgcagtcgaaacgaagagcgatggtaagcttgcttctatcaatcttagtggcgaacgggtgagtaacgcgtaatcaaccctgcccttcagagggggacaacagttggaaacgactgctaataccgcatacgatccaanctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaagaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcggagccgc

SEQ ID NO: 2139 - DNA, 1364 bp, Veillonella sp.
  misc_feature (12)..(12): n is a, c, g, or t
  misc_feature (445)..(445): n is a, c, g, or t
  misc_feature (728)..(728): n is a, c, g, or t
  misc_feature (815)..(815): n is a, c, g, or t
  misc_feature (1340)..(1340): n is a, c, g, or t
  misc_feature (1344)..(1344): n is a, c, g, or t
ggagtttgattntggctcaggacgaacgctggcggcgtgcttaacacatgcaagtcgaacgagtggcgaacgggtgagtaacgcgtaatcaacctgcccttcagagggggataacaacgggaaaccgttgctaataccgcgtacggaaagtcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgatgacggtaccggaatagaaagccacggctaactacgtgccagcagccgcggtaatacgtangtggcaagcgttgtccgaaattattgggcgtaaagcgcgcgcagccggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaactgacgctgaggcgcgaaagcaaggcgagcgaacgggattagataccccggtagtccttgccgtaaacgatgggtantaggtgtaggagcttctgtgccggagttaacgcaataataccccgcctggggagtacggtcgcaaggctgaaactcaaaggaattgncgggggcccgcacaagcggtggagtacgtggtttaattcgacgcaacgcgaagaaccttaccaggtcttgacattaacaggtggtgcacggctgtcgtcagctcgtgtcgtgagatgttgggttaagtcccgcaacgagcgcaacccctatcttatgttgccagcacgtgggaactcatgagagactgccgcagacaatgcggaggaaggaggggatgacgtcaagtcatcatgccccttatgacctgggctacacacgtactacaatgggctttagaggggagcgaagccgcgaggtggagcaaaccccagagctctcagttcggaagtaggctgcaactcgcctacggaagtcggaatcgctagtaatcacaggtcagcatactgcggtgaatacgttcccgggccttgtacacaccgcccgtcacacaacgaaagtcggaagtacccaaagccggtgggtagccagccgtctaaggtaaagtcgatgattggggtgaagtcgtaacaaggtagccgtatcgnaagntgcggctggaacacctcctt

SEQ ID NO: 2140 - DNA, 1323 bp, Veillonella sp.
  misc_feature (667)..(667): n is a, c, g, or t
  misc_feature (676)..(676): n is a, c, g, or t
  misc_feature (714)..(714): n is a, c, g, or t
  misc_feature (720)..(720): n is a, c, g, or t
  misc_feature (792)..(792): n is a, c, g, or t
  misc_feature (803)..(803): n is a, c, g, or t
ggagtttgattctggctcaggacgaacgctggcggcgtgcttaacacatgcaagtcgaacgagtggcgaacgggtgagtaacgcgtaatcaacctgcccttcagagggggataacaacgggaaaccgttgctaataccgcgtacggaaagtcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggaacaacgccgcgtgagtgatgaaggtctgcggattgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactactaggctagagtatcggagaggaaagcggaattcctagtgtagcggtgaaatgcgtagatattaggaagaacaccagtggcgaaggcggctttctggacgaactgacgctgaggcgcnaaagccagnggagcgaacgggattagataccccggtagtcctggccntaaacnatgggtactaggtgtaggagcttctgtgccggagttaacgcaataagtaccccgcctggggagtacggtcgnaaggctgaaantcaaaggaattgacgggggcccgcacaagcggtggagtatgtggtttaattcgacgcaacgcgaagaaccttaccaggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaagtcatcatgccccttatgacctgggctacacacgtactacaatgggctttagagggaagcgaagccgcgaggtggagcaaaccccagagctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtacccaaagccggtgggtagccagccgtctaaggtaaagtcgatgattggggtgaagtcgta

SEQ ID NO: 2141 - DNA, 1363 bp, Veillonella sp.
  misc_feature (360)..(360): n is a, c, g, or t
ggagtttgattatggctcaggactaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggtgcaacgccgcgtgagtgatgacggccttcgggtngtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccgggtcttgacattaacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggagaggatgacgtcaaatcatcatgccccttatgacctgggctacacacgtactacaatgggagttagacggaagcgagatcgcgagatggagcaaacccgagactctctcagttcggacgtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggtaaagtcgatgattggggtgaagtcgtaacaaggtagccgtatcggaaggtgcggctggaacacctc

SEQ ID NO: 2142 - DNA, 1296 bp, Veillonella sp.
  misc_feature (1102)..(1102): n is a, c, g, or t
  misc_feature (1143)..(1143): n is a, c, g, or t
ggagtttgattctggctcaggacgaacgctggcggcgtgcttaacacatgcaagtcgaacgagtggcgaacgggtgagtaacgcgtaatcaacctgcccttcagagggggacaacagttggaaacgactgctaataccgcatacggaaagtcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgatgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgttgatgggatggaaactgctgatctagagtatcggagaggaaagtggaattcctagtgtagcggtgaaattcgtagatattaggaagaacaccagtggcgaaggcgactttctggacgaactgacgctgaggcgcgaaagccaggggagcgaacgggattagataccccggtagtcctggccgtaaacgatgggtactaggtgtaggagcttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacatcacaggtggtgcacggttgtcgtcagctcgtgtcgtgagatgttgggttaagtcccgcaacgagcgcaacccctatcttatgttgccagcacgtgggaactcatgagagactgccgcagacaatgcggaggaaggcggggatgacgtcaaatcatcatgccccttatgacctgggctactcacgtactacaatgggatagacggaagcganatcgcgagatggagcaaacccgagactctctcagttcggangtaggctgcaactcgcctacggaagtcggaatcgctagtaatcgcaggtcagcatactgcggtgaatacgttcccgggccttgtacacaccgcccgtcacaccacgaaagtcggaagtgcccaaagccggtgggtagccagccgtctaaggta

SEQ ID NO: 2143 - DNA, 1464 bp, Veillonella sp.
  misc_feature (2)..(2): n is a, c, g, or t
  misc_feature (7)..(7): n is a, c, g, or t
antcgancgaagagcgatggaagcttgcttctatcagtcttagtggcgaacgggtgagtaacgcgtaatcaacctgcccttcagagggggacaacagttggaaacgactgctaataccgcatacgatctaacctcggcattcaggatagatgaaaggtggcctctatttttaagctatcactgaaggaggggattgcgtctgatatgcgatagtgaggggggacggggccccccggcggatgaccagtgccggtttgagaggatgaacggccaccattggactgagacacggcccagactcctacgggaggcagcagtggggaatcttccgcaatggacgaaagtctgacggagcaacgccgcgtgagtgatgacggccttcgggtttaaagcttcgttaatcgggaagaaagggcctctgcgcgaacagtgagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgagtgaaagggcaagagattgtccccttatcttcggataacacgaaaacaggtggtgcatggttgtcgtcagctcgtgtcgtgagatgttgggttaagtcccgcaacgagcgcaacccctatcttatgttgccagcacttcgggtgggaactcatgagagactgccgcagacaatgcagaggaaggcggggatgacgtcaaatcatcatgccccttatgacctgggctacacacgtactacaatgggagttaatagacggaagcgagatcgcgagatggagcaaacccgagaaacactctttcagttcggatggtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggaaaagtcgtaa

SEQ ID NO: 2144 - DNA, 1563 bp, Veillonella sp.
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaagaattgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttct

SEQ ID NO: 2145 - DNA, 1229 bp, Veillonellaceae bacterium
gacgaacgctggcggcgtgcttaacacatgcaagtcgaacgagacggattgggagcttgctcctgacaagtcgagtggcaaacgggtgagtaacgcgtagacaacctgccgcaaagatggggacaacagcccgaaagggctgctaataccgaatgttgcgcccctcccgcatgggaggggcgccaaagatggcctctgcctgcaagccatcgctttgcgatgggtcctgcgccttattagccagttggcggggcaacggcccaccaaggcgacgatcagtagccggtcctgagaggatggacggccacattgggactgagacacggcccagactcctacgggaggcagcagtggggaatcttccgcaatgggcgaaagcctgacggagcaacgccgcgtgggtgaagaaggtcttcggatgcgtaaagccctgttgcccgggacgaacgcccccggcgcgaacagcgccggggggtgacggtaccgggcgaggaagccacggccaactacgtgccagcagccgcggtaatacgtaggtggcgagcgttgtccggaatcattgggcgtaaagggagcgcaggcgggcatgcaagtccatcttaaaagcgcggggcccaaccccgcgaggggatggaaactgcatgccttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatgaatgctaggtgtggggggtatcgacccctcccgtgccggagtcaacgcaataagcattccgcctggggagtacggccgcaaggctgagactcaaaggaattgacgggggcccgcacaagcggtggagtatgtggttcaattcgacgcatggcgaaggaaccttaccagggccttgacattgagtgacacgggccggagacggcccccctcccctcgggggacacggaaaacagggtggtgcagtggctgtcgtcagcctcgttgtcgtgagatgtggggtcaagatcccgccaccgagcgccaccccccgttccctcgttggccagcgacgcacagggcggggaacccaagggaagaccgccgccggactacgccgaggaaggcgggggacgacgttcagttattcatgcccc

SEQ ID NO: 2146 - DNA, 1511 bp, Veillonellaceae bacterium
gagtttgatcctggctcaggacgaacgctggcggcgtgcttaacacatgcaagtcgaacggagctgatttatttcggtaaatcgcttagtggcaaacgggtgagtaacgcgtaggcaacctgccctcaggatggggacaacggctcgaaagagccgctaataccgaatgacgtaactcttccacatggaagagatactaaagatgggtcaaaccatcgcctaaggatgggcctgcgtctgattagccagttggtgaggtaacggctcaccaaagcgacgatcagtagccggtctgagaggatgaacggccacaatgggactgagacacggcccatactcctacgggaggcagcagtggggaatcttccgcaatgggcgaaagcctgacggagcaacgccgcgtgagtgaagaaggtcttcggatcgtaaagctctgttgtcggggacgaaagagtagacgaggaaatgcgtctactaagacggtacccgacgaggaagccacggctaactacgtgccagcagccgcggtaatacgtaggcggcaagcgttgtccggaattattgggcgtaaagggagcgcaggtgggacggtaagtccgtcttaaaaggcaggggctcagcccctgtaagggatggaaactatcgatcttgagtgccggagaggaaagcggaattcccagtgtagcggtgaaatgcgtagatattgggaagaacaccagtggcgaaggcggctttctggacggcaactgacactgaggctcgaaagccaggggagcgaacgggattagataccccggtagtcctggccgtaaacgatggatactaggtgtaggaggtatcgacccctcctgtgccggagttaacgcaataagtatcccgcctggggagtacggtcgcaagactgaaactcaaaggaattgacgggggcccgcacaagcggtggagtatgtggtttaattcgacgcaacgcgaagaaccttaccagggcttgacattgagtgaaagggcaagagattgtccccttatcttcggataacacgaaaacaggtggtgcatggctgtcgtcagctcgtgtcgtgagatgttgggttaagtcccgcaacgagcgcaacccctatattctgttgccaacaggtaaagctgggaactcaggatagactgccgcggagaacgcggaggaaggcggggatgacgtcaagtcatcatgccccatatgacctgggctacacacgtactacaatgggatgtacagagggcagcgaaagagcgatctggagcgaaccccagaaaacatctcccagttcggattgcaggctgaaacccgcctgcatgaagatggaatcgctagtaatcgcaggtcagcatactgcggtgaatacgttcccgggccttgtacacaccgcccgtcacaccacggaagtcattcacacccgaagccggtgaaagccgtcgaaggtgggggcgatgactggggtgaagtcgtaacaaggtagccgtatcggaaggtgcgg

SEQ ID NO: 2147 - DNA, 1467 bp, Victivallaceae bacterium
tcagaacgaacgctggcggcatggattaggcatgcaagttgaacgaaccacttcggtggagagtagcggaagggtgaggaacgcgtgagtaatctgccccctagttgggaataacagttggaaacgactgctaataccgaatgtggcttcaatcctgcatgggatggaggctaaagatttatcgctaggggatgagctcgcgtcccattaggtagttggtgaggtaacggcccaccaagccgacgatgggtagctggtctgagaggatggtcagccacactgggactgagacactgcccagactcctacgggaggctgcagtcgagaatcttgggcaatgcgcgaaagcgtgacccagcaatgccgcgtgtgtgatgaaggccttcgggtcgtaaagcactgtctcccgtgacgaaatttgacggtagcggggaaggaagccacggctaactacgtgccagcagccgcggtaatacgtaggtggcgagcgttgttcggatttattgggcgtaaagggtctgtaggaggttcgttaaatacgaggtgaaatcccgaagctcaacttcggaactgccttgtagactgacggactagagtaccggagaggtaagcggaataccaggtgtagcggtggaatgcgtagatatctggtagaacaccaatagcgaaggcagcttgctggacggaaactgactctgaaagacgaaagcatggggagcaaacaggattagataccctggtagtccatgccgtaaacgttgtcaacttgatgtggggggatttagtcctctccgtatcgaagctaacgcgataagttgaccgcctggggactacggccgcaaggctaaaactcaaaggaattgacgggggcccgcacaagcggtggagcatgtggcttaattcgaggcaacgcgaagaaccttacctggtcttgaaatatatcggaccgcctgtgaaagcaggcttcccttcggggctgatatacaggtgctgcatggctgtcgtcagctcgtgccgtgaggtgttcggttaagtccggcaacgagcgcaacccgtgtcactagttgccatcaagtaatgttggggactctagtgagactgcctgtgttaagcaggaggaaggcgcggatgacgtcaagtcagtatggcccttacgaccagggctgcacacgtgctacaatggggggtacaatgggatgcaatgtcgcgaggcggagcaaatccacaaaacctctcttagttcagattgcagtctgcaactcgactgcatgaagttggaatcgctagtaaaggcgtatcagctacgacgccttgaatacgttcccgggccttgtacacaccgcccgtcacatcatgggagttgactgcacccgaaatcggtgatctaacctgcaaaggaagaagccgcctaaggtgtggtcgatgactgggatgaagtcgtaacaaggtagccgtaggggaacctgc

SEQ ID NO: 2148 - DNA, 1496 bp, Victivallis vadensis
agagtttgatcctggctcagaacgaacgctggcggcatggattaggcatgcaagttgaacgaactccttcgggagtgagtagcgaaagggtgaggaacgcgtgagtaatctgcccataagttgggaacaacagttggaaacgactgctaataccgaatgtggctattgacccgcatgggtttttggctaaagatttatcgcttatggatgagctcgcgtcccattagctagttggtgaggtaacggcccaccaaggctacgatgggtagctggtctgagaggatggtcagccacactgggactgagacactgcccagactcctacgggaggctgcagtcgagaatcttgggcaatgcgcgaaagcgtgacccagcaatgccgcgtgcatgatgaaggccctcgggtcgtaaaatgctgtctcccgtgacgaataatgacggtagcggggaaggaagccacggctaactacgtgccagcagccgcggtaatacgtaggtggcgagcgttgttcggatttattgggcgtaaagggtctgtaggaggtttgttaaatacgaggtgaaatccgggggctcaacttccgaattgccttgtagactgatgaactagagtactggagaggtaagcggaataccaggtgtagcggtggaatgcgtagatatctggtagaacaccaatagcgaaggcagcttgctggacagaaactgactctgaaagacgaaagcatggggagcaaacaggattagataccctggtagtccatgccgtaaacgttgtcaacttgatgtgggcggatttagtcctgtccgtatcgaagctaacgcgataagttgaccgcctgggaactacggccgcaaggctaaaactcaaaggaattgacgggggcccgcacaagcggtggagcatgtggcttaattcgaggcaacgcgaagaaccttacctgggcttgaaatataccggaccggctgtgaaagcagtcttctcttcggagctggtatacaggtgctgcatggctgtcgtcagctcgtgccgtgaggtgttcggttaagtccggcaacgagcgcaacccgtgtcattagttgccaacaggtaatgctggggactctaatgagactgcctgtgttaagcaggaggaaggcgcggatgacgtcaagtcagtatggcccttacgcccagggctgcacacgtgctacaatggggggtacaatgagaagcgaagtcgcgaggcggagcaaatctacaaaacctctcttagttcagattgcagtctgcaactcgactgcatgaagttggaatcgctagtaaatgcgtatcagctacgacgcattgaatacgttcccgggccttgtacacaccgcccgtcacatcatgggagttgattgcacccgaaatcggtgatctaacctgcaaaggaagaagccgcctaaggtgtggtcgatgactgggatgaagtcgtaacaaggtagccgtaggggaacctgcggctggatcacct

SEQ ID NO: 2149 - DNA, 1506 bp, Virgibacillus proomii
gcggcgtgcctaatacatgcaagtcgagcgcgggaagcaagcagaaccccttcgggggtgacgcatgtggaacgagcggcggacgggtgagtaacacgtgggcaacctgcctgtaagactgggataactccgggaaaccggggctaataccggataatacgttttcttgcataaggagacgttaaaaggcggcgcaagctgtcacttacagatgggcccgcggcgcattagctagttggtggggtaaaagcctaccaaggcgacgatgcgtagccgacctgagagggtgatcggccacactgggactgagacacrgcccagactcctacgggaggcagcagtagggaatcttccgcaatggacgaaagtctgacggagcaacgccgcgtgagtgaagaaggttttcggatcgtaaaactctgttgttagggaagaacaagtgccgttcaaatagggcggcaccttgacggtacctaaccagaaagccccggctaactacgtgccagcagccgcggtaatacgtagggggcaagcgttgtccggaattattgggcgtaaagcgcgcgcaggcggtcttttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacggccctagagatagggagttcccttcggggacagagtgacaggtggtgcatggttgtcgtcagctcgtgtcgtgagatgttgggttaagtcccgcaacragcgcaacccttgatcttarttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgtgaggccaagcaaatcccacaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccgtaaggagccagccgccgaaggtgggaccaatgattggggtgaagtcgtaacaaggtasccgtatcggaagg

SEQ ID NO: 2150 - DNA, 1483 bp, Weissella beninensis
gcctggcggcgtgcctaatacatgcaagtcgaacgcattgtcgtggttatgatttgttaagcttgcttaacattgattaatcgccatacaatgagtggcgaacgggtgagtaacacgtgggaaacctacctcttagcaggggataacatttggaaacagatgctaataccgtataacaaataaaaccgcatggttttattttaaaagatggttctgctatcactaagagatggtcccgcggtgtattagctagatggtgaggtaatggctcaccatggcaatgatacatagccgagttgagagactgatcggccacattggaactgagacacggtccaaactcctacgggaggcagcagtagggaatcttccacaatgggcgcaagcctgatggagcaacgccgcgtgtgtgatgaagggtttcggctcgtaaaacactgttataagagaagaacgtcagtgagagtaactgttcattgagtgacggtatcttatcagaaagggacggctaaatacgtgccagcagccgcggtaatacgtatgtcccaagcgttatccggatttattgggcgtaaagcgagcgcaggcggttatttaagtctgatgtgaaagcctacggctcaaccgtagaattgcatcggaaactggatgacttgagtgcagtagaggagagtggaactccatgtgtagcggtgaaatgcgtagatatatggaagaacaccagaggcgaaggcggctctctggactgtaactgacgctgaggctcgaaagtgtgggtagcaaacaggattagataccctggtagtccacaccgtaaacgatgaatgctagttgttagagggtttccgccctttagtgacgcagctaacgcagtaagcattccgcctggggagtacgaccgcaaggttgaaactcaaaggaattgacgggggcccgcacaagcggtggagcatgtggtttaattcgaagcaacgcgaagaaccttaccaggtcttgacatctttcgctatcttaagagattaagagttcccttcggggacggaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggatggtacaacgagtcgcaaagtcgcgaggctaagctaatctcttaaagccattctcagttcggattgtagtctgcaactcgactacatgaagtcggaatcgctagtaatcgcggatcagcacgccgcggtgaatacgttcccgggccttgtacacaccgcccgtcacaccatgagagtttgtaacacccaaagtcggtggggtaaccttttaggagccagccgcctaaggtgggataga

SEQ ID NO: 2151 - DNA, 1529 bp, Weissella cibaria
gatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatagcaaccgcatggttgctacttaaaagatggttctgctatcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcrtcagctcgtgtcgtgagatgttgggttaagtcccgcaacragcgcaacccttattactagttgccagcattyagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacc

SEQ ID NO: 2152 - DNA, 1477 bp, Weissella confusa
ggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatgacaaccgcatggttgttatttaaaagatggttctgctatcactaagagatggtcccgcggtgcattagctagttggtaaggtaatggcttaccaaggcgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacag

SEQ ID NO: 2153 - DNA, 1496 bp, Weissella hellenica
gatgaacgctggcggcgtgcctaatacatgcaagtcgaacgctttgtgcttaattgatatgacgagcttgctctgatttgattttttgatttcaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaatggcttaccaaggcaatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacggcactgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaacgctagaaatagcgcgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgataaaccggaggaaggtggggatgacgtcaaatcatcatgccccttatgacctgggctacacacgtgctacaatggcatatacaacgagtcgctaacccgcgagggtacgctaatctcttaaagtatgtctcagttcggattgtaggctgcaactcgcctacatgaagtcggaatcgctagtaatcgcggatcagaacgccgcggtgaatacgttcccgggtcttgtacacaccgcccgtcacaccatgagagtttgtaacacccaaagccggtggggtaaccttttaggagccagccgtctaaggtgggacagatgattaggg

SEQ ID NO: 2154 - DNA, 1528 bp, Weissella kandleri
  misc_feature (1)..(2): n is a, c, g, or t
  misc_feature (163)..(163): n is a, c, g, or t
  misc_feature (273)..(273): n is a, c, g, or t
  misc_feature (372)..(372): n is a, c, g, or t
  misc_feature (388)..(388): n is a, c, g, or t
  misc_feature (440)..(440): n is a, c, g, or t
  misc_feature (583)..(583): n is a, c, g, or t
  misc_feature (665)..(666): n is a, c, g, or t
  misc_feature (802)..(803): n is a, c, g, or t
  misc_feature (970)..(970): n is a, c, g, or t
  misc_feature (1005)..(1005): n is a, c, g, or t
  misc_feature (1060)..(1060): n is a, c, g, or t
  misc_feature (1090)..(1090): n is a, c, g, or t
  misc_feature (1137)..(1137): n is a, c, g, or t
  misc_feature (1425)..(1425): n is a, c, g, or t
  misc_feature (1524)..(1524): n is a, c, g, or t
nntaaattgagagtttgatcctggctcaggatgaacgctggcggcgtgcctaatacatgcaagtcgaacgcactgtggttgaaatgagatgagaagcttgcttcaagtcaaatgccaacattgcagtgagtggcgaacgggtgagtaacacgtgggaaacctncctcttagcaggggataacatctggaaacaggtgctaataccgtataacaataaaaaccgcatggttttgatttaaaagatggttctgctatcactaagagatggtcccncggtgcattagttagttggtgaggtaaaggctcaccaagacgatgatgcatagccgagttgagagactgatcggccacaatgggactgagacacggccnatactcctacgggagncagcagtagggaatcttccacaatggacgaaagtctgatggagcaacgccgngtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccnagcgttatccggatttattgggcgtaaagcgagcgcagacggttatttaagtctgaagtgaaagccctcggcttaaccgagnnattgctttggaaactggataacttgagtgcagtagaggaaagtggaactccatgtgtagcggtgaaatgcgtagatatatggaagaacaccagtggcgaaggcggctttctggactgtaactgacgttgaggctcnnaagtgtgggtagcaaacaggattagataccctggtagtccacaccgtaaacgatgagtgctagctgttcgagggtttccgcccttgagtggcgaagctaacgcattaagcactccgcctggggagtacgaccgcaaggttgaaactcaaaggaattgacggggaccngcacaagcggtggagcatgtggtttaattcgaagnaacgcgaagaaccttaccaggtcttgacatcctttgaccactccagagatggagntttcccttcggggtcaaagtgacaggtggngcatggttgtcgtcagctcgtgtcgtgagatgttgggttaagtcccncaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagcagccaacccgcgagggtgcgcaaatctcttaaagcttgtctcagttcggactgtaggctgcaactcgcctacacgaagtcggaatcgctagtaatcgcggatcagcacgccgcggtgaatacgttcccgggncttgtacacaccgcccgtcacaccatgagagtttgtaacacccaaagtcggtgaggtaacctttataggggccagccgcctaaggtgggacagatgatnaggg

SEQ ID NO: 2155 - DNA, 1591 bp, Weissella koreensis
tttaaattgagagtttgatcctggctcaggatgaacgctggcggcgtgcctaatacatgcaagtcgaacgcattgtggttgaaatgatatgaagaacttgttcagatttgattttcaacattgcaatgagtggcgaacgggtgagtaacacgtgggaaacctacctcttagcaggggataacatttggaaacaaatgctaataccgtataataattaaaaccgcatggttttagtttaaaagatggtcttgctatcactaagagatggtcccgcggtgtattagttagttggtgaggtaatggctcaccaagacaatgatacatagccgagttgagagactgaccggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcggctcaaccgaggaattgctttggaaactggataacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacactgtaaacgatgagtgctagttgttcgagggtttccgcccttgagtgacgaagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactccagagatggagctttcccttcggggacaaagtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagtcgccaacccgcgagggtgcgcaaatctcttaaagcttgtctcagttcggactgtaggctgcaactcgcctacacgaagtcggaatcgctagtaatcgcggatcagcacgccgcggtgaatacgttcccgggtcttgtacacaccgcccgtcacaccatgagagtttgtaacacccaaagtcggtgaggtaaccttttattaggagccagccgcctaaggtgggacagatgattagggtgaagtcgtaacaaggtagccgtaggagaacctgcggctggatcacctcctttctaaggaa

SEQ ID NO: 2156 - DNA, 1579 bp, Weissella paramesenteroides
tttaaaatgagagtttgatcctggctcaggatgaacgctggcggcgtgcctaatacatgcaagtcgaacgctttgtctttaactgatatgaagagcttgctctgatttgattttatctgacaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaacggcttaccaaggcaatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacggcactgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaatggctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgctaatcctagaaataggacgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgacaaaccggaggaaggtggggatgacgtcaaatcatcatgccccttatgacctgggctacacacgtgctacaatggcatatacaacgagtcgccaacccgcgagggtgcgctaatctcttaaagtatgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctggatcacctcctttct

SEQ ID NO: 2157 - DNA, 1234 bp, Weissella sp.
agtggcgaacgggtgagtaacacgtgggaaacctacctcttagcaggggataacatttggaaacagatgctaataccgtataacaaaagtcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagatgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgactgacgttgaggctcgaaagtgtgggtagcaaacaggattagataccctggtagtccacaccgtaaacgatgagtgctaggtgtttgagcttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcgacaggtggtgcatggttgtcgtcagctcgtgtcgtgagatgttgggttaagtcccgcaacgagcgcaacccttattactagttgccagcatgggcactctagtgagactgccggtgacaaaccggaggaaggtggggatgacgtcaaatcatcatgccccttatgacctgggctacacacgtgctacaatggcgtacaacgagttgccaacccgcgagggtgagctaatctctttacgtctcagttcggatgtaggctgcaactcgcctacagaagtcggaatcgctagtaatcgcggatcagcacgccgcggtgaatacgttcccgggtcttgtacacaccgcccgtcacaccatgagagtttgtaacacccaaagccggtgggtagccagccgtctaagg

SEQ ID NO: 2158 - DNA, 1480 bp, Wolinella succinogenes
agagtttgatcctggctcagagtgaacgctggcggcgtgcctaatacatgcaagtcgaacggtaacagggtgtagcttgctatactgctgacgagtggcgcacgggtgagtaatgcataggttatgtgccccatagtctggaatagccactggaaacggtgattaataccggatattcccgagaggggaaagtttttcgctatgggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggcgaaagcctgaagcagcaacgccgcgtggaggatgaaggtcttcggattgtaaactccttttctaagagaagattatgacggtatcttaggaataagcaccggctaactccgtgccagcagccgcggtaatacggagggtgcaagcgttactcggaatcactgggcgtaaagagcacgtaggcggccttgcaagtcagatgtgaaatccaacggcttaaccgttgaactgcatttgaaactgcaaggctagagtatgggagaggtaggtggaattctcggtgtaggggtaaaatccgtagagatcgagaggaatactcattgcgaaggcgacctgctggaacattactgacgctgaggtgcgaaagcgtggggagcaaacaggattagataccctggtagtccacgccctaaacgatgaatgctagttgttgccctgcttgtcagggcagtaatgcagttaacacattaagcattccgcctggggagtacggtcgcaagattaaaactcaaaggaatagacggggacccgcacaagcggtggagcatgtggtttaattcgaagatacgcgaagaaccttacctgggcttgacattgatagaatcctatagagatatgggagtgccagtttactggagcttgaaaacaggtgctgcacggctgtcgtcagctcgtgtcgtgagatgttgggttaagtcccgcaacgagcgcaaccctcgtcactagttgctaacggttcggccgagcactctagtgagactgccttcgcaaggaggaggaaggtgaggacgacgtcaagtcatcatggcccttacgcccagggctacacacgtgctacaatggtgtgtacaaagagaagcaataccgcgaggtggagcaaatctttaaaacacatctcagttcggattgtagtctgcaactcgactacatgaagctggaatcgctagtaatcgtagatcagcaatgctacggtgaatacgttcccgggtcttgtactcaccgcccgtcacaccatgggagttgtattcgccttaagccgggacgctaaactggctaccgtccacggcggatgcagcgactggggtgaagtcgtaacaaggtaaccgtaggtgaacctgcggttg

SEQ ID NO: 2159 - DNA, 1491 bp, Xanthomonadaceae bacterium
agtgaacgctggcggcaggcctaacacatgcaagtcgaacggcagcgcgagagagcttgctctcttggcggcgagtggcggacgggtgaggaatacgtcggaatctgcctatttgtgggggataacgtagggaaacttacgctaataccgcatacgtcctacgggagaaagcaggggaccttcgggccttgcgcagatagatgagccgacgtcggattagctagttgggggggtaatggcccaccaaggcaacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcatgcggttaatacccgtgtgtcatgacggtacccaaagaataagcaccggctaacttcgtgccagcagccgcggtaatacgaagggtgcaagcgttactcggaattactgggcgtaaagcgtgcgtaggtggtttgttaagtcagatgtgaaagccctgggctcaacctgggaactgcatttgatactggcaagctagagtgcggtagaggatagcggaattcctggtgtagcagtgaaatgcgtagagatcaggaggaacatccgtggcgaaggcggctatctgggccagcactgacactgaggcacgaaagcgtggggagcaaacaggattagataccctggtagtccacgccctaaacgatgcgaactggatgttgggctcaacttggagttcagtatcgaagctaacgcgttaagttcgccgcctggggagtacggtcgcaagactgaaactcaaaggaattgacgggggcccgcacaagcggtggagtatgtggtttaattcgaagcaacgcgcagaaccttacctggccttgacatgtcgagaacttggcagagatgccttggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatgggaaggacagagggctgcgaacccgcgagggcaagccaatcccagaaaccttctctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtacc

SEQ ID NO: 2160 - DNA, 1548 bp, Xanthomonas campestris
agagtttggtcctggctcagagtgaacgctggcggcaggcctaacacatgcaagtcgaacggcagcacagtaagagcttgctcttacgggtggcgagtggcggacgggtgaggaatacatcggaatctactctttcgtgggggataacgtagggaaacttacgctaataccgcatacgacctacgggtgaaagcggaggaccttcgggcttcgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccatccatgccgcgtgggtgaagaaggccttcgggttgtaaagcccttttgttgggaaagaaaagcagtcggttatacccgattgttctgacggtacccaaagaataagcaccggctaacttcgcgccagcagccgcggtaatacgaagggtgcaagcgttactcggaattactgggcgtaaagcgtgcgtaggtggtggtttaagtctgttgtgaaagccctgggctcaacctgggaattgcagtggatactgggtcactagagtgtggtagagggtagcggaattcccggtgtagcagtgaaatgcgtagagatcgggaggaacatccgtggcgaaggcggctacctggaccaacactgacactgaggcgcgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggttgccttcgggaaccgtgagacagtgctgcatggctgtcgtcagctcgtgtcgtgagatgttgggttaagtcccgcaagagcgcaacccttgtccttagttgccaagccaacgtaatggtgggaactctaaggagaccggccgtgacaaaccggaggaaggtggggatgacgtcaaagtcaatcatggccacttacgtccagggctacacacgtactacaatggtagggtacagagggctgcaaacaccgcgagggtaagccaatcccagaaaccctatctcagtccggattggagtctgcaactcgactccatgaagtcggaatcagctagtaatcgcagatcagcattgctgcggtgaatacgttcccgggccttgtacacacacagcaccgtcacacatgggagtttgttgcaccagaagcaggtagcttaaccttcgggagggcgcttgccacggtgtggccgatgactggggtgaagtcgtaacaaggtagccgtatcggaaggtgcggctggatcacctcctt

SEQ ID NO: 2161 - DNA, 1301 bp, Xanthomonas sp.
gaatctaccgttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggttaggacagagggctgcaaactcgcgagagtaagccaatcccagaaacctaatctcagtccggattggagtctgcaactcgactccatgaagtcggaatcgctagtaatcgcagatcagcattgvtgtcggwgaatacgttcccggggcgtttgtacacaccgcccgtcactccwtacaagtt

SEQ ID NO: 2162 - DNA, 1471 bp, Xenophilus aerolatus
cacatgcaagtcgaacggtaacaggtcttcggatgctgacgagtggcgaacgggtgagtaatacatcggaacgtgcccagtcgtgggggataactacgcgaaagcgtagctaataccgcatacgatctatggatgaaagcgggggatcgcaagacctcgcgcgattggagcggccgatggcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagtctctttctaataaagagggatcatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaattcactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctgga

SEQ ID NO: 2163 - DNA, 1488 bp, Yokenella regensburgei
tagagtttgatccatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgatacggttaataaccgtgtcgattgacgttactcgcagaagaagcaccggctaactccgtgccagcagccgcggtaatacggagggtgcaagcgttaatcggaattactgggcgtaaagcgcacgcaggcggtctgtcaagtcttatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaacttagcagagatgctttggtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagt

SEQ ID NO: 2164 - DNA, 1485 bp, Zimmermannella bifida
agagtttgatcctggctcaggacgaacgctggcggcgtgcttaacacatgcaagtcgaacgatgaagccttagcttgctttggtggattagtggcgaacgggtgagtaacacgtgagcaacgtgcccagaactctggaataaccgccggaaacggtggctaatactggataggtgccaaggccgcatggtctttggttggaaagatttttcggttctggatcggctcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaattccgaggctcaacctcgggcgtgcagtgggtacgggcagacttgagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggaccattccacggtttctgtgtcgtagctaacgcattaagcgccccgcctggggagtacggccgcaaggctaaaactcaaaggaattgacgggggcccgcacaagcggcgtagcatgcggattaattcgatgcaacgcgaagaaccttaccaaggcttgacatataccggaaacggccagagatggtcgcccccttttgggtcggtatacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgtatgctacaatggccggtacaatgggctgcgataccgcgaggtggagcgaatcccaaaaagccggtctcagttcggattggggtccgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccttttggggggagccgtcgaaggtgggatcggtgattaggactaagtcgtaacaaggtagcc

SEQ ID NO: 2165 - DNA, 1482 bp, Zymomonas mobilis
agagtttgattctggctcagaacgaacgctggcggcatgcttaacacatgcaagtcgaacgaaggcttcggccttagtggcgcacgggtgcgtaacgcgtgggaatctgccttcaggtacggaataactaggggaaactcgagctaataccgtatgatatcgagagatcaaagatttatcgcctgaagatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggggaaaccctgatccagcaatgccgcgtgagtgaagaaggccttagggttgtaaagctcttttacccgggatgataatgacagtaccgggagaataagctccggctaactccgtgccagcagccgcggtaatacggagggagctagcgttgttcggaattactgggcgtaaagcgtacgtaggcggtttaataagtcaggggtgaaagcccagagctcaactctggaactgcctttgagactgttagactagaacatagaagaggtaagtggaattccgagtgtagaggtgaaattcgtagatattcggaagaacaccagtggcgaaggcgacttactggtctatagttgacgctgaggtacgaaagcgtgggtagcaaacaggattagataccctggtagtccacgccgtaaacgatgataactagctgtccgggtacatggtatctgggtggcggagctaacgcattaagttatccgcctggggagtacggtcgcaagattaaaactcaaagaaattgacgggggcctgcacaagcggtggagcatgtggtttaattcgaagcaacgcgcagaaccttaccagcgtttgacatcctgatcgcggaaagtggagacacattctttcagttcggctggatcagagacaggtgctgcatggctgtcgtcagctcgtgtcgtgagatgttgggttaagtcccgcaacgagcgcaaccctcacctctagttgccatcattaagttgggcactttagaggaactgccggtgataagccggaggaaggtggggatgacgtcaagtcctcatggcccttacgcgctgggctacacacgtgctacaatggcggtgacagagggccgcaagcctgcaaaggttagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctccttt

SEQ ID NO: 2166 - DNA, 659 bp, Alistipes shahii
  misc_feature (10)..(10): n is a, c, g, or t
  misc_feature (56)..(56): n is a, c, g, or t
  misc_feature (71)..(71): n is a, c, g, or t
  misc_feature (105)..(105): n is a, c, g, or t
  misc_feature (113)..(113): n is a, c, g, or t
  misc_feature (168)..(168): n is a, c, g, or t
  misc_feature (240)..(240): n is a, c, g, or t
  misc_feature (248)..(248): n is a, c, g, or t
  misc_feature (273)..(274): n is a, c, g, or t
  misc_feature (288)..(288): n is a, c, g, or t
  misc_feature (337)..(338): n is a, c, g, or t
  misc_feature (350)..(350): n is a, c, g, or t
  misc_feature (356)..(356): n is a, c, g, or t
  misc_feature (367)..(367): n is a, c, g, or t
  misc_feature (386)..(386): n is a, c, g, or t
  misc_feature (412)..(412): n is a, c, g, or t
  misc_feature (424)..(424): n is a, c, g, or t
  misc_feature (439)..(439): n is a, c, g, or t
  misc_feature (458)..(458): n is a, c, g, or t
  misc_feature (468)..(468): n is a, c, g, or t
  misc_feature (478)..(479): n is a, c, g, or t
  misc_feature (482)..(484): n is a, c, g, or t
  misc_feature (490)..(490): n is a, c, g, or t
  misc_feature (493)..(493): n is a, c, g, or t
  misc_feature (509)..(509): n is a, c, g, or t
  misc_feature (520)..(520): n is a, c, g, or t
  misc_feature (530)..(531): n is a, c, g, or t
  misc_feature (548)..(548): n is a, c, g, or t
  misc_feature (559)..(560): n is a, c, g, or t
  misc_feature (574)..(574): n is a, c, g, or t
  misc_feature (578)..(578): n is a, c, g, or t
  misc_feature (586)..(586): n is a, c, g, or t
  misc_feature (588)..(588): n is a, c, g, or t
  misc_feature (601)..(603): n is a, c, g, or t
  misc_feature (606)..(606): n is a, c, g, or t
  misc_feature (608)..(608): n is a, c, g, or t
  misc_feature (620)..(620): n is a, c, g, or t
  misc_feature (624)..(624): n is a, c, g, or t
  misc_feature (630)..(630): n is a, c, g, or t
  misc_feature (645)..(645): n is a, c, g, or t
  misc_feature (651)..(652): n is a, c, g, or t
cttaacatcnggaccggcgtgggttctggttgataactccggtgggtatggatggncatgcgttgtattangtgggtggtgaggtaactgctcaccagggcaacnatacatanggggactgagaggttagccccccacgttggtactgagacacggacaaacctcatncgggaggcagcagtgaagaatattggtcaatggacacaagtctgaaccagccatgccgcgtgcaggaagacngctctatnagttgtaaactgcttttgtactaanntaaacgctcttacntgtaaaagcctgaaagtatcgtacgaaaaaggatcggctaactccgtgnnagcagccgcggnaatacngaggatccatncgttatccggatttattgngtttaaagggtacgtaaacgggttgntcaataaaggtnaaataccggtgcttnacaccgtaactgcctctanactgttgcantatagagtanntgnnntaggcngantgtatgatgtagcggngaaatgcttanaaatcatacnnaacacctattgcgaaancagcttactcnnactatatctgacgntgangcaaaaancntggggagaaaacnnnatnanataccctggtantccncgcagnaacgacgataactcnctgacnncgataca

SEQ ID NO: 2167 - DNA, 1383 bp, Bacteroides caccae
tcgaggggcatcagtttggtttgcttgcaaaccaaagctggcgaccggcgcacgggtgagtaacacgtatccaacctgcctcatactcggggatagcctttcgaaagaaagattaatatccgatagcatatatttcccgcatgggttttatattaaagaaattcggtatgagatggggatgcgttccattagtttgttggcggggtaacggcccaccaagactacgatggataggggttctgagaggaaggtcccccacattggaactgagacacggtccaaactcctacgggaggcagcagtgaggaatattggtcaatggacgcgagtctgaaccagccaagtagcgtgaaggatgactgccctatgggttgtaaacttcttttatatgggaataaagtggtccacgtgtggatttttgtatgtaccatatgaataaggatcggctaactccgtgccagcagccgcggtaatacggaggatccgagcgttatccggatttattgggtttaaagggagcgtaggcggattgttaagtcagttgtgaaagtttgcggctcaaccgtaaaattgcagttgatactggcagtcttgagtgcagtagaggtgggcggaattcgtggtgtagcggtgaaatgcttagatatcacgaagaactccgattgcgaaggcagctcactggagtgtaactgacgctgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaaatgaattatggggaaacccatacgccgcaaggcatttgtgaaattgcagttggtactggcagtcctgggtgcgggagaggtcggcggaattcgtagtatagcggcgaaattcttcgatagttactaacaggtcatgctgaggactctggagagactgccgtcgtaagatgtgaggaaggtggggatgacgtcaaatcagcacggcccttacgtccggggctacacacgtgttacaatggggggtacagaaggccgctacctggtgacaggatgccaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 2168 - DNA, 1382 bp, Bacteroides eggerthii
tcgaggggcagcatgattgaagctgtgcttcaattgatggcgaccggcgcacgggtgagtaacacgtatccaacctgccgataactcggggatagcctttcgaaagaaagattaatacccgatagtatagtatttccgcatggtttcactattaaagaatttcggttatcgatggggatgcgttccattagatagttggcggggtaacggcccaccaagtcaacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtggagtatgcatactcctttgtatgtaccgtatgaataaggatcggctaactccgtgccagcagccgcggtaatacggaggatccgagcgttatccggatttattgggtttaaagggagcgtaggcgggtgcttaagtcagttgtgaaagtttgcggctcaaccgtaaaattgcagttgatactgggcgccttgagtgcagcataggtaggcggaattcgtggtgtagcggtgaaatgcttagatatcacgaagaactccgattgcgaaggcagcttactggactgtaactgacgctgatgctcgaaagtgtgggtatcaaacaggattagataccctggtagtccacacagtaaacgatgaatactcgctgttggcgatacacagtcagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaagttgtgaaggtttgcggctcaaccgtaacatcgcactggatactgggcggcttgagtgtagtatacgtaggcggaagccgtgaggtgtcggcttaagtgccataacgagcgcaacccttatctatagttactatcaggtcatgctgaggactctatggagactgccgtcgtaagatgtgaggaaggtggggatgacgtcaaatcagcacggcccttacgtccggggctacacacgtgttacaatggggggtacagaaggcagctacctggcgacaggatgctaatccctaaaacctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtacgtaaccgcaa

SEQ ID NO: 2169 - DNA, 1362 bp, Bacteroides sp.
ggggcagcatttcagtttgcttgcaaactggagatggcgaccggcgcacgggtgagtaacacgtatccaacctgccgataactcggggatagcctttcgaaagaaagattaatacccgatggtataatcagaccgcatggtcttgttattaaagaatttcggttatcgatggggatgcgttccattaggcagttggtgaggtaacggctcaccaaaccttcgatggataggggttctgaaaggaaggtcccccacattggaactgagacacggtccaaactcctacgggaggcagcagtgaggaatattggtcaatgggcgcaggcctgaaccagccaagtagcgggatgacgctatgggtaatttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtaaggtgggcggaattcgtggtgtacggtgaaatgcttaatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaagaacatgtggattaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 2170 - DNA, 1362 bp, Bacteroides sp.
attttagtttgcttgcaaactgaagatggcgaccggcgcacgggtgagtaacacgtatccaacctgccgataactccggaatagcctttcgaaagaaagattaataccggatagcatactaatatcgcatgatatttttattaaagaatttcggttatcgatggggatgcgttccattagtttgttggcggggtaacggcccaccaagactacgatggataggggttctgaaaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgataaggatggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtaaggtgggcggaattctggtgtacggtgaaatgcttaatatcacaaaactccgattgcgaaggcagctcactagactgttactgacactgatgctcgaaagtgtgggtatcaaacaggattaataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaaacggaggaacatgtggtttaattccatgatacgcgaggaaccttacccgggcttaaattgcaacagaatatattggaaacagtatagccgcaaggcagttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcggctacctggcgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 2171 - DNA, 1343 bp, Bacteroides sp.
gcgaccggcgcacgggtgagtaacacgtatccaacctgccgataactccggaatagcctttcgaaagaaagattaataccggatggtatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaa

SEQ ID NO: 2172 - DNA, 1341 bp, Bacteroides uniformis
  misc_feature (9)..(9): n is a, c, g, or t
  misc_feature (11)..(15): n is a, c, g, or t
cgaccggcncnnnnngagtaacacgtatccaacctgccgatgactcggggatagcctttcgaaagaaagattaatacccgatggcataattcttccgcatggtagaattattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtacctatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagctgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaagcctcacccggaatatagtagtagataatgggtgtcttacgtgtcagccgcaaggcagtagtgaaggggctgcatgggagtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggtgacgtgatgctaatccctaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaagg

SEQ ID NO: 2173 - DNA, 1377 bp, Bacteroides vulgatus
  misc_feature (14)..(14): n is a, c, g, or t
cagcatggtcttancttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatggatcccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagctgcaaggcatctgtgaaggtgctgcatggttgtcgtcagctcgtgccgtgaggtgtcggcttaagtgccataacgagcgcaacccttgttgtcagttactaacaggtttcgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggag

SEQ ID NO: 2174 - DNA, 1381 bp, Bacteroides vulgatus
  misc_feature (1325)..(1325): n is a, c, g, or t
  misc_feature (1328)..(1328): n is a, c, g, or t
cgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtgtacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggacgaacatgtggtttaattcgatgagacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttccgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccccaaaacctctctcagttcggactggagtctgcaacccgactccacgaagctggattcgctagtaatcgcgcatcagccacggcgcggtgaatacgttcccgggccttgtacncancgcccgtcaagccatgggagccgggggtacctgaagtgcgtaaccgcgaggag

SEQ ID NO: 2175 - DNA, 970 bp, Bifidobacterium adolescentis
  misc_feature (18)..(18): n is a, c, g, or t
  misc_feature (33)..(33): n is a, c, g, or t
  misc_feature (81)..(81): n is a, c, g, or t
  misc_feature (83)..(83): n is a, c, g, or t
gtgagtgtacctttcgantaagcaccggctaantacgtgccagcagccgcggtaatacgtagggtgcaagcgttatccggnanttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgcagagatacggtctcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacctcgtgagggggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcc

SEQ ID NO: 2176 - DNA, 1350 bp, Bifidobacterium pseudocatenulatum
  misc_feature (1284)..(1284): n is a, c, g, or t
tccatcaggctttgcttggtggtgagagtggcgaacgggtgagtaatgcgtgaccgacctgccccatacaccggaatagctcctggaaacgggtggtaatgccggatgctccggcctgccgcatggtgggctgggaaagattgtatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggcctcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggatcatgcggattaattcgatgcaacgcgaagaaccttacctgggcttgacatgttcccgaccgctccagagatggggcttcccttcggggcgggttcacgggaggagcatggacgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggngaatgcgttcccgggccttgtacacaccgcccgtcaagtcatgaaagtgggtagcacccgaagccg

SEQ ID NO: 2177 - DNA, 1388 bp, Blautia producta
tcgagcgaagcacttaagtggatctcttcggattgaaacttatttgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggttaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttataggagg

SEQ ID NO: 2178 - DNA, 1391 bp, Blautia producta
cgaagcacttgaacggatttcttcggattgaagtttttgtgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaatctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacctgtccaggaaggggacatgccataggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttataggagggagctgccg

SEQ ID NO: 2179 - DNA, 1391 bp, Blautia schinkii
tcgaacgaagcacttgaaacagattcttcggatgaagtttcctgtgactgagtggcggacgggtgagtaacgcgtgggtaacctgcctcatacagggggataacagttagaaatggctgctaataccgcataagcgcacggcatcgcatgatgcagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgccaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttgggtagcaaagctattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatccgaccggaccgtaatggcacgtttcctttggggggcggggactcaagccggggactgcattggaacagctcgtgtcgtgagatgttgggttaagtcccgcaacgagcgcaacccttatcctcagtagccagcaaatgaaggtgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaaggaagga

SEQ ID NO: 2180 - DNA, 1349 bp, Clostridium bolteae
  misc_feature (8)..(9): n is a, c, g, or t
  misc_feature (425)..(425): n is a, c, g, or t
gcaattanntgaagttttcggatggatttttaatgtgactgagtggcggacgggtgagtaacgcgtgtataccctgcctcactgtgggggataacagttaaaagtgagtgctaataccgcataagcgcacagtaccgcgtggtacggtgtgaaaaactccggtggtgtgagatggatccgcgtcagattaccctggtgggggggtaacggccccccaaagcgactatcaatacccgacctgagagggtgaccggccattttgggactgacacacggcccactctcctacgggaggcagcagtgggaaatattgcacagtgggcgaaaccctgatgcagccaccccgcgtgagtgaaaaaatatttcggtatgtaaagctctatcagcgggaaaaaatgacggtacctgataaaaccccggctaantacgtgcccaccgcggtaatactagggggcaagcttatccgatttcgggtgtaagggagctaacgacgtctagtgaacccggctccctggactgttgaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagct

SEQ ID NO: 2181 - DNA, 1011 bp, Clostridium butyricum
  misc_feature (927)..(927): n is a, c, g, or t
  misc_feature (983)..(983): n is a, c, g, or t
gatgaagcttcttcggaagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaaactctgtctttggggacgataatgacggtacccaaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggagnaagccacttcggtggcaggaagacaggtggtgcatggttgtcgtcagctcgtgtcntgagatgttgggttaagtcccgcaacga

SEQ ID NO: 2182 - DNA, 1371 bp, Clostridium disporicum
  misc_feature (26)..(27): n is a, c, g, or t
tcgagcgagtggagttcttcggaacnnagctagcggcggacgggtgagtaacacgtgggcaacctgcctcatagaggggaatagcctcccgaaagggagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaatgccgcgtgagtgatgacggccttcgggttgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatttttaagtgagatgtgaaatacccgggcttaacttgggtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggaacatgtggtttaattcgaagcaacgcgaagaaccttacctagacttgacatctcctgaattacccgtaactggggaagtcgcttcggcgacaggaagacaggtggtgcatgggagtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctaactcgcaagagaggaa

SEQ ID NO: 2183 - DNA, 1384 bp, Clostridium hathewayi
agcgaagcggatcttcggaagttttcggatggaagaggatttgacttagcggcggacgggtgagtaacgcgtgggtaacctgccttacactgggggataacagttagaaatgactgctaataccgcataagcgcacagggccgcatggtccggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtttagcaagtctgaagtgaaagcccggggctcaaccccggtactgctttggaaactgttagacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggggcaaagcccttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgaaaacggtttaaccggagtccctcttcggagcagtggagacaggtggtgcatggttgtcgtcagctcgtgtcgtgagatgttgggttaagtcccgcaacgagcgcaacccttatccttagtagccagcgagtagagtcgggcactctggggagactgccagggataacctggaggaaggtggggatgacgtcaaatcatcatgccccttatgatttgggctacacacgtgttacaatggcgtaaacaaagggaagcaaaggagcgatcgggagcaaaccccaaaaataacgtttcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagg

SEQ ID NO: 2184 - DNA, 958 bp, Clostridium hylemonae
  misc_feature (907)..(907): n is a, c, g, or t
  misc_feature (938)..(938): n is a, c, g, or t
caatactgtgtgaagagattagcttgctaagatcagaactttgtattgactgagtggcggacgggtgagtaacgcgtgggcaacctgccttacacagggggataacagctagaaatggctgctaataccgcataagacctcagtaccgcatggtagaggggtaaaaactccggtggtgtaagatgggcccgcgtctgattaggtagttggtagggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcatggcaagtctgaagtgaaagcccggggctcaaccccgggactgctttggaaactgtcaggctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagctttttcggtgccgcagccaacgcaataagtaatccacctggggagtacgttcgcaagaatgaaactcaaaggaattgacggggacccgcacaagcggtggagcatgtggtttaattcgaagcaacgcgaanaacccttacctgatcttgacatcccggtganaaagtatgtaatgtactctt

SEQ ID NO: 2185 - DNA, 1308 bp, Clostridium innocuum
  misc_feature (28)..(29): n is a, c, g, or t
  misc_feature (627)..(627): n is a, c, g, or t
gcggacgggtgagtaacgcgtgggtaanntaccctgtacacacggataacataccgaaaggtatgctaatacgggataatatatttgagaggcatctcttgaatatcaaaggtgagccagtacaggatggacccgcgtctgattagctagttggtaaggtaacggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtggtgagaaggccttcgggtcgtaaaactctgtcctcaaggaagaaatgacggtacttgaggaggaagccccggcaactacgtgccagcagccgcggtaatagtagggggctagcgttatccggatttactgggcgtaaagggtgcgtaggcggtctttcaagtcaggagtgaaaggctacggctcaaccgtagtaagctcttgaaactgggagacttgagtgcaggagaggagagtggaattctagtgtagcggtgaaatgcgtagatattaggaggaacaccagttgcgaaggcggctctctggactgtaactgacgctgangcacgaaagcgtggggagcaaacaggattagataccctggtagtccacgctgtaaacgatgagtactatgtgtcgggggttacccccttcggtgccgcagctaacgcattaagtactccgcctgggaagtacgctcgcaagagtgaaactcaaaggaattgacggggacccgcacaagtagcggatcatgtggtttaattcgaagcaacgcgaagaagcttacctaagcttgacatcccaatgacatctccttaatcggagagttcccttcggggacattggtgacaggtggtgcatggttgtcgtcagctcgtgtcgtgagatgttgggttaagtcccgcaacgagcgcaacccttgtctttagttgccatcattaagttgggcactctagagagactgccagggataacctggaggaaggtggggatgacgtcaaatcatcatgccccttatgcttagggctacacacgtgctacaatgggtagtacagagggttgccaagccgtaaggtggagctaatcccttaaagctactctcagttcggattgtaggctgaaactcgcctacatgaagctggagttactagtaatcgcagatcagaatgctgcggtgaatgcgttcccgggtcttgtacacaccgcccgtcacaccacgggagttggagacgcccgaagccgatt

SEQ ID NO: 2186 - DNA, 1376 bp, Clostridium innocuum
aacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccttcaaggcgtgaacatggatggacctgcggcgcattagctagttggtgaggtaacggcccaccaaggcaatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggcaacaaataccctagagatagggggataattatggatcacacagtggtatgctggagtgcagcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtgg

SEQ ID NO: 2187 - DNA, 1339 bp, Clostridium mayombei
  misc_feature (42)..(42): n is a, c, g, or t
ttctcttcggagaagagcggcggacgggtgagtaacgcgtgngtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggtacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacgtgggattcctagtgtagcggtgaaatgcgtagatattatggggtaaacccctacaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaac

SEQ ID NO: 2188 - DNA, 1380 bp, Clostridium nexile
  misc_feature (12)..(12): n is a, c, g, or t
cgaagcgcttanatggatttcttcggattgaagtttttgtgactgagtggcggacgggtgagtaacgcgtgggtaacctgcctcatacagggggataacagttagaaatgactgctaataccgcataagcgcacagtgctgcatggcacagtgtgaaaaactccggtggtatgagatggacccgcgtctgattagctagttggtggggtaacggcctaccaaggcgacgatcagtagccggcctgagagggtgaacggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggtttactgggtgtaaagggagcgtagacggttgtgtaagtctgatgtgaaagcccggggctcaaccccgggactgcattggaaactatgtaactagagtgtcggagaggtaagcggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctggtcttgacatccctgtgaccggcaagtaatgttacctttccttcgggacaccggagacaggtggtgcatggttgtcgtcagctcgtgtcgtgagatgttgggttaagtcccgcaacgagcgcaacccctatcttcagtagccagcatttaaggtgggcactctggagagactgccagggataacctggaggaaggtggggatgacgtcaaatcatcatgccccttatgaccagggctacacacgtgctacaatggcgtaaacaaagggaagcgaacctgtgaggggaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcagtaacgcccgaagtcagtgacccaaccgtaaggagg

SEQ ID NO: 2189 - DNA, 1382 bp, Clostridium orbiscindens
  misc_feature (1330)..(1330): n is a, c, g, or t
  misc_feature (1334)..(1334): n is a, c, g, or t
  misc_feature (1371)..(1371): n is a, c, g, or t
acggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtcccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggaccgcacaagcggtggagtatgtggtttaattcgaagcagcgcgaataccattccgaggtttaaactgccggctaaacatccagcctgcatttgagactgtcgtggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaatcccgcgaggtggagcaaatccctaaaagccatcccagtttggattgcaggctgaaacccgcctgtatgaagttggaatcgctagtaatcgcggatcagcatgccgcggtgaatacgttcccgggccttgtacacaccgcccgncacnccatgagagtcgggaacacccgaagtccgtagcctanccgcaaggagg

SEQ ID NO: 2190 - DNA, 1345 bp, Clostridium symbiosum
  misc_feature (876)..(876): n is a, c, g, or t
  misc_feature (1044)..(1044): n is a, c, g, or t
gttttcggatggaagttgaattgactgagtggcggacgggtgagtaacgcgtgggtaacctgccttgtactgggggacaacagttagaaatgactgctaataccgcataagcgcacagtatcgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcccgggtaatacgtagggggcaagcgttatcggatttactgggtgtaaagggagcgtaacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtgcgaaggcgacttactggacgataactgacgttgaggctcgaaagcgtggggagcaaacaggattagataccctggtagtcacgccgtaaacgatgaatactagtgttggggagcaaagctcttcggtgccgtcgcaaacgcagtaagtattccacctggggagtacgttcgcaagaatgaaactcaaaggaattgacggggaccgcacagcggtggagcatgtgggttaattcgtaagcaacacgagtaacnttgcctggtctgggcgtcaaccgacgggggagtaacgtccccttcccttcggggcggagaagacaggtggtgcatggttgtcgtcagctcgtgtcgtgagatgttgggttaagtcccgcaacgagcgcaacccttattctaagtatccagcggttcggccgggaactnttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccg

SEQ ID NO: 2191 - DNA, 1357 bp, Clostridium tertium
  misc_feature (249)..(250): n is a, c, g, or t
  misc_feature (277)..(277): n is a, c, g, or t
gcgagaggagttccttcgggaacaaatctagcggcggacgggtgagtaacacgtgggcaacctgccttgtagaggggaatagccttccgaaaggaagattaataccgcataacattacattttcgcatgaagaagtaattaaaggagcaatccgctacaagatgggcccgcggcgcattagctagttggtgaggtaacggctcaccaaggcgacgatgcgtagccgacctgagagggtgatcggccacnntgggactgagacacggcccagactccnacgggaggcagcagtggggaatattgcacaatgggggaaaccctgatgcagcaacgccgcgtgagtgatgaaggttttcggatcgtaaagctctgtcttcagggagataagacggacctgagaggaagccggctaactacgtgccagcagccgcggtaatacgtaggtggcgagcgtgtccggatttactgggcgtaaagggagcgtaggcggatttttaagtgagatgtgaaatacccgggctcaacttgggtgctgcatttcaaactggaagtctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtgcacgccgtaaacgatgaatactaggtgtaggggttgtcatgacctctgtgccgccgcaaacgcattaagtattccgcctggggagtacggtcgcaagattaaaactcaaaggaattgacgggggcccgcacaagcagcggagcatgtggtttaattcgaagccccgcgaagaaccttacctagacttgacatctcctgcattactcttaatcgaggaagtcccttcggggacaggatgacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagatgcgataccgcgaggtggagctaaactataaaacttgtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacccgtaaggg

SEQ ID NO: 2192 - DNA, 1346 bp, Collinsella aerofaciens
acccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaactccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggaacatgtggcttaattcgaagcaacgcgaagaaccttaccagggcttgacgtatgggtgaagcgggggaaaccccgtggacgagaggagcccatacaggtggtgcatggctgtcgtcagctcgtgtcgcgagatgatgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgaga

SEQ ID NO: 2193 - DNA, 1382 bp, Coprobacillus sp.
tcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgatatacaccaggtgcatggagtgcaggagaggatcgtggaattccttgggtaacggccaaaagcgtagatatccgtagtcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaag

SEQ ID NO: 2194 - DNA, 765 bp, Coprococcus catus
  misc_feature (15)..(18): n is a, c, g, or t
  misc_feature (20)..(21): n is a, c, g, or t
  misc_feature (374)..(374): n is a, c, g, or t
  misc_feature (553)..(553): n is a, c, g, or t
  misc_feature (577)..(577): n is a, c, g, or t
  misc_feature (580)..(580): n is a, c, g, or t
  misc_feature (599)..(599): n is a, c, g, or t
  misc_feature (604)..(604): n is a, c, g, or t
  misc_feature (606)..(607): n is a, c, g, or t
  misc_feature (619)..(619): n is a, c, g, or t
  misc_feature (626)..(626): n is a, c, g, or t
  misc_feature (632)..(632): n is a, c, g, or t
  misc_feature (635)..(635): n is a, c, g, or t
  misc_feature (637)..(637): n is a, c, g, or t
  misc_feature (643)..(643): n is a, c, g, or t
  misc_feature (645)..(645): n is a, c, g, or t
  misc_feature (678)..(679): n is a, c, g, or t
  misc_feature (681)..(681): n is a, c, g, or t
  misc_feature (686)..(686): n is a, c, g, or t
  misc_feature (690)..(690): n is a, c, g, or t
  misc_feature (706)..(706): n is a, c, g, or t
  misc_feature (714)..(714): n is a, c, g, or t
  misc_feature (722)..(723): n is a, c, g, or t
  misc_feature (730)..(730): n is a, c, g, or t
  misc_feature (742)..(743): n is a, c, g, or t
  misc_feature (746)..(746): n is a, c, g, or t
  misc_feature (758)..(758): n is a, c, g, or t
gtggcggacgggtgnnnntnncgtgggtaacctgcctcatacaggggaatagcagctggaaacggctgataaaaccgcataagcgcacagtgccgcatggcacagtgtgaaaaactccggtggtatgagatggacccgcgtctgattagcttgttggcggggtaacggcccaccaaggcgacgatcagtagccggcctgagagggtgatcggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagataatgacggtacctgactaanaagccccggctaactacgtgccagcagccgcggtaatacgtatggggcaagcgttatccggatttactgggtgtaaagggagcgtaggcggcggagcaagtcagaagtgaaagcccggggctctaccccgggacggcttttgaaactgccctgcttgatttcaggacaggtaagcgganttcctagtgtaccggtgaaatgcntanatattacgaggaacaccantggcnanngcggcttactgnactgacnatgacnctnangctcanangcgtggggagcaaacaggattagataccctggnnanccacnccgnaaacgatgaatactangtgtcggngctcatannatcttcngtgccgcatcanntcnataagtattccncctgggg

SEQ ID NO: 2195 - DNA, 1348 bp, Coprococcus comes
cgaagcacttatctttgattcttcggatgaagaggtttgtgactgagtggcggacgggtgagtaacgcgtgggtaacctgcctcatacagggggataacagttagaaatgactgctaataccgcataagaccacagagccgcatggctcggtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtccgactaaagcaccgctaatatgccacagccgcggaatactagggcaacgttcgttggtgtaagggagcagtgtgtaatctgataaagccggggctcacccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcctgtaatgacgccttttcttcggaacaccggtgacaggtggtgcatggttgtcgtcagctcgtgtcgtgagatgttgggttaagtcccgcaacgagcgcaacccttatcttcagtagccagcattttggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctg

SEQ ID NO: 2196 - DNA, 1379 bp, Dorea formicigenerans
tcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgacggcttcgtaatggaaggttttaattggaaggcatgggctcagccgggcatggttgtcgtcagctcgtgtcctgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaggcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccga

SEQ ID NO: 2197 - DNA, 1234 bp, Dorea longicatena
  misc_feature (11)..(14): n is a, c, g, or t
  misc_feature (281)..(281): n is a, c, g, or t
  misc_feature (390)..(390): n is a, c, g, or t
  misc_feature (393)..(393): n is a, c, g, or t
  misc_feature (420)..(420): n is a, c, g, or t
  misc_feature (438)..(438): n is a, c, g, or t
  misc_feature (460)..(460): n is a, c, g, or t
  misc_feature (463)..(463): n is a, c, g, or t
  misc_feature (544)..(544): n is a, c, g, or t
  misc_feature (677)..(678): n is a, c, g, or t
  misc_feature (718)..(718): n is a, c, g, or t
  misc_feature (726)..(727): n is a, c, g, or t
  misc_feature (735)..(735): n is a, c, g, or t
  misc_feature (740)..(741): n is a, c, g, or t
  misc_feature (744)..(744): n is a, c, g, or t
  misc_feature (747)..(747): n is a, c, g, or t
  misc_feature (758)..(758): n is a, c, g, or t
  misc_feature (762)..(763): n is a, c, g, or t
  misc_feature (770)..(770): n is a, c, g, or t
  misc_feature (773)..(773): n is a, c, g, or t
  misc_feature (777)..(777): n is a, c, g, or t
  misc_feature (780)..(780): n is a, c, g, or t
  misc_feature (782)..(782): n is a, c, g, or t
  misc_feature (784)..(784): n is a, c, g, or t
  misc_feature (787)..(788): n is a, c, g, or t
  misc_feature (792)..(793): n is a, c, g, or t
  misc_feature (798)..(798): n is a, c, g, or t
  misc_feature (824)..(824): n is a, c, g, or t
  misc_feature (851)..(851): n is a, c, g, or t
  misc_feature (886)..(886): n is a, c, g, or t
  misc_feature (913)..(913): n is a, c, g, or t
  misc_feature (924)..(924): n is a, c, g, or t
  misc_feature (1020)..(1020): n is a, c, g, or t
  misc_feature (1048)..(1049): n is a, c, g, or t
  misc_feature (1051)..(1051): n is a, c, g, or t
cgaagcgcttnnnnaagattcttcggatgattacctttgtgactgatcggcggacgggtgagtaacgcgtgggtaacctgcctcatacagggggataacagttataaatgactgctaataccgcataagaccacggtaccgcatggtacagtggtaaaaactccggtggtatgagatggacccccgtctgattaggtagttggtggggtaacggcctaccaagccgacgatcagtagccgacctgagagggtgaccggccacattgggactgacacacggnccagactcctacgggaggcagcagtggggaatattgcacaatggaggaaactctgatgcagcgacgccgcgtgaaggatgaattatttcggtatgtaaacttctatcancanggaagaaaatgacggtacctgactaanaagccccggctaactacntgccagcagccgcggtaatacntanggggcaagcgttatccggatttactgggtgtaaagggagcgtagacggcacggcaagccagatgtgaaagcccggggctcnaccccggatgcatttggaactgctgagctagagtgtcgaaggcaagtgaattcctagtgtacggtgaatgcgtaatattagaggaacccatggcaaggcgcttgctggacatgactgacgttgagctccgtgnngagcaacaggattaataccctggtagtccacgccgtaaangatgactnntaggtgtngcgtnncanagncattcggtgcngcanntaacgcnatnagcngtncncnttnngagnncgttngcaagaatgaaactcaaaggaattgncggggacctgcacaagcggtggagcangtggtttaatttgaagccacgcgatgaaccttacntgatcttgacatcccgatgaccggttngtaatggaagnttttcttcggaacatcggtgacaggtggtgcatgtttgtcgtcagcttgtgtcgtgagatgttgggttaagtcctgcaacgagcgcaacccctatnttcagtagccagcaggttaagctgggcnntntggagagactgccagggataacctggaggaaggtggggatgacgtcaaatcatcatgccccttatgaccagggcttcacacgtgctacaatggggtaaacaaagagaagcgaactcgggagggtaagcaaatctcaaaaataacgtctcagttcggattgtagtctgcaactcgattacatga

SEQ ID NO: 2198 - DNA, 1386 bp, Enterococcus faecalis
tttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgagctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtg

SEQ ID NO: 2199 - DNA, 1387 bp, Erysipelotrichaceae bacterium
  misc_feature (935)..(936): n is a, c, g, or t
  misc_feature (1381)..(1381): n is a, c, g, or t
tctctaggaagcttgcttccaaagagacttagtggcgaacgggtgagtaacacgtaggtaacctgcccatgtgtctgggataactgctggaaacggtagctaaaaccggataggtatacggagcgcatgctctgtatattaaagcacccttcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcataggaaatgctatgggagtgaggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggtcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaannccctagagatagggagataaatatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagngagccg

SEQ ID NO: 2200 - DNA, 1359 bp, Escherichia coli
cgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacttccacggaagttttcagacatgagaatgtgccttcgggaacggtgagacagtggctgcatggatgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggag

SEQ ID NO: 2201 - DNA, 995 bp, Escherichia coli
  misc_feature (744)..(745): n is a, c, g, or t
  misc_feature (944)..(944): n is a, c, g, or t
  misc_feature (975)..(977): n is a, c, g, or t
aacaggaagcagcttgctgctttgctgacgagtggcggacgggtgagtaatgtctgggaaactgcctgatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtnncgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcaganatgagaatgtgccttcgggaaccgtgagacnnngctgcatggctgtcgtca

SEQ ID NO: 2202 - DNA, 1394 bp, Eubacterium eligens
  misc_feature (19)..(20): n is a, c, g, or t
  misc_feature (44)..(45): n is a, c, g, or t
  misc_feature (1382)..(1382): n is a, c, g, or t
tcgaacgaagcatttaggnnacagattatttcggtatgaagttnnttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccttactgcgggtaaagagagtgtcgttgcctagggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgnaagaaggagccg

SEQ ID NO: 2203 - DNA, 1375 bp, Eubacterium rectale
cactttatttgatttccttcgggactgattattttgtgactgagtggcggacgggtgagtaacgcgtgggtaacctgccttgtacagggggataacagttggaaacggctgctaataccgcataagcgcacggcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagtaatgacggtacctgctaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaacggtacttaatcgtaccttctcttcggacctagatattaggggggacaccggttgtcgtcagctcgtgtcgtgagatgttgggttaagtcccgcaacgagcgcaacccttatctttagtagccagcggtccggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaa

SEQ ID NO: 2204 - DNA, 995 bp, Eubacterium rectale
  misc_feature (657)..(657): n is a, c, g, or t
  misc_feature (726)..(726): n is a, c, g, or t
  misc_feature (814)..(814): n is a, c, g, or t
  misc_feature (931)..(931): n is a, c, g, or t
  misc_feature (933)..(933): n is a, c, g, or t
  misc_feature (935)..(938): n is a, c, g, or t
  misc_feature (945)..(946): n is a, c, g, or t
  misc_feature (948)..(948): n is a, c, g, or t
  misc_feature (955)..(956): n is a, c, g, or t
  misc_feature (964)..(964): n is a, c, g, or t
  misc_feature (969)..(969): n is a, c, g, or t
  misc_feature (977)..(977): n is a, c, g, or t
actgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgangctcgaaagcgtggggagcaaacaggattagataccctggtagtccacgccgtaaacgatgaatactangtgttgggaagcattgcttctcggtgccgtcgcaaacgcagtaagtattccacctggggagtacgttcgcaagaatgaaactcaaaangaattgacggggacccgcacaagcggtggagcatgtggtttaattcgaagcaacgcgaagaaccttaccaagtcttgacatccttctgaccggtacttaaccgtaccttctcttcgnancnnnntgacagnngngcatggnngtcgtcanctcgngtcgtganatgttggggttaagtccc

SEQ ID NO: 2205 - DNA, 1349 bp, Faecalibacterium prausnitzii
  misc_feature (1312)..(1312): n is a, c, g, or t
agcgagagagagcttgctttctcgagcgagtggcgaacgggtgagtaacgcgtgaggaacctgcctcaaagagggggacaacagttggaaacgactgctaataccgcataagcccacagctcggcatcgagcagagggaaaaggagcaatccgctttgagatggcctcgcgtccgattagctagttggtgaggtaacggcccaccaaggcaacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatctatgggctcaacccataaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgatgctggaaacagtattttccttcgggacgcagaaacaggtggtgcatggtcgtcgtcagctcgtgtcgtgagatgttgggttaagtcccgcaacgagcgcaacccttactgtcagttactacgcaagaggactctggcaggactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgtggatcagcatgccacggtgaatacgttcccgggccttgtacacaccgcccgtcacanccatgagagccggggggacccgaagtcggtagtctaa

SEQ ID NO: 2206 - DNA, 1342 bp, Faecalibacterium prausnitzii
ttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctagttggtgaggtaatggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacactgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacggtgctggaaacagtactttccttcgggacgcagagaccggtggtgcatggatgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggagga

SEQ ID NO: 2207 - DNA, 998 bp, Lachnospiraceae bacterium
  misc_feature (14)..(14): n is a, c, g, or t
  misc_feature (25)..(27): n is a, c, g, or t
ctatcagcaggganagatgacggtnnngactaagaagccccggctaactacgtgccagcagccgcggtaatacgtagggggcaagcgttatccgggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattccggatgggcactctggagagactgccagggacaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgcaagggagg

SEQ ID NO: 2208 - DNA, 1368 bp, Odoribacter splanchnicus
tcgaggggcagcatgaggtagcaataccttgatggcgaccggcgcacgggtgagtaacgcgtatgcaacctgcctgataccggggtatagcccatggaaacgtggattaacaccccatagtacttttatcctgcctgggatgggagttaaatgtttaaggtatcggatgggcatgcgtcctattagttagttggcggggtaacagcccaccaagacgatgataggtaggggttctgagaggaaggtcccccacattggaactgagacacggtccaaactcctacgggaggcagcagtgaggaatattggtcaatggacgtaagtctgaaccagccaagtcgcgtgagggaagactgccctatgggttgtaaacctcttttataagggaagaataagttctactgtaatgatgcctgtactgataagcatcggctatctgccagcagccgcggtaatacggaggatgcgagcgttatccggatttattgggtttaaagggtgcgtaggcggtttattaagttagtggttaaatatttgagctaaactcaattgtgccattaatactggtaaactggagtacagacgaggtaggcggaataagttaagtagcggtgaaatgcatagatataacttaaactccgatagcgaaggcagcttaccagactgtaactgacgtgatgcacgagagcgtgggtagcgaacaggattagataccctggtagtccacgccgtaaacgatgctcactggttctgtgcgatatattgtacgggattaagcgaaagtattaagtgagccacctggggagtacgtcggcaacgatgaaactcaaaggaattgacgggggcccgcacaagcggaggaacatgtggtttaattcgatgatacgcgaggaaccttacctgggtttaaatgggaaatgccgtatttggaaacagatattctcttcggagcgtttttcaaggtgctgcatggttgtcgtcagctcgtgccgtgaggtgtcgggttaagtcccataacgagcgcaacccttaccgttagttgctagcatgtaatgatgagcactctaacgggactgccaccgtaaggtgagaggaaggcggggatgacgtcaaatcagcacggcccttacacccagggctacacacgtgttacaatggccggtacagagggccgctaccaggtgactggatgccaatctcaaaagccggtcgtagttcggattggagtctgtaacccgactccatgaagttggattcgctagtaatcgcgcatcagccatggcgcggtgaatacgttcccgggccttgtacacaccgcccgtcaagccatggaagccgggggtgcctgaagtccgtaaccgcgaggat

SEQ ID NO: 2209 - DNA, 1368 bp, Odoribacter splanchnicus
gggcatcatgaggtagcaataccttgatggcgaccggcgcacgggtgagtaacgcgtatgcaacctgcccgataccggggtatagcccatggaaacgtggattaacaccccatagtacttttatcctgcatgggatgtgagttaaatgttcaaggtatcggatgggcatgcgtcctattagttagttggcggggtaacagcccaccaagacgatgataggtaggggttctgagaggaaggtcccccacattggaactgagacacggtccaaactcctacgggaggcagcagtgaggaatattggtcaatggacgtaagtctgaaccagccaagtcgcgtgagggaagactgccctatgggttgtaaacctcttttataagggaagaataagttctacgtgtagaatgatgcctgtaccttatgaataagcatcggctaactccgtgccagcagccgcggtaatacggaggatgcgagcgttatccggatttattgggtttaaagggtgcgtaggcggtttattaagttagtggttaaatatttgagctaaactcaattgtgccattaatactggtaaactggagtacagacgaggtaggcggaataagttaagtagcggtgaaatgcatagatataacttagaactccgatagcgaaggcagcttaccagactgtaactgacgctgatgcacgagagcgtgggtagcgaacaggattagataccctggtagtccacgccgtaaacgatgctcactggttctgtgcgatatattgtacgggattaagcgaaagtattaagtgagccacctggggagtacgtcggcaacgatgaaactcaaaggaattgacgggggcccgcacaagcggaggaacatgtggtttaattcgatgatacgcgaggaaccttacctgggtttaaatgggaaatgtcgtatttggaaacagatattctcttcggagcgtttttcaaggtgctgcatggtagtcgtcagctcgtgccgtgaggtgtcgggttaagtcccataacgagcgcaacccttaccgttagttgctagcatgtaatgatgagcactctaacgggactgccaccgtaaggtgagaggaaggcggggatgacgtcaaatcagcacggcccttacacccagggctacacacgtgttacaatggccggtacagagggccgctaccaggtgactggatgccaatctcaaaagccggtcgtagttcggattggagtctgtaacccgactccatgaagttggattcgctagtaatcgcgcatcagccatggcgcggtgaatacgttcccgggccttgtacacaccgcccgtcaagccatggaagccgggggtgcctgaagtccgtaac

SEQ ID NO: 2210 - DNA, 913 bp, Parabacteroides merdae
  misc_feature (861)..(861): n is a, c, g, or t
  misc_feature (874)..(875): n is a, c, g, or t
  misc_feature (898)..(898): n is a, c, g, or t
  misc_feature (906)..(906): n is a, c, g, or t
cctatcagagggggatagccgggcgaaaggcggattaataccccataaaacaggggtcccgcatgggaatatttgttaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatggccgagaggctgaaccagccaagtcgcgtgaaggaagaaggatctatggtttgtaaacttcttttataggggaataaagtggaggacgtgtccttttttgtatgtaccctatgaataagcatcggctaactccgtgccagcagccgcggtaatacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacaggattagataccctggtagtccacgcagtaaacgatgattactaggagtttgcgatacaatgtaagctctacagcgaaagcgttaagtaatccacctggggagtacgccggcaacggtgaaactcaaaggaattgacgggggcccgcacaagcggaggaacatgtggtttaattcgatgatacgcgaggaaccttacccgggtttgaacgtantctgaccggagtnnaacactctttctagcaatagcanattacgangtgctgc

SEQ ID NO: 2211 - DNA, 1374 bp, Roseburia intestinalis
ctttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgctaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagaacatgtaatgtgttttctcttcggatcatcggagactgtcggaggggggttgtcgtcagctcgtgtcgtgagatgttgggttaagtcccgcaacgagcgcaacccctattcttagtagccagcggttaagccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggag

SEQ ID NO: 2212 - DNA, 976 bp, Ruminococcus bromii
  misc_feature (28)..(28): n is a, c, g, or t
  misc_feature (722)..(723): n is a, c, g, or t
  misc_feature (930)..(932): n is a, c, g, or t
  misc_feature (958)..(958): n is a, c, g, or t
  misc_feature (968)..(970): n is a, c, g, or t
tcttcggaatgaatttgattaagtttangtggcggacgggtgagtaacgcgtgagtaacctgcctctaagaggggaataacattctgaaaagaatgctaataccgcataatatatatttatcgcatggtagatatatcaaagatttatcgcttagagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggaaaccctgacgcagcaacgccgcgtgaaggatgaaggtcttcggattgtaaacttcttttattaaggacgaagaaagtgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccatagcctgcatttgaaactgcagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtnncgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcctactaacgagatagagatatgttnnngcccttcggggaaagtagagacaggnggtgcatggnnntcgtca

SEQ ID NO: 2213 - DNA, 1364 bp, Ruminococcus gnavus
agcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcatgaagtatttcggtatgtaaagctctatcagcagggaagaaaatgacggtacctgactaagaagcccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatcccagtgtccgagagttaagcggaatttttcgtgtagcgatagaagacatagagattagggggaacaccagctcgtgtcgtgagatgttgggttaagtcccgcaacgagcgcaacccctatctttagtagccagcatttaaggtgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgaccca

SEQ ID NO: 2214 - DNA, 959 bp, Ruminococcus obeum
  misc_feature (10)..(10): n is a, c, g, or t
  misc_feature (13)..(13): n is a, c, g, or t
  misc_feature (17)..(17): n is a, c, g, or t
  misc_feature (40)..(40): n is a, c, g, or t
  misc_feature (937)..(939): n is a, c, g, or t
  misc_feature (947)..(949): n is a, c, g, or t
cgaacggganacntttnattgaagcttcggcagatttggnctgtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttgggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgannnttaaccgnnnctttccttcg

SEQ ID NO: 2215 - DNA, 1357 bp, Ruminococcus torques
  misc_feature (8)..(8): n is a, c, g, or t
  misc_feature (34)..(34): n is a, c, g, or t
  misc_feature (41)..(41): n is a, c, g, or t
  misc_feature (43)..(43): n is a, c, g, or t
  misc_feature (46)..(46): n is a, c, g, or t
  misc_feature (190)..(190): n is a, c, g, or t
  misc_feature (229)..(229): n is a, c, g, or t
  misc_feature (359)..(359): n is a, c, g, or t
caccttgnttcgattcttccgatgaaaatcatgntgactgngnggnggacaggtgagtaacgcgtgggtaacctgtctcctacagggggatatcagttataaatgactgctcataccgcatataaccacagcaccgcatggggtgcgggtaaaaactccggtggtgtgagatggacccgcgtctgattangtagttgggggggtaacggcctacccagccgacaatcantatccgacctgagagggtgaccggccacattgggactgagacacggcccaaactcctacgggaggcaccagtggggaatattgcgcactgggggaaaccctgatgcggcgacgccccgtgagcgataaantatttcggtatgtaaagctctatcacaggaaaaatgacggtacctgactaaaacggctaaatacgtgccacaccgcggtaatactatgggcaagcgttatccggatttactgggtgtaaagggagcgtaacgagtggcaagtctgatgtgaaaacccggggctcaaccccgggactgcttgaaactgtcaatctagagtaccggagaggtaagcggaattcctatgtacggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtttggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagg

SEQ ID NO: 2216 - DNA, 1400 bp, Streptococcus thermophilus
  misc_feature (8)..(8): n is a, c, g, or t
  misc_feature (1393)..(1393): n is a, c, g, or t
cgctgaanagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgttccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctttnggagcca

SEQ ID NO: 2217 - DNA, 1541 bp, Escherichia coli
aaattgaagagtttgatcatggctcagattgaacgctggcggcaggcctaacacatgcaagtcgaacggtaacaggaagaagcttgctctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactcgtgcccaggcatgcgcaggaatacggaggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactcacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgmcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctta

SEQ ID NO: 2218 - DNA, 344080 bp, KLE1738
cccccgccagtaggcggcgttgcaggcggtgagcttgatggcgttgcccttaatgcgcccggtggagtccaggtgggggccggcgcacaggtcggtgaattccccctgcttgtagaaggagatggtggcgtcctcgggcaggtcgtggatgagctccaccttgtagggctctcccttctcctccataaactggatggcctcggcccggggcagctcgaaccgctccagcttcagcttttccttgcagatcttccgcatctccgcctccagctcggccagctgggtctcggagaagggctcgggggtgtcaaagtcgtagtagaagccattctcaatggccgggccgatggccagcttcacctcggggtgcaggcgcttcatggcctgggccagcacgtgggagcaggtgtgccagtaggtctttttgaattcggggttttcaaaggtgtacaggtttgcatcagacatggtgtgttcctccttgtagcatttggggcaaagaaaaatcccgcccctgatgatgtcaggggcgggacggatatcgtctcgcggttccaccctgcttgcctgtccttggggacaggccgcttcgtttccgctgtaacgggcggtgcccggcccagcctactgcccagaggggttcggggggcggctcggggagggtgcttgatccggtcctgggggcaggagcgcttgcagccgatgacgctccctctctgtgcgccgggaccggaaaggttcccgtcgttgcctgtttctgatgggggtattatatgcctgctggcgagaaatgtcaaggctttgcccggctgggtaagacaggattctctgttgcttcagcgttgtgaaaaaatatccctgccccacaggggcgaagagcctcgcccccataggacagggaatagaactgcgatgggacaggcgcctcacgctggcggattgccggtgtagagctggtagtagcgccccttcttctccatgagttcgtcatggctgccccgctcgatgatccggccctgctccaggaccatgatgcagtcggcgttgcgcacagtggacagccggtgggcgatgacgaaggtggtccggccgtacatgaggccgtccatgccctgctgcaccagcatctcggtgcgggtgtcaatggaggaggtggcctcgtccaggatgagcaccgggggatcggccaccgcagcccgggcgatggccagcagctggcgctggccctggctgaggttggcgccgttgccggtgatccaggtgttgtagccctcgggcagccggcggatgaatccgtcggcgttggccagtttggccgcggcgatgcactcttcgtcccgggcgtccaggcggccgtagcggatgttgtccatgacggtgccggtgaagaggttggtgtcctgaaggacaatgcccagggagcggcgcaggtcagccttcttgatccggttgatgttcaccccgtcgtagcggattttgccgtcctgaatgtcatagaagcggttaatcaggttggtgatggtggtcttgcccgccccggtggagcccacaaaggcgatcttctgaccgggggtggcgtagagcttgatgttgtgcaggaccattttctcgtcggtgtagccgaagtccacgtcatcgaaggtcacgtctccctccacccggacataggtgggggcctgcccgtcctggccggggcgcttccaggcccacacgttggtgcgctcttgggtctccaccagagtaccgtcggccccttccttgacgtttaccagttccacgttgccttcatcggtttcgggaacctcgtccaggagacggaagacccggtcagcaccggccaggcccatgatgaccgcgttgagctgcatgctgatctgggcgatgggcatgttgaagctcttattaaaggtcaggaagctggccaggccgcccagggtgaagccacccactccgcccagggccaggataccgcccaaaatggcgcagaggacgtagctgatgttgcccagttgggcggagacaggcatgagcatgctggcgaaggtgttggcgttctgggcgctctggaagagggcctcgttgcgccgggtgaactcctccacgtttttctcctcgtggcagaagaccttgaccaccttctggccctccatcatctcctcgataaagccgttgaggctgcccaggtttttctgctgggccacaaagtaccggcccgacagaccggagaacttcttggtggtgaagagaaccaccgccaccatggccagggtgaggagggtcagggggatgctgagcacgatcatggacaccaggacgctgaccacggtgatggtgcagttgagcagctggggcatgctctggctgatcatctggcgcagggtgtcaatgtcgttggtgtagatggacatgatgtccccgtgggcatgggtgtcaaaataccggatggggagggtctgcatgtgctggaacatctcattgcgcaggtcccgcagggccccctgggtgacatagatcatcacccgggcctggagcaggctggccagcacgccgcaggcgtagaagagggccacccgggtgatggcgtggatcaggccggagaagtcggcggtgccgccggcctggacggttttcaccaggggcaggatatagctgtcgatgagggtcttggtgaacagggtgccctggaccatggacaggacactgaccacaatggcaatgaccaccacgatcaggtggagccaatactttttccccacaaaccccagcacccgccccagggtctgcatggggtgctccagcttgggtttggggccccggcctcgggcgcccggtacggttcttgccttttctgccatcagtgatcactcccttcgtcaaagtcgccgtttccgctggtctgggattcgtagacatcctggtagatggggttggttttcagcaggttctcatgggtgtcaaacccgctgatgaccccgtcgtccagcaccagaatccggtcggcgccggacacgctggagacccgctgggcgatgataaatttggtggtgtccgggatttcccgggcaaaggcctggcgaatgcgggcgtcggtggcggtgtccaccgcggaggtggagtcatccaggatgagcaccttgggctttttcagcagggcccgggcgatgcacagccgctgacgctgcccgccggagacgttggtgcccccttgttccaggtaggtatcatagccatcgggcatcttttcgatgaactcatcggcgcaggccagccggcaggcccgtttgcattcctccagagaggcgttctcgtcgccccagcgcagattctccagaatggtgccggagaagaggacgtttttctggagcaccacggagacctggtcccggagggactccaggtcgtattcccgcacgtcccgtccgcccaccagcacctgcccggcggtgacgtcgtacagccggctgatgagactgaccaggctggtcttggcgctgccggtgccgccgatgatgccgatggtctcgccggagcggacggagaggttgatgtccttgaggaccggcttgtcggcgtttttccgataagcgaagtccacgtggcggaactccacggagccatcggcgatggtatgcactggatgttccgggttcaccaggtcgggctcctccttcaaaacttcacagattcgctcggcgctggcggtgctcatggtgatcatcacaaagaccatggagagcatcataaggctcatgaggatgttcatgcagtaggtcagcaggttcatgagctccccggtggtcagggaactgcccacgatcatgttggcccccagccagctgatgagcaggatgcaggcgtacacggtgaagttcatcagcggcgcgttccaggagagaatcttctcggcggagaggaaggtcttgtagatattctgggaggctttctggaacttcttgttctcatggtcctcccggacgtaggccttcaccactcggataccggtgacgttctcttggacgctggcgttcatgtcatcgtacttttggaagacctgcttaaagtatttcatcgcccggctcatgatgaggaagagcagcacgcccagcaccaccaccgccaccaggtagatactggccagctcggcgttgatggagaaggagagcaccatggccaccaacaggctggccggggcccggctgcacatccgcaggatcatcatgtaggcgttctggacgttggtcacgtcggtggtcagacgagtgatcaggctggaggtactgaacttgtcaatgttggagaaggaataggtctgaatcttttcaaacatggcctgccgaaggttccgggccagacccgctgaggcctgggcgccaaaccgggcgctgagcagccccaggcacaggctgaccaccgccagcagcagcatccagaggccggtggttttgatgtggtcgatgtttcccgccgtgacgccttcgtcgatgatggaggccatgagcaggggaatgaccatctccaaaatgacctcccccagcacaaagacaggggtgaggatggagacccgcttaaactccttgacttgggacagaatggtttttagcatgggcacactccttttggggaattagattggtttggatggcatcgcacagggacaagaaggtctccacctgctccggggacagcccccggatggccaggccttccacgtggtggaaggcctccatggactgctcacaggcccgggtgcccaggtctgtgagggagagttttttcagccgggcgtctccctggacgctttggcggaggatgtagcccttttgttccatcagtttcacgatgcccgccacagaggaacgggtgatgttaaagtgttcctcaatatctttctggtagacatcctttggtcggctccagtaaagatacccgaggatccggccgtgcatgctggtcagttcctccacaccgttggcgcgggcggtctccatgaatttacggttgaacgcatggtataagaacttgatccggggaccgaggtaccggtccggggtttccaggtgacgcacaggcatcccctcctcttagaaagttcggacatgaactgttcggtaacgtacattttaatcaaatggtgtttctttgtcaactgtgattttttacaataccctaccagtttaacggggaaattttttagggggcggtggggcgccgccgggccgccgaaacaaggggagaacacagaccggcggttgacatctgaggaagaatccggtatcttggtcttagtaaagtgtctccgagatccgtcccggaccacggaaagagaggaacttgcccatgaaaacctggaggaaacggctcgctgccgggctgctcaccttggtgctgggggttagcctggtgccgggggcctttgctgcctcggcctatgactgtccgggccagaaactggccgcactgacctttgacgatggtcccgggcgctattccgctgccattctggacaccctgaaggcccacggggccaaagctaccttctttatgaatgggtataatatttggatttatgcgtcccaggtgcagagaatggtggcggaagggcatcaagttgccaaccatacctacaaccaccccgatctggtccagagttccgacgctttggtccggcaggaggtcgacagcttggcccaggccctcacccagatcaccgggctgaaagggacggggaatacgagcttttacctgcgcccgccctttggcagccggaaccaacgggtgctgtccctggcggggaccccggtggtctgctggtcggtggactccagcgactggaagtaccgggacgccaaccatttggtcagctacgtctcctcccagaccagggacggggacatcatcctggtccatgagacggtgccctccaccgcccaggggctggaccggctgctgacccagctgcagtcccagggctttgaactggtcacggtggaggaactgttctggcggcggggcatcaccccccaggcgggcaagctctacttctccgcccagaacaccggggtgaaccggtgcgccaaggccctgtattttgacgagagcaagctggatacccactgggcctaccccgccatctcctttgccctggagcagggcttcatgtccaaaaaccagtatggggaatttacccccaacttccctctgacccggggcatgtttgtcaccgccctgggccgtctggcggggggaacggcggaagaggtggtgccctcgggctttacggacattcccatagaccactatgctgcgccttacgtcacctgggccaaggaaaccggcatcatgaacggggtctcggcggacacctttggggtgaacagccccttgacccgccagcagatggcggcggccctggcccggtatgcccggtaccagggggcacagcccggtgcctttgatttgaatacctattccgacagtgcctccattgccgcctgggcccgggaggacgtggctgactgctcggccctgggcctgctcaacgggtccgacggtgccttccgcccggaggagaccaccacccgggccatgggggcggccatcctccagcgcctggcccgctacccctggcccgagattcccacagaccccgatgtgccgacggacccggatgtgtccaccgatcccaacataccttctgttccggaaactcccacggacccggacacgacccggccgcaaaacacctgatggcgaacaaccaaaacgcccccgcatcccggagatgggatgcgggggcgtttttcagaatgtggtggggcagcgtcctcatacccagaggggagagcccaggtagcgccagagcatggcggccacttgccctcggatggcgggttccctgggaataagggtgccattgtatccctggacgatcttctggtccacggcccaggtcatggcgtccgtagcccaagtggagaggtcagccaggtcggggaagtccataaccgtgcccgcactgggcgcagggctgccgtcgtaacgccagagcatggtggccagctgctcccgggtgacctggctgtcaggggagaaggtggtggggctggtaccttggatgacccctttctcctgggcccaggccacagcctgggtgtaccaggtgtcggcgggtacgtcggagaaggtgacgtcgccggaaaccgctggctccccggccatgcggtagaggacggtggccaccatggcacgggtcatgggggcgtagggagagaacgtggtctcactggtgccctgcatgatgccggcggcatagagatagctggcagcagtggtggcgtagtagggggcagggtcttcgtaggggtagaccagggggtcggatagtacaaagttgacatggacttggaagggagaggcgggcatgacaaaggaatagcgtccgttgcccaggtctttataatccatggcaaggaagagccgttttaacttgtagtggggggcgggggtgacggtgaaggtgacggtgtcccccttggcagggttggtgtcggagaacgtcaccgtgccctctccctcaaggatgacagcactgacgggatagtgaaggggatcgccgccggtcttggggaagacggcggtgacaactcctctgttgtcataggaataggagacttccgtggcaccgggaacctggaagaagtcctcgctgagtccgtccagggtgtaggtgggcttggcctccagatagacggtggcggtgtaaacggtgtcgggggcgaaggtgccctcatggagttcagggtcccagaagatcccgcggggaaaccggtactggtcggtttcgggaagttcctgcatggggacctccccggccaccggtggggtgatggccagttggcgcagggtgatgtcatttaggcgggcgtggagggtaaccacctgagaggcgatggttttctccccgctggtggccagacagcggtactgccagccgtccatatccgggtagactcgggagatggtataggtaggctgagtgacgaggaacaggttttcccaggtatcactctttttcagctgccactgataggtaggagcgggatcgcccacggcctggacggaaaagacagcggtatctcttccgggcatggcagtacagtcctggggctgctgggtgaaggccagctgggtccccgccgcaccggcccccaagggaaggacactcagcagcaggaccacggccaacaagagggaaacgcgtttcatggtacattcactccttttctctggggatggcttccattctattcataagacgagcgcagccccccaaaagtctctcctttatgatacaagaaaccgggagaaaaagcaatttattttgtcaaaaataacaaaaacgacgccccgccaaaaaagcgcagcagacttccagcgcccgcaggcgcaggaacaaatgagcccccaaatgtgaactccccggccgaaagcggccggggagtttgcgcgcaggggagcgcggcccctcaaatttgggagcccagcgaagggggtccccaatttcctcactctgcgtagttggtgaagtagttctgaatgacgatgaagggggtccccttatcgccggagccggaggtcagatcgcacagggagcccagcaggtcggtgtactgccggggggtggtgccctcggagctcatgtcccccaccaggtcggcgtttttggccttgatctcctggcggatggcctcttggagggcctccccggacaggtcggcaaagtcgttgtcggccaggaacttcagcttcagctcattgggcttgcccgccaggccggcggtataggcgggggagaccaccgggtcggccagctcccagatgccgcccaccgggtctttgaaggccccgtcgccgtagaccatcacctccacgtgcaacccccgctcctttgcgatccgggcctggatgctgtccaccactggctggcagttccgggggaagagcttcagcttctcctcggtggccttgttagagcccagcatgccgtacttgtcgtgatagccgctgccgttcaccggggcggacatcacgtcagccagggtgaagacggtcttgcccatggcctggagcacgtcccgggtttcgttccgggtgtggatatcgcagcagagcacctggtcacagaaggaggcgatgtagcggcagtcgttggagaagaggaaggtggccttggccccctcgctctcaatgacctcccggtagaagtccaggtagttgaccccggtgaaggggtggacgggggagccaaaggttttgacaaagtcggcctcctggaagtcatagaccccgctgtaccggttcttcagataggccgagcggaccatgagggggttgcccacctcgtcgttggggtagctgaacagaatgaccacctcgtccatggcccgggcgatgcccttcaggcacatggagaaccggttccggctgagaatggggaagaccagccccagcttcttcgcggggaatttattgcggatatcctgggcaacctgatccacagtgacatagttgccctgggcccgggccaccacggactcggtcacggcgatcacatcccggtcctgcagggtgtagccgtctgcctgctcagacgcatagacactgtttaccacgatatcgacgatgtcgtccccctcgcggatgatggggcctcggatgcctctggaaataacgcctgccatggtcatgtcctccaatatagttcaagaataggatcatttcttccgaaaaaataccgcaactattatacagggatgtgcccggaatggcaagttcttttttggcaaaaacgggggttttccccaggtttcttcccggtccggcggcgccggggggagagaagccttgcaggggcggggaagttcctgtataatgacctcaaaaatcaaaaaggaggaccctgctttgcagaagatcacaccatacaacgggttcgagctggggcccatccgtccccccagtgaggcgtacagtctgctgctgcggatcaaccggggctgcggctggaacaagtgccggttctgcggcttttaccgggacgtgcccttcagcatccggcgggccgaggacgtgaagaaggacattgacctcatcaaatactgggtggatgtctttcaggggaagcagcccccccggcaggccaagtccgagggggattacgaggcctgctccatggcctatcactgggtgcagagcggcatggagtcggtgtttttccaggacggcaacagtctgctcatgccccctgaccagctcactgacgtgctggagtacctcaacgccgctttcccccagatccagcgcatcaccacctatgcccggtcggacaccatcaaccgcctgaagcccgagcggctgcagcgctatgcccagctgaagctcaaccgcttccacatcggcctggagacgggcaacgacgagattttgaagcgcatgcggaagggggtcaccaagcaggcccagatcgaggccggcatcaaggccaaggccgccggcattgagatcaatgagttctacatgcccggcatgggggggcgggagtacgcccgccagagcgccctggacaccgccgacgtgatgaaccaggtgaaccccgacttcatccgcatccgctccatggccctggcggagaatctggagatgtacgaggactatgagactggcctgctcacccggcccaacgatgtggagaccattggggagatccgcctgtttctggagaacctccacggcatcaccagctgggtggacagcgaccacattttgaacatcctgctggagctcaagggccggctgccccaggacaaggaccgcatgctggccctcatcgaccggtttttggacctgccggaggaccagcagatgctcttccgcctgggccgccgcctgggcctcatgggccagctgcgggacctgagcaaccaggtgctggtggacaaggtgaaacagaccatggaccaggccaacatcgacaagaccaacattgacgccgtgtgtgaccggctgatgatccgggccattcccatttgaaggggggaccgggcagcggacgcgaaaggcttcctacccagggaggatgggtgggaagcctttgtttttttctgccggagagagaacaggaggggttcagggatgaactatgggtacatccgggtcagcacccgggaccagaacgaggagcggcagcggctggccatgggggagctggagatcccggagaagaatctgtaccgggaccaccagtccggcaaggactttgaccggccccagtaccggaaattggtgcggcggctgaagcgggacgacgtgctgtacatcaagagcattgaccggctgggccggaactatcgggagatcctggagcagtggcgggtgctgaccaaggaaaagggggtggatatcgtggtgctggacatgcccctgctggacacgagaaggggcaaggacctgatggggacctttctcagcgacattgtcctccaggtcctctccttcgtggcggagaacgagcgggccgccatccaccagcgccaggcggagggcatcgcggcggccaaggcccggggcgtccgctttggccgcccgccccggcccctgccggagaattttcccgccgtgcaccgggcctggcgcagcaaaaaactgaccctcaagcaggccgcgaaagcctgtgagatgccagtggggaccttctattccaaggcggtgcagtgggaaaccacggccgcactgccgcccggtttggatttgtaaaggtgtactttttcaaattactttatgggaaaagtacctatcaaaataatacatgtatttttccttttttgcaagatttttgggggaaatgaggcaattatttttttgtctgaaaaagtacactttttgaaagtgtggggggtgattgctctgcatttaacacctgcgagaccccaataaaatcagaaaggaaggaaaacaaaccaatgaagaaacgacttttgtccatgttcctgtgcctgtgcatgctgctgaccatggttccggcggcgttggcggcgggaacgactggtactgctgcgccggcgacggaagacgaaggcgagaccagcgggaatcagattaccgcaagcaccacgacattgacgacagggaactatgtccttgagagcgatgttacgttgaccagtggtgctttgaaagtggaagcgaacaatgaagttacgctcaatctgaatggcaagaagctgaccaaccaagccggtgcaaataccattgaagtcgccgcaggcggtacactgaccattgaaggtcccggcacagttgacaatgtatctcatcaaaaggctgccgttaataacagcggtacggttgttttgaatggaggcacgtatactcgcagccaagaaaagggtacaagcgaagaggatagcggaagcaattcttattataccattctgaaccatggtaccatgacgatcaatgagggcgtcaccgttaaccagggggaaaatggagcaggaaagttttccagcctcatcgaaaacggttggtataacggaaacaacaatacaggtggagagctctccgtcatgacgatcaatggcggaacctttagcggcggcctgaataccatcaagaatgatgattatggcgaactgaccatcaaaggcggcacgttctccagctatgcacaggcctgcctcctgaactggaatgtggcgacagtggaagggggtaccttcgaaggaaaggactccacgaacgcgacaatcctgaatggatatatcaatgacacgatggataaaggccagttgacgattcagaaaggaacctttaccggcccgtatatcttggaacagatgggtggaggtagcagcattggttctgttgtgatcaaaggaggttctttcaccgggtcaagcgggattgtgaaccaggagcaaggacaggaccttgggaatggcaccattgaaatttctggcggtacattctctcatgatgtcggagaattttgtgctacgggctatgcctgcgcaaaggattctgacaacaaatatgtagttaatgttgccgatggcgcgcaggtttctaccgataaggatgagagcggcaatgtgattgccacggtagatggcaactacagcggaggtgaaacccccgagagtggcggcaacggcagcatctccaccgacaattccggcaaggttacgattgatgtgtcttccgacgatggtggggaaactactactggcacagcagctgaaattacggtcggttccaatgccctgacctccatcaataagaatgagaaggtgaaggaagtcgagctgaaaaccgacgtgggcactctgaccatcagcgacgcggcctggaacgatatgacggccaaggcgaccgaggttgataagaccgccagcgtggtcatcaagttggaggacaagtctaaagagggcagcaacccagtctacgaagtcaccgccaccgtcggggaagaaaacgctttcgacggtagcggcgatggcgctgtgaccatctctgtaccttataccgcagacgggggaaaaggcaacgtcaaggtgtactgcacggataatggaaagatggaggacatgaatgcggctctgtctgatggcatcctgtcctggacaaccagccatttctccaccttcgaggttgttgcctatgacgggactgccgaggttacataccagactacgaaagatggaaccacctctgtctcttccggttcctttagtgatgccctgaccgccgtagcgagcaacggcggcaccatcacgctgctcaaggacgtgacagcgaccaatttcaatacgaccatctcgaaaaatgtcacgatccagggcaaagaaggcctcaagatcaatctcacaaccggcagcacaagcagaaataaagcgtttacggtttccaaggatgctaagctgacactggatggcgtgacgatgatgatctccggttccggtgaagaaggtcaagggattggggacggctttgacgtgcagtatggtggtgcgttggagttgaacaattctaacgtgaccctctctaatctggaagctgctaccatctctgcaaagcctcagaacagcggtgaggtaggaacgggtatctttacactcaatcactcgacaatcaccgccaccggtatccggggcaacttctccaatggtggagtctggacgcttgatagcgaatctgccattgagatcgacgactgtgatgcccatggtttcagtgctgatcgtatcgaagtcaaagggaattccaacatcaacgttgacaacacagcctatcgcgggatcagtatcaatagcacaggtcttggagaggacacgaatggcgggctaatcatcgaagctggcagtgcagtgtctgtgaccaactgtggcgacaaagaacatccagctgtgtttatgacgaatgatcatgccgcgaacctgattgtaaacgagggcgcgatcctcaacgtttctgctacggaggaaggaaagagcaatacgatttctctcagtaccaataatggttcgcaggatactctgaatggtgcagtgatcggaacagtgaccaagggagaagaaagcccaacgacctattatgagatcaccttcaatgtgactccgtctgacgccaacatcgttgtcaagggttctgatggtaaagcagtaagcgcggtcaacgggaagtatgcgctggagaaggataagacttatacctatgaggtctccaagagcggctaccgcacgcagaccggtacgttcaccgtcaccgaggcagagaccatctccgtcaccttgtcttccagcggtggaggcggcggaggtggcggttccgtcaccaccaagtacaccctgagctttgacaccaacggcggctccgccattgccaaggtgaccaaggagaaggggaccaccgtggacctggggcagtatgtacccacccgggagggctacacctttgccggctggtacagcgacgaggccctgacccagaaggtcacctccgtgaagctgaacggcaacaccactgtgtacgccaagtggaccgagaacgccgtgacacccaccctgcccttcaccgatgtgaagagcggcgattggttctatgaggcagtccagtatgtctacgacaagggcatgatgaccggcgtttcggcggaccggtttgcccctgcctccaccaccacccgcgggatgatcgtgaccatcctctaccggctggagaacgagcccgcggtgtccggcggcagcgccttcaccgacgtggagagcggcgcctggtatgccgatgccgttgcctgggcagcggccaacgacattgtcaacggcaccagcgccaccaccttcgcccccaacagccccatcacccgggagcagatggcggcgatcctgtaccggtatgccgcctacaaaggctatgacgtgagccagaaggcggacctgtcgggctacaccgacgccgcctccatcagcggctacgccaaggacgctctggcctgggccaatgcccagaagcttatcaccggggtgacggacaccaccctgaacccccagggcagtgccacccgcgcccaggtggccaccatcctcatgcggctgtgtgagaccgtggtaaaataatctacaaactacccgagaccggggagggagctgcggctctctcctcggttttttctctggattgggggcagagagcgatgggggctttttccatcgccgttggaacgggcgggaacggagccctcccgggcggggccctatttctttgaagaaataggggaaagaacaccaaggggaaggaggttccttccccttggaaccccattctctggtgggaggaatgggggaaggtggttggtcaggtaggggcctggcctgcggcctccaagaccaacgcctcatggcccgcccaccggctcgggcgggcgggagaggtggttcgttgacgggaggaaaaagtaggaaaaagaatggtttttctcctccttttcccaaagggtacctgtccacgtccccagcccgcccagccggtggacgggccgttacgggcctttcaatgtgagggccgcaggccaggtatcccgtaagaggtacagcctcccccccacataatcccaccagagaagggggttccgggggaggaacctcctcccccgggggttctttcccccatttcttcccaagaaatggggccccggccgggcaggccaaggttccctgccgttccaacggctgggaggccccaacagggaccagggttccaacccccggccggcttatcttccagggaaacaaaaaagtccccgccgcatacgcggcagggactcatgtagctgtttatttgattacttcagctcaaccttagcgccagcctcttccagcttcttcttcaggtcctcggcctcatccttggaaacgccttccttgatggccttgggagcggcctcaacaacagccttggcgtcagccaggcccaggccggtgatctcacggacagccttgatgaccttgatcttctcatcgccgaagctggccagaaccacgtcgaactcggtcttctcagcagcggcctcagcagcgggagcggcagcggcagcaacagcaacgggagcagcggcggaaacgccgaactcgtcttccagggcgtgaaccagctcggacagctccagaacggtcagagccttaacttcttcgatcagagcagtgatcttctcgcttgccatagtagtgtacctccaaatagtaaagtaaaataaaatgttttaacatcagtgcggagccaaccggggcgtttacgcacccttctggtcggcaatggcctgcatcacgcgggccaagccagagatgttggcgtccagaacggttgccagccctctgacgggggcgataagggtgcccagaacggtggccaccaggacctctctgctgggcaggtcggccagggccttgacctcgtccacggaaatgactttgccatccacgaaaccggacttgatcacgaacttctcctgggcggccagcttcttggagaactcagccaccaccttggccgcagccacagggtctccctcgcagatggcgatggaagtggtgccctccaggacgtcgcacagttcgtccaggccggcgttcttggcggcaaagcgggccagcgtgttcttcaccacgaagtattccacgccgttctcgcgcatcttggcgcgcagctcggtgtcctctgccacggtgatgccgcggtagtccacaatgacgccggcggcggcattctggaacttctcggtcagggaagccacaatggcctgtttctcgctgagaatctttgcgttaggcatgctgttgtttcacctccagagtgagaatggaaccaaagaaaaaacgttcccgcgccaaaagacacagaaacgtgaagcaatcatagatagagctatctgatgaactgcatcctcggcaggatttatggggcacctgctgtctttggaacgctgtaatattttatcattccggaaaggcgctgtcaagcgcctttccggaaaatgacaacggaatttgcactttttctgggaaaacccggaaaaatcagcccagcttcgcggcgttgaccttgatgccggggcccatggtggaggccaccacgcagctcttgatataggtgcccttggcggcggcgggcttggccttcaggatggcgcccatgagggtgctgaagttctcgcccagcttctccgcgccgaaggagaccttgccgatggggcagtggatgatgttggtcttgtccagacggtactccaccttaccggccttggcttcctgcacggcgccggccacgttgggggtgacggtaccggccttgggggagggcatgaggcccttggggcccagcaccttacccagacggcccaccacgctcatcatgtcgggggaggcgatgaccacgtcgaagtcgaaccagttctcctgctggatcttctgggccagatcggcctcgcccacgtaatcggcgccggcctccttggctgcgtcggccttgtcgcccttggcgaagaccagcacgcggggcaccttgccggtgccgtgggggagcacgatggcgccgcggacctgctggtcggcgtgacgggagtcaacacccagcttcacatggagctctacggtctcgtcgaacttggcgggggcggtcttgacaatcagatccatggcctctgcggtgtcatacagattggccttgtcgatctgctttgcgctgtcctgatacttttttcctctaaacatatctctaccctcctgccttactcgccaacgacaatgcccatggagcgggcagtaccggcaatcatgctcatggcggcctcgatggtggcggcgttcaggtcacgcatcttggtctcggcaatcttgcggacgtcttccttgctgatggtggcaaccttatccttgttgggcacaccggaccccttctcaatgttgcaggccttcttgatgaggaccgcggcggggggggtcttggtgatgaaggtgaaggaacggtcggcatagacggtgatgaccacggggatgatcagacccacgtcgttcttggtgcgctcattgaattccttggtaaaggcggcaatgttgatgccgtgctgacccagagcggggccaacagggggcgccggcgttgccttgccggcgggaatctgcagtttaacgtatccagttactttctgtgccacttagagcacctccattatgaaaatgtggttggacggagcggaagaccactcctcccacgcccgcgggactgccgcggggtcagatggactcgatttgatccaggtccagttccaccggggtctcccggccgaacatggacacgaccacccgcaccttctgacgctcggtgtcgatctcttccacgatgccgaggaaggactccagcgcgccgtcggtgatgcggacgttgtcgccgacctggtaggtcacaaggacctcccgcttttccacgcccagggaggcgatctccgcctcggtgaggggaatgggcttgtttccagagccgacaaagcctgtgaccccccgcacattgcggaccagatgccaggtctcgtcggtcatcaccatcttgaccagcacataaccggggaagacctttcgctccacggttttgctgccggcgtcggtgatctcggtgacggtctccagaggaatgttgaccgccaggatcaggtcgcccatgttgcggttttccacggccttttcgatggtggcttttacggtgttttcataacccgaataggtgtgagccacataccatttcgcttcttcagccatacgcgttcccctttcgtcaatgctggccgaaaagggagaggagagcgtcgatgacggagcttgcaatgccatcgaagatccaaacgatgatgcctacgacgatgacgcagacaatgacgatccccgtctttttcagggtatctgcccgggtgggccaggcgacctttttcagttccgccttcagctcccggaagaaccgccccacgcgcttgaaaaagccgggctttttgtccttgtcggacttggccttggccttttccgccttggcgggtttggtctctttcgccttctcctccgtcccgtcctggttcatcttttctttttcagacattcagttccacccttctttcttacagggaatgtgggccatcatcacttagtctcgctatgaacggtgtgctttctgcagaaggggcagtacttgttcatctctaagcggtcgggggtattcttcttgttcttcatagtgttgtaattgcgctgcttgcattcattgcatctgagggtgattttcacccgtgcgccggcttttgccatttgcggcacctcctttacgatgttcggccccgggaaaaacaaaacgccggaagtcggcctttcgcctgtccacaggcgattccgatcccggcgcatgcacagcagcccaaatgggcataaaaagaaaacacggctggatcggcatcgtttgcctccctatgtccaaacggtccagggtttgcgcccagataccgtaatctgcgcacaaaaaataagcccttttcataggtgtttccatgataccacaggcctgtccccattgtcaagacatttttcggatccagaggggctttctcttcccctggcggcggggccgggaagggggccttgcccttgacaaggggagggcttcacgataagataccattaaaacaactaaggaagtgatcgctgtgcgtattatggccatcgactatggcgacgcccgcaccggggtggccctgtcggaccccaccggattcctggccggacagacttttttgatcaagagccggaagcaggaggtggtcctggaggagctggccgccctggtccagcggcagggggcccaggagctggtgatgggctatcccaggaacatggacgggaccttagggccccgggcggagaagtacgccgcctttgcccgccggctggaggaggccaccggcctgccggtggccctctgggacgagcgccggaccacggtggacgcccaccggatcttaggggaacagggggtgcgggccaagaaccggaaggacaagattgactcggtggccgccaccttgattttggagggctatctggactggaagcgccttcaggcccagcgacaggaaagggaggaagagaccccatgaaacaggaagagcgttccgtacaatttcacatccagtgtgcccccggggacgtgggccggtactgcattctgccgggcgacccaggcaggagtgagatcatcgcccgctattttgacaaccccatccatgtggcctacaaccgggagtttaacatctataccggcaccctgctgggggagaaggtcagcgtctgctccacgggcatcgggggaccttcggcggtgatcgccttggaggagctctgcgccatcggcggggatacctttgtacgcaccggcacctgtggcgggatcaagctggaggtccagagcaatgacctggtcatcgccaccggcgcggtccgccatgagggggccagccgggagtatgcccccattgagttcccggcggtgcccgactatgaggtgctctcggccctggtggacaccgccaaggccctgggccatccctggcacgcgggggtggtgcagtgcaaggactccttctatggccagcacgcccccggccggatgccggtgtcctatgagctggaagccaagtgggaggcctggaagcgcctgggggtgctggccagcgagatggagtcagcggctctcttcaccgccgccgcggccctgggggtccgctgcggctcggcgtttcacgtgatttggaaccaggagcgggagaaagccggcctggaccaaaaggagtcggaagatgtcaccctgtcggtgaagctggcggttgaggcggtcaaggagctcatccgccgggaccgggctaaggagggacgggcatgagccaggagatccgccggtcctgcattgactgtgcggtgacccgctgtgacaaccacacctccacccgcccccaccctgccttctgcgtcagccagcaggtgacagaggaacagcgggcggcctccctgaaccagtatctcaccgaccaggaggaccgaaagctggcccaggtggccgcgggcattgagtccgacgggtaccggaagtggccccgggtccaggagaccatcctgttcgccaagcggatgggctaccataagattggcattgccacctgtgtggccctgctccgagagagccggatcttggccaagatgctccgggccaatggttttgaggtcttcggcgtggggtgcaaaaccggggagatttttaagactgagctgggcatcgaccaggcccaccagggccccggccccgtggcctgcaacccggtgctccaggcccagctgctcaacgaggcggggacagaactgaacattgtcatgggtctgtgcgtgggccatgacagcctgttttataagcatgccaaggcggtgaccaccaccctggtggtgaaggaccgggtcctggtccacaacccggtgatggccctgtacaccgccgaggggtattatgccaacctcatgcggcctttggaagacgaatgaatccctcccgcccctccgggggcgggattttttccttcgggggcgcataggttatgtttggggtggtgggtatggaacaaaaatttcccatggaacagggctggctcctctgccgggagaccggcgggcgggccgagctcaccatggaggtccccggcgggagccggggactctaccgggggtatgtcctgggggagcggggcctgatggacctgggcacccttctgcctgaggggaatgtcctccgcctgcgccggacatttcccgtggagcgcctgcgcagccagggatgctggccggtcaccgggggcagggtgcagatgacctatgctttcaccggccagcccgctgctgctccgccccggggctggaaggaactggaccatccggagaccctgtttccccaggacccggtgctggcccaggcggcccgggccggggggcgggggatgctctgccggcggcaggatgagaccttctgcctggcctacccctgggacccccgccgtccctttcccctgacaccggctttctgtctggcccgtgtcaagcttttgcgcgggcagccccatgtgatcttccgatttcgtcccgagggggtgcccatccccccagcggaggaggaatgagcctgcaccggggaagatgggttgccatctgccccaaactggggtaaaatgggggaaatgccaaagacaacggagcgacactatggattattttcacctgtctgaggacaaacaggacattttgaacatgagcagcctggggctggcctacctgggggacgcggtctatgaggtcatggtccgctcctggctgtgtctgcggggcaagctcacccctggggccctgcaccggtcggccctggactatgtggccgccccccgccaggcggctctgctggaaaagctgctgccggttctccgcccggaggagacccaggtattcaagcggggccgcaacgccaatcctcactcccatccccggggtgccacccgccgggagtatcaggttgccacaggactggaggccctgtttggctggctctatctccggggagagaccggacggctcaatgagctgtttgagatgatgatggaaggagaggactgacatgcccatggacgccctttgcctgtccgccgtctgccgggaggtggagccggcggtgctgggcggacggatcgacaagatttaccagcccagccgggacgaaattctgctgcagatccggggccgggcggggagctgccgcctgctgctgtcggccaaccccagccggccccggctccagctcaccgatctgccccgggagaaccccgccgagccccccatgttctgcatgctgctgcggaaatatctggcggggggaaaaatcctggccctccgccagcccccgatggagcgtctggcggagctggttgtcgaggccgccaatgagatgggggacaaagtccgccgccgtctggtgttggaagccatgggccgccggaccaacctcctgctgttggacggggaggaccggattgtggactgcctgcgccgggtggagggggacctgacccaggcccgccccctgctgccggggatgttttatcagtaccccgccccccagccggggaagaagaacccgggggccctcacccccgccgaccggacggagctgctggcgctgggacagggggcgggcccggcggaccggttcctcctggatcactgcatgggcctgtcgcccctgctggcccgggagctggcctttgaggcctttggcgaggtggacgccccggtgagccgggacccggcagccctgctggacaagctggagaggctgctggcccgcctgtcccagggggaggctgtgcccaccctgctggtccgggagggcaagccggtggatttctccttccggcccatcctccagtacggccccggcacggagagccgggcctatcccacctttgccgccctcctggacgccttttaccaggcccgggagaccgccgaccaggtgcgccagaaggggcaggatttcctcaaaaccctcacccaggcccgggagcggctggcccggaagatggccctccaggagaaggagctggccgccacaggcgaccgggaccgggaccggatgtacggggacctgatcaccgccaacctctaccgcatggagaagggggcccgggtgctgcggacggaaaactattacgaccctgacggcggccaggtggagatcccgctggaccccttgaagacgccccagcagaacgccgcccgctactataagaactataccaaagccaagaccgccgagaccatgcttaccctccagctggagaaaggggcccaggaggcggcctatctggacagcgttctggacagcgtgtcccgggcggagggggaccgagacttggaggaaatccgccaggagctggtggagaccggctacctccgccgccgggccaaggccaaggaccggatgaagcggcccggcgcaaagcccttggagtttcgctccaccgccggcctgcggatctccgtgggacggaacaacctgcaaaacgaccggctgaccaccaagcaggcggggaaatgggactactggtttcatacccaaaagattcacggtgcccatgtgatcctctggaccgagggccggcagcccgacgaccagagcctccgggaggccgccgctctggccgcttggttctcccaggggcgggaggggaagaaggtccctgtggactacaccccggtgaaatacgtgaagaaacccgccggcgcccggccggggatggtggtttacaccacctatcagaccgcctatgtggacccggaccccgccttggcggacacgctgcgtgcatgagaggaggcaaatcggatggcgtcttttgtctgttaccggttccagtgtccccggtatcctgattgcgccctggccgcgggaaagggctgctgcatcgagcgggacccggaccagcaggaggtcccggagggggcgtgcaccaaggagaaggagtatccctatttccgccctgctccgccgaatcctgtccatgcctggctgcgccggaagtgaaaaatctgtctgcataagccgggcggatttgccgcacactgaagagaagaggcggcccctcggagaggccgcgatcagggaacgtaaggttccgggaagaaggggaaataccagatgatctattttgaccacgccgccaccacccgcgtcctgccggaggcggcccaagcggcgatgaagaccatgacagaggactacggcaatccgtcgtccctgtatcagctgggggtccaggccgccaagaggatgggggagcaccgggaacaggtggcccgggccttgggctgtcagggggaagaggtctattttacctcgggaggaaccgagggggacaactgggccgttgccctggcggtccatctgggccgccacaagggccggcacatcatcaccacggcgatcgagcacgccgcggtgcttcagccctgcaaggagttggagcgccagggatatgaggtcacctacctccaccccgacgcctccggccgggttcgggtggaggacctggaggccgccctccggccggacaccgtgctggtgtccatgatgctggtgaacaatgagactggggccctccagccggtggcccaggcggcccagctgctccggcggaagcagtcggcagccttgctccacaccgacgcggtccagggctttttgaagattcccttcaccccgaaggggctgggggtggatctgctcaccatcagcggccacaagattggcgccatgaaggggtccggtgccctctatctccgcaagggccttcgggcggttcccctgatccgggggggcggacaggagcggggccttcgctccggtacggaggccaccccccagattgccgccctggctgccgccgcgtccctgggcagggagcggatggaggagcacaccgccgcgctgacagacctgaaagcctatgccctggagaccttccagcggggggtgcccggcctggcggtggtctccccaggggacgcgccccacatctgcgccatctccctgccggggtatcccagccaggtggtggtgcgctggctcagtgaccggggcttctgcgtctcctccggctctgcctgccatcgggggaaggccagccatgtctatgccgccatgcacctgtccaaaggggtgcgggacggggtgctgcggatatccttcggcccagagaacacccggcaggaggtggaccagctggcccaggcccttctggaggccacccgggacctggtgcctgcaaggggataaattgcgagggaaccgctcccaccgggagcggttcttttatggggcgaaggaaaaagtcttgcaatgacggggcggctcctgtacaataaaggaaaacagggaaagggggggatggtcatgtcggcggcagctgtaccaagccaagggtttgaagggtcatccctatggtatcggcggaagtgccggtattttttttgcggttttccctggggagaggagaagagaagatgaaagaaaaagacacgaccattggacaggcgcccattcgggacgcccgcaccctgggggcgcccaggatgttggtgctgggcctgcagcacatgttcgccatgtttggggccacggtgctggttcccattctggtgcagagctacggcctgcccctgagcacccagaccaccttgttctttgccggctttggcaccctgtttttccatctgtgcacgaagctggagattccggccttcctgggatcatcctttgcctttctgggcgggttttccgccatggcgaatttagacaccggcaagtacgctgccatggcccccggcgagaagctccagtacgcctgcggcggcattgtggtggcggggctgctctatgtgatcctggccctggtggtcaaggtggtgggagtccatcgggtgatgcgctttttgcccccggtggtcacaggccccatcatcattctcatcgggctgaacctggccccctcggcggtttccaatgcctccacctgctggtggctggcgctggtctccatggcgatcattgtggctgccaacatctggggccgtggcatggtgaagatcattcccattctgttgggggttgtggggggctatgtggcagccctgctggccggcatggtagacttcaccggcctgtccggcagcaccctgctggggggagagaaccccatcctgggcttgcagcccttctttaccgatttttccggcagcgtggccaagtttgacctgtccgccatcctggtgatggcccccattgcggtggcctccatgatggagcacatcggtgacatctccgccatctccgccacggtgggggagaacttcattgaaaagcccggcctccaccgcaccctggtgggagacggggtggccacggcgctggcgggcctttttggggggccggccaacaccacctacggggagaacaccggtgtgctggccctttcccgggtccacgatccccgggtgatccggctggcagccctgtatgccatggtgctgtccttttccccggcctttgcctacctggtcaataccattcccgccgccatcatcggtggggtcagcttcatcctctatggcatgatctccgccatcggggtgcgcaatgtggtggagaaccgggtggactttaccaacagccggaacctcatcatcgccgcggtaattttggtgtgcggcctgggctttaccgatggcctgaccttccatgtggggggcgtgaccatcaccctgacctctctggccgtggcggccatcgccggcattgttctcaacgccatcctaccgggcaacgacttccacttcggcaagtcggaaagcggagacgacgtggcctctctgggccggtattgagcatcgctgacagcggaaaaaaaccgcccccttccactgctggaaaggggcgttttttttcaaaaaacgacaggcccttggcgtttccaagggcctgtccgcatgtaaaaggtggcatcaggaggcgagggatttcttcttcccgtggggaataaaatgcccgatgacgccacagagcagggcgggcaccacccaggcaaagcccagggaggccaggggcagatgggacaggaaggcgatctccagaccggtataggagctgattacctccagcagactgatcaccagagcgcccagagcggccaggcggaacacccagtcgttgcggatgcggcggccgaagagggccagaacgatcagggccagcgtggggggatacaccacgctgaggatgggcgaggcgatggcgatgatctcattgatgccaaagttggagacaacggcgctgaacaggcagatgagacagaccaggaccggataggagagtctcccgccggagaggccggagaagtagttggcgcaggcgctgaccaggcccaccgccgtggtaatgcaggccagggccaccacgatggcaaagaggatcagccccccatggcccagcagctgctgcacaatggaggtgaccaggtaggtacggtccacggtgatgtcaaagaggtttgcggtggtggcgcccagataggtcagacccagatagaccaccagcaggccgatgcccgccaccaggctggcgccgctgaccacgcggatctgcgccttggccttggtgtatcccttggcctgggcacttttgagaatgatgaagccaaacaaaagggtggccagaacgtccatggtttggtagccggcctcgatgccggtggcggccacgttctccaccagggcctggtcccccaccgggccgatgggggagaccacacccaccacaatgaggatcagcaggccgatgagcagggcgggggtgaggattttgcccacgatgtccaccaccgcccgctcccgcacgcaaagcagcaggatcagcaggaagaagagcaccgagaagaggacggggctcacaccggagaccaggggagtcaccgaggtctcaaaggtggtggcggcggtccggggaatggccagcatgggaccgatgcacagcacgatggcgcacatcagcagcacggacgggaccttcccaatgcgggaggtgaccttttccgggctgccctgccggagaatagcgaacatcgccagcagagccaggccgatgtccgcgatgtagtagctgatgaagcccagcagccaatgggggccggactccagccccaggtagggggggaagatcacgttccccgccccaaaaaacatggaaaacagagcaaagccaatgatgaaactgtccttcaatggtttcttcatagagaacctccctttctgcgataggactgtgttgatagacgaacagaaaaaatacccttacattttttcaggggctgttacgcctaagagtcccaggcagttggccaggacagaacggacgctgtccgccagcttcaggcgggcagccagcagggcaggggtctcccccttaatgcggcaggcgctgtaaaaacggtgaaattctccggccagctccaccagatagcggttgatccgggaggggtcgtagtcccgggcagcagcgtggatctcctccggcaggcgggccagggcccggatgagggaggtctcctcctggctggagagcagctcggactggacctccgctgccttgggaacggcatacccctccccggccaggcgggcgatcagggtacagatccgggcgtgagcgtactggacgtagtagaccggattctcgctgtcctcccggaccgccagatccaagtcaaagtccacaggactggtggcggagcgggagttgaagaagtaccgggcggcgtccacacttacctcatccagcaggtcgtgcagggcgatggccttgcccgaccgcttggacatccgcacaggctgcccgtcctggagaaggttcaccagctgcatgagcaccaccaccagccggtgggagccgtccaggcccagcccgtccagggccgcctggagccgggccacgtgaccgtggtgatcggccccccacacgtcgatgctcttgtcaaagccccgaacctccagcttgttccggtggtaggcgatgtcggcggcaaagtaggtgtagaagccgttggcccggcggaggacatcgtccttcaggtccagcttgtctacctgcttctgactcttgccctcggccaggtacttgtttttcagcagctgggtggtgttcagccacagggcgccgtccttttcgtaggtccagcccttctccgtcagcagacccaccgtctcggccacatagccggaggtgtgaagggaggactcgaagaaccattggtcgtactcgatgccgtaccggcgcaaatcggcctgcatcttggggatgttccgctccaggccgaaggccgccagggcctccaggcgctgtgcctcttctacgtcccggtactggtctccgtggaggtcgtagaaggcctgggccagttcccggatatcatcgccgtgatagccgtcctcgggaaagggcaccttctcctcccccagcaggagctggaggtagcgggcctgaatggacacggcgaatttgtgaatctgattgccggcgtcgttgacatagaactctttccaggtgtcgcagccgtcccggcggagaatgttggccagggtgtctcccagcaccccgccccgggcattgcccatgtgcatgggaccggtggggttggcggagacaaactccaccatcaccttctggccccggccctcgtcactctgtccgtagaggggaccttcggcctcaatctccgccagcacatccccataccatttggcgcccagccggaaattcagaaagcccgggccggcgatctccaccgaggcgaagaggctgtctgtcaggtccatgtggtccaccaccgcctgggcgatggcccggggggccattttcatggccttggcgccggccatggcgaaggaggaggcgtagtccccgttctgggggtctttgggaatttccacagacccctttacttccaccccgggggggaggacccccgcggcggcggcggcggcgtaggcctgggcggtcagctggctgacctggtcctttgcgtgctgaattaaattcgccataatcgttctctcaccttttctctgtttaatggggtcactgacccggtgcgggggcggtcaaatgaggctcggtcacctgaatttcaaaggagttctccccaatgggctggctgtccacttccagggcatagcgaatggagaggcgcccccccgccgttcccaggtccgccttggcccggtgggtgttcacccccagcatcaggcccccatagggggtctcatacagggagacgtgcttctgcccctcctgaaagatcatctccgagttgagtgtgccctcccgccggagggtgatccggtccggcgcgatgcggaaggtggtggtggtgccctccaggccggtgagctcactttccagatagctcagggagaaaccctctccctcctcctgccggaggacgccctgggtgaccagctccatcacgtcttcctccccgggctccaggctctgtacccctcggattgagataatcactggtttttccatgaatacaatacacccatttcttttttgttggtgttcactgaaatgtaaactattatacatgatcgtacaacaaatgtaaagtagtcccaggacgcgctttggcagattcaggagagaaaactgaggcctttcggggagaattcgtggagttttcctgctttccacctttgacaatcggccttgggaacactataatagatggacgaccaggcaggggcaacttttcccctgtcatcgcttataatagtaaggacccattgtttcatttcacagcgaggaggtcatggtatgcagctggaattgagcaaaaaggaattccgacgtctgctggatatggtctatatcggcaactggattctcaactccacccggggagaggatcgttttcaggactacgacaaagtggaaagcctgctgtttgaaaaggcccggcaggaaggcatggggatcttggcggagacctaccaaggtgagaccatcccctcccgccccttcgtggaggggggcatccatgaggccattatggagtatgagaacaacgtcttttttgatatcctggccgaggatctggcccgccgggatatgaacgacgcccccattgacgagagcaactacgccgagctcacccaccggattgaggcgtatatcaacgagtttgaggagaatgggacggacaacattttggtggatatcgacatagcgccctgagtgaagacccataaaaacccggagcccctgtgagggggctccgggtttttgcatggcggcgcaagaggggattgacaggagggaaaactgtggtatactgtaaatcgtaagtgataagtagtaagtagatagtaaacggaaacctgtctgctgtatgaaggaggacgtatgcgagatttaactctgagccaggaatatttgctctgtgcagtgaacgagaagggaagactgccccatctgggggtggagagaacggtctgcctggtggcggcggcgctgctggagctccagctggagggctgtgtggctgtggacaaaaagtatgtgactgtgacaggacccctgccggaggggcaggcgcatttacggcccctctatgcgtttgtcaaccgtccaaagccgatccgaaaggagaagctgctggaggagtacacctatactgtcaccgatgctcagcgcgatgagctgctggagagcattgggcgctccctggcggacctgggactggtccagccggtaaaggtgggactgctggggaaaaagaagggatatgcccccaccccggaggctatcagcggtgtggtggatatgatccgcgcggagctgctggaggagggggagatcaccgaggacgtggtgtctctggttgttctgatggagaagggcaactgcctcaagccctacttctccgcctttgagcagaaacagatgaagcagaggcttcgggcccttggcgaatcccccactggaaaaatggtccaagagatggtagaatacgtggagaacatgatggccatagcggttggtcttattgcagtgtattcttgacgggagaacggggggcgccatgtccaggcagcgaaaattagaggtcatccagcaggcggaggacgtgaccatcggggagttggtccgtctgaccgacgtgcggtacagcaccttgaaattttacaccgagcaagggatgctgccctttcagcaggcggaggaaaacctgacccgtcgctataaacgggaggagagcatccgccggattcagtggatcaaggcgctgcggcaggagggaaaatccatccagcaaattaagcagatgctccacgcccaggggtgagaagggcggggaggaagcaaagaaaccggggcacccagtacagggtgtcccggttttttcaggttccgcagaagagggtgcccagcagggattgatagacagcccaaagggtcagcctggggacctcctcttgggccaccagggggagcttttgattctctttcccatccaccaggacggtgaggcttcccagctcctgccccttctccaccggggcctggagggtgtccgggagggaaagggtggtggagaccttgcctgcctcggccttgggaaggagaatttggctctcctgggtgagcaccggctgcacgctgtcggcggtgcccagggtgacgggaatgggggagatgggctcggagggggctactgtgaccagggaatatcccgcgaagccgtagttgagcagcgccttggcggtttcaaatcggtccgcagaggtgggggagcccagcaccacggcgatgagctccatcccgtccttttccgcggtggcggagacacagtagagggcggcgtcggtggagccggttttcagaccggtggccccctcgtagaatcggatgagcttgttggtgttggccagctggaaggttccgtcccgaagggtgtccatccagatggtggtgtaggtgcggatatccgggtggttttggatcagcgcccgggacatgagggcgatgtcataggcagaggagtgatgtccctcggcaggcagaccggtgcagttgacaaagacggtgttttccatgcccagctccgccgctctggcgttcatcttttccacaaaggtgctctcgctgccggccaggtattccgccatggccacacaggcgtcgttgccggaggccacggcgatggccttgagcatgtcatggacggagaacgattccccctccttcatgtagacctgcgagcctcccatacccgccgcggtggcggagacggggaccatggtttccttggtgatggtgccctcttccagggcctccatgatgaggagcatggtcattaccttggtgacgctggccagctccaggggatcgtgggcgtgctcctcatacaggacctggcctgtggtcttctccatgagcagaacggccttggcgttgacctccggccccgccgcctgggcggggaggaggcccccgcacaggaccagacagagaaaggtggcgaagaatttcttcatagaaggacctcctggtgatctcggttgtctccactctatgtctggacagggagaagtatgcaggaaagacccctgtcattgaaaaaagagaaaccccgccggtttgcccggcggggcgagggaaaggaggtcaatcggcccaatgccgcagggtctcggcccaggcggtgtattgctccacttttctttggcagtcagcgctgtcggtgccggaggccaaaacatagactttgatcttgggttcggtgcccgagggacggaccaccagggtggtgccgtcggccagctggtatcccagcacgttggaccctgccaactccatggcggtagtctctcctgtggcagtgtcccgttcggtgccggtctggtagtcccgctggaggcagaccgtggtgcccgcgatctggtcggggggtgtctgccggagagcagccatgatggcctgcattttgcccatgccctccaggccgggcatcaccaggttcagggtgttttcgccataatagccgtatgtctcataaatggcctggagagcgtccagcagggtcatgccccgggcggcgtaccaggcggtcatctccgtgagcagaagggcggcggtaaccgcgtccttgtcccggacgtagtcgccgatcatgtagccgatggactcctcataggagaagatcacgtggccctggccggcggcctccagctggtttttcttttccgccatgaacttaaagccggtgaaggtgttgtagcaccgcaccccattggcctcggccaccacctgggccagctgggtggtcaccagagacttgagggccaccgggttctccggcagggtccccgcccggcgcttggcgccgatgaggtagtccagcaggagcaccccggtctgattgccggagatctggacatagtctcccttccggtcctttacctgaatggccactcggtccgcgtcggggtcggagcccaggatcagctgggcgtccacctccttggccagcttctgggccagggcaaagctctcgggggtctccgggttgggggatttcacggtggggaaggtgccgtcaatgaccatctgttccggcacgcagtgcaggtaccggatgcccagctgctccagcacatagggaatctgctggtatcccgtgccgtggaagggggtgtagaccatgcggaaggcgtcggtcacctgggccacggcctgcctgtcgttaatctgatccagcacgtgggagaggaatttgtcatcggtctcccggcccagcagggtgatgagcccctgggcccgggcctgttcgtagtccatggtcctgacatcgtcaaagacatccagggcctccatctgggcggcgatggccgccgcgtgctgggggggcagctgggcgccgtcggaccaatagaccttgtagccattgtactccgggggattgtggctggcggtgacgttgagtccggccacacagccgtactcccgcacggcgaaggagagctccggcgtggggcgcatggcctcaaaaaggcgcacggggatgccgttggcggccatcaccccggcggcggcccgggcaaattcctgggagtgaacccggcagtcatagcagatggccaccccctgggcggcggcggccggtccctcggccaggatcacctgggcaaaggcctgggtggcatggcggatcacatggacgttcatccgccgcaaccccaggcccatcaccccccgcaggccggcggtgccgaactccagcaggccgaagaaccggtcttccacctctttggggtcgtcggcaatggcctgcagctgggctttctcctccggggacagggcgtcgctgtgcagccagcgatggaattgctgctgataggacatagaaaggctcctttctcagagggggccggcaggatggaacccgagccctcctccggactatttgtggtagcgggtgcctgcggcaatttggaaggcccggtaaacctgctccagcaccatgacccgggccagatggtggggaaaggtcatgggggacatggacagacgcaggtgggccgcctccttcactgaggggtgcaggccgaaggacccgccaatgatgagggtgagatgggaggccccttccaccatccactgctccatctgggcggccagggcggggctggacagctgaactccctccacgcacagggcgatgaccttggcgcttttggggagcttggccagaagggcctccccctccctggccagcgccccctccacctgggtgggggtggggtgctccggcagccggacctccggcagctctgtgacagtgagcttgcagaaggcccccagacgcttttgatattccgcgcaggcggcggaaaaatgcttctctttcagcttgcccacgcagagcagttggatgttgaccatggaaggactccttacaagatggtacgaagaaaagtggacggcaggcctgcccgccgtccacagacgaagtgacacattccgtctcccggacaggggacggggcatagggggcggaagtcagcccacactgtttccgctgcgccagtcctcctcgggaatggcttcctcgtggatgtcggcgcccagtttggccagcttttccacaatgccttcatagccgcgctcaatgtgatagacctggtcgatctccgtgatgccgttggcggccaagccggccacgatcatggccgcgcccgcccgaaggtcacaggcacagaccggggcgccggtgagggcgtgaaccccttcgatcaccgccaccttgccgttgacctggatgttggcgcccatgcggcggaattcatcggcgtagcggtaccggttgtcccagacaccctcgttgaggatgctggtcccctcggccaggcacagcaccgcggcaatctgaggctgcatatcggtggggaagccggggtagggcatggtctttacattggtgctggtgagcttgcccgaccggcggacgatgagggcgtccccatcctcctgaatctccacccccatctccaccagcttggcggtgatgcagtccagatgcttgggaatgacgttgttgatgcggacctcgccgccggcggcggccacggcggtcatataggtgcccgcctcgatctggtcggggatgatggagtagaagccgccccggagcttttccacccctcggaccttgatgacgtcggtcccggcccccatgatgtcagcccccatggagttgaggaagttggccaggtccacgatatggggttccttggcggcgttttcgatgatggtcaggccatccgccagggcggcggccagcagaatattcatggtggcccccaccgataccacgtccagatagatctgggcgccgtggaggcggcctgtgggggaggcggcgtaaataaagccgttttccacctgaatctccgcccccatggcggaaaaacccttcaggtgctggtcaatgggccgcacccccaggtcacagccgccgggagggggcacctcggcccggccgaagcggcccagcagggcgccgatgaggtaataggaggcgcggatctggcgggccagctcataggggacattctgtttatagacatgggagcagtccagctccactgtggtctggttgatcatgcgtacgttggcgcccagatcccgcataatccccaggatcatggtcacgtcgctgatgttgggaacattttcgatccggcagactccgtccaccagaagggctgcgggaagaatggccacagcggcattcttcgcgccgctgatctcaacctcgccgtggaggggttttccaccgctgatcacgtattttgtcaaaacggcaccttcttttatatggttctgagaaatgagataggtagcaaagcaatcagaaacgcgaagccgggaccgtctccggttctctctctatcatatccgaattttccggacaaatgtacccggattcggcgcgggagacggctggtccgaaagctgcattcatgtcaccttctgtcccgaaacagggacggaaggaaacaaactgttacactttgttcgaaacccggggccaaaaaggaaattttggcgcacgcttcgcccaacggtggacataccaccgcctataatttgacctcattatagcatcaaggggctgaaaaaaaaagataaattttaacaatttctcagtttattttgaaaagaagatgggccgcgcggcgccatcgtcccaggaaaacggtggaaaagccttggcatatctacgtttttctctccgggcgctgcggccaagggaaacaaaaaagaagggaaaaatttccgattcttttgaaaatttaggggggaaactccaaaaatgacagcctggaaaaggggaaaaaggagggattccggcgaaaatccctcagcagagcggggcggcggcggtctcctccggcagccggggcaggacaaaaaacagcaccccttggcgggaggaaaaggacttcacctccatggccggcgggatggggtggcgggccttggccagggcccggcggatgaggggaaggaccgcttcctgggtcagcggacggaccgtgggaagctcgtcgtgggagaaatagagcaccgaaccggtgtcaatggcggaaatggtcatgggtacctcctgagggtggaatggatgctccccattataaagcaccctggggcctggggcaaatgtaaaggttgccagtgggaaaagaagttggcagcgggacggaaatatgctataattcttagcatcatgggacttgctctccccggcggggcgccgccgccccgggggaacaggccgccgcacattccagagaaatcgaggtaccagccaatggaattgaaggaagaaatggtctcccagcagaccgtgtacgaggggatcatcgtcaatgtccgccgggacaaggcccggctgttggatggccggatcgccaaccgggaggtggtggagcaccccggcggggtggcggtgtttgccatggacgggcagggccgggtggcgctggtccgccagttccgttaccccctgggcgaggtgaccctggagctgcccgccgggaagctggagcccggagaggacccccgggccagcggcctgcgggagctggcggaggagacgggactgaccccggggaccttcctgcctctgggcagcatcgcctcctccccgggcattctggccgagcggattcacctcttttttgcccgggatttggtccagggggaggcccgccccgatgacggggagtttgtggagaccctctgggttccctaccaggatctgctggacatggcccgccggggagagattcaggatggaaagaccttggcggggattctcaaggcgtccttcctgctggaggcgccccaaacctgagacaaggggacagtggcgttatggagaaaaagcaaaaggtcctcatcgtcgaggacgagaaaaatattgtggacatcctccgctttaacctgcgcaaagaaggctatgataccctggaggcctttgacggcgtcaccggcctccgcctggccctggaggagagtcccgacctgatcctgctggacctcatgctgccggagatgaacggctttgaggtgtgcaagctcctccgggacaaggggaaaaacaccccggtgctgattatcaccgcccgggaggaggagaaggacaaaattctgggcctggacctgggcgcggacgactacatcaccaagcccttctccgtccgggagctgatggcccgggtcaaggcccatatccgccgggtggcgctgatccggcagtccgcgggaaaccaggaggaccgcctggattttggccgtctggtgatccacaaggagagtgcccaggccaccaaggacggggagagactggagctcacccagcgggagttcgagctgctcacctatctggcctcccacgccggccgggtattctcccggcaggagctgatggagcgggtgtggaactatgagggctatgtgggggatgtccggggcgtggatgtggccgttcggcggctccgggaaaaactggaggacgacccggcccagcccaagtacatcatcacccgccggggggcgggctactatttccaaaaagacctgtgaccggggaagacagagagggggaggaccgtgctgcgaagcctgcacatcaagctggtgctgattatgatcctgctggtggtctgcctgatggccattgcgggagcctttctgatcaactccgtcaaccggttttatctcaatgagttttacacccagatggtggaggtgttcagcgaggacacggagtttgtccgagacctggtcaccgcccgggagggggagcaggatgggggagaagccatcgaccagatcctgctggccaaaatgggtccgctgggggtggacgggaaaaaccggaattactatatcctggacggggagacagcggagatcctggccagctccgatgacgacggtgcccagaccctggaaaagctcacccccaacctcctgattgccctcaatgagaagcgggagggaaatgagagcgatctcaccgccaattatatggacctggctctgcccatccaacggggcgggcaggactatatcatctatattctggatcagcgggccacggtgcgggagctcaacagtcagctgttccagctgatcattgaggccctggcctttggcctcattatctcagtgctcctctctttcctcctctcccgggccatggtcacgcccatccgggcgctgacccggggggcccaacgggtggcggagggggattttgaccacaagatccaggtggagtcccacgacgagatcggggtgctcaccaacgccttcaacgccatggccggccagcttcagtccaccctccaggcggtggacagcgagcggaccaagctcagcaccctgttccttcacatgaccgacggggtggtggccttcaaccagagcggagaggtcatccacgccaaccccgctgccgaggagatgctggacatggagattcccctggggggaacggttacctaccaggatctttttggggagatcgccccgctggagaccatcctcaccctggagcgggactgcctggagagcgagaccgtccggggagagcgcacgctgctgttcctcctggcgccctttgaccgggagaagcaggtgggggtgctggtggtggtccacgatgtcacccagcaggtgaagaacgagaccatgcgcaaggagtttgtggccaacgtctcccatgagctccgaacccccatcaccaacattcgcagctatgccgagaccctggaggagaaccccgacctgcccccggagatgaccggtgactttttgaaggtgatcctcaacgagagcgaccggatgacccatattgtccaggacctgctcaccctgtcccggtttgactcggggtacagccagctcaacctgaccaggttcccctttgcggcggtattggaagacagctatcaggcggtgcggatcgaggcccaacgccatggccaccagctcctactggagggaacggaaggactgcccaatgttcggggggaccgggagcggattttgcaggtgattatgaatatcctctccaacgccatcaagtataccccagacggtgggcggattgtcatgtccgccggcgccgaccgggagcgggtctggctggaggtggccgacaacggcatcggcatccccgacggggatcgagagcgaattttcgagcggttttaccgggtggataaggcgcgctcccgggagtccggcggtacgggcctgggactctccattgcccaggagatcatccgccagcatgagggcagcctcagcctggtggagcggtccggccccggcaccaccctgcggatggagctgaagagggaggggcccaagggatgagacggaagctgagccgccgggagattgaccggctggaaaacctcctcatcctcctgctggtctgtctggcgctctttctcatccacaggaccgggatgtttcagagcgtcaccgagcaggggagcggaacaggggacgagagtctctttgcgggggttcaggataccgccctgtcccggggaaccccggtgcgcttgatggtgcagaacggaacaggacgctatggggtgcagtacgatcagacaacggtgaaccggctgtaccacgatgggctgaacgacctgctgacccagtctctggacaccatggcttccccccaggccagctcccgggaggcatgggagcgcgcggtgagccaggggagcagctgggtgtactatgactttctctataatgtctcctttaccagccagagcagccggggggagggggaggcccggtcgtttctgatcaccgcccgcaatgggcgggcggatgccctgtactactacaacgaggagacaggggattactatatggcccagctgcgagaggccagtctggttttgccggctttgctggaggacctggtccccaacggaggccagtttgcctttgagaattcctcgttggcggataccctggccccctatatgatgctgcttccccagccgcccctctgccctgtctacacaggggccaatcccctggacgactgggacacggcggaccaggaggccctgctggaggcgctggatttcaatccccgggcctccgcggtctatgaggcggtggacggcacggtgatccaggagggatcggacaccctgcggattcagaagaacgggaaaatcaccttccacgctgcggagagtgggcaggctcggtttcaggccctctccgcccgggaaaaggacctgcagatcaaggcggaggagattttggacggggtcacagcgggacacctgggggaaggcacgatgttctgccaatccattgaaacccaggaggatggcagtgtggcgctggtgttctgctatctgctcaacggcacccaggtacagctgtgggaggaggggtggagcgcccggttcctcttcgagggcagtgactgcaccgccttctccgtctgcctgcgggagtatacgctcacggagcggtcccagcaggctcttcccgagcggcaggccgccgccgccgccgtggccatggggcagacggggaaagagcttcagctgtgctatctggacaatggcaccaccccggagattgcagccgattggacggtccgggagcggacataaggagggcggtgtatggaacggtccaaactgaagctgacggtgatttttctcctgacggtgctggatctttttctgctgggaagtgtgctcatgcagtgccaccagtcccgagactacgcccgcaccacccagacgcagattttggtgtacctggagcgcaatgggattgaggtccagcaggagaccatcccgtgggagagcggcctctcagcccggcgggaggacctggcagaccagattcttccggacagtgaatggccggcccagggcctgccggacaactgtgaggtacagcccgcccgggagcccgccacgctgctcatggactttgtccgcggcctgtccgagctggggcagacctgtgagacgatccacgggattcaggagggctattggtacagcggcgaggaggaccgggcggttctcacccccatgtgggagattgagaccgaccaggggacctttctgctggactgtgcccaggggcttctgaccagggcgacgtaggaaagcggcagccgacataggctgccgctttttatttggaaaatgacatcccaccgtggaaaccacggtgggatgttgtcaaattaggtcatatttttccttcagctgcaaaatccgcagaacactttgatccagccgttcctgggaaatggtccccttctccacggcggagaggagggcgtcgtaggcttcggggaggtcctccggcatcagcagcagatccgcgccggcctggaaggccagcagggcggcttggccggcggaataggtgtcggtgatggcctgggcggacagggaatctgtgaggatcacccgctggaaccggagctctccccgcagtttctctgtgatcatttcccgggaaagggaggcgggcaggccgtcttgaacggcgttgggggcagtcatgtgggagaccaggacggcgtctgcgccggtggccatccccgcctggaagggatagatttcgcaggtcagcatctcctgccaggttttctcggtggaggcccggcccgtttgactgtcccagcgggcgctcccctccccggggaagtgcttcagggcacaggccacgcctgcctcatggaagccgtccaccgccgcgctgaccagcatggcggtctgctcagggtgggtgccaaaagaacggttgcccagaaccgcgttgtcagggtcggttttcacatcggccacgggggccagatccaagtgaaaacccaggtcccggagaaagctgcccagagccagaccggcctgcttggccttggccgggtctccgtccgcgcccactgtggccatatccgccacctggggggaggagaaggtctccttcccggcaaagggagagcggctgccgccctcttcctcgatggcaaagaggggagggacccgggaggactgggagagacgggtcatcagagactccagctggtccgggtcctggagctgtttcgctgtgcagacaaaaccgcccacagggtagtcttttaggacgttccgggcgctggcgtccacctgggtgagccctggctgattggggtcctggcgctgctggggggtctgggtggtgtccagggcgtcaggggagatcaaaaagagttggccgaccttctcctggacggtcagcttggccagcaattcctccgcgtttcccgctgtgaccggttctaccgcgccgggttcctcctggatggggggctcctctttcttgccgcagctgcacagcagcccggccatgagcacggcgcagagtatccatttccatttcattgtggttcatcctctctgggggggtgttggaaagacgggttccaagggatagtataccctttgaaccagaaaagcacaaggggcattccctgcttccgccgcctgaaaaaacgcgcgtaccgaacctcggtacgcgcgtttggcaaggaaaaaggaggggattatccttcttcctggatggctttggcgtcgtcgatggccttttgctgggcggcggggggagcctcctcatagcggacgaagtggaaggagaaggtgccgcggctctgggtaatggagcgcaagtcaatggcgtaggaggtcatctccgccatggggacctcggcctccagaatctgattgccgtcgtcggtggggttcatgcccatcacccggccccggcgcttgttcaggtcgcccatgacgtcgcccagatagctgtcgggaatggttaccttcagctctccaatgggctccagaatggtggggttggcgttggcaatcccctctttgtaggccagctgggctgcggttttgaaggccatttcgttggagtccacagggtgataggagccgtcatacagggtggccttcagccccaccaggggatagccggccagcacgcccttgttggcggcctcccgcaggcccttttccacggcggggaagaagttcttggggacgctgccgccgaagacctcttcggcgaagatcatgtcctcggactcatactggggctcaaagcggacccacacgtcgccgaactggccggagccgccggtctgcttcttgtggcggccatgggcctccacctttttcttgatggtctcccgataggggacccgggcgggactgagctccgcctccaccccgaagcggctctttaggcgggagaccagcacatccagctgcatatcgccggtgccggagaggaccacctggcgggtctcaggattgttgaccacggagaaggaggggtcctcctcgttcatccgggccagacctgcggccactttgtcgtcctggccccgggtcttgggggcaatggccttggaatagcagggctcggggaaggggatacccttcagggcgaccactttccggctgtcacacagggtgtcgccggtctttaccttgtccattttgccgatggcgccaatgtcgccgcaggagagctccttgacctcttcggctttcttgccgcacattttgtacaggcgtcccagcttttccgccgcgccggtgcgggcgttgaccaggggaagatcggaggtgatcaccccggaaaggaccttaatcatggagtatttgccgtactggtccgagatggtcttgaagacgtaggccgtgggcacgccgccgggggagaccacgaagtcctcggtctcgccgttctgcatggtggccttgtggtggttgccctccatggggttgggcagcagatccacgatgtagtccatgagcatcagtgagccgatgcagttgatggcggagccgaagaggacggggaacatggacagctcccgcacgccctggcgcaggccctgaatcatctctgcataggtgaaggactcgccgctgaagtatttgtccatcatttcatccgaggtctcggccacggactccttcagggcttcgttgaattccgccaccacgtcggccttttccgggggaatgtccacctccacccgcttaaagtcctgcatctcataggcccgcttgttgagcacgtcgatgaggccggtggtctttttgtcggcgtcccacatggggaccaccaggggggcgattttgttgccgtaccgctcccgcagggcgttgaaggtggcgttgtagtcactgttttcttcgtcggttttggagatatagataaaccggggcatatcccgctcctggcagtatttccagaccttttcaaagcccacggagataccgtccttggcggagcagaccaggatggcggcgtcggcggcccggagggcctccattacctcgccggagaaatcgaaagcgcccggggtgtccagcagattgattttacagcccttatactccaggggggcgactgcggtggagatggaaatctggcggcgaatctcctcgggatcgtagtcacagacggtgttgccatcggcgctgttgcccatgcggttgatggcgccggtcataaacagcaggctttctgccagggcagtcttgccgttgccgctgtggcccaccagacagacatttcggatgttttgcacagaatagctcatagcaatcttctctccttatttcagatgggacagggagggaaccccctctcctgtgccccgacggagtcacgcactccatagtcatggacttagtatacaacaagagtgcgtcaatgacaacacaaaaaataaaaaataactaaaaaatttgtaaaaatcagagaaaaatttcatttccttccggttatcccagtccgggccccgtggaggacggcgggacgggaatctcgtgaatctgtcctgtggagcaagagaccatcaggaacgtgacggcgttgccgttggcatcccggccggaaaagcgccagtaaccttggttgggactggagtccaaaggcaccagggtgagggtccgtccctgctgggccagataggccgtgagcagcgactgggcttcctgccggctcaccgcgggggcggggggatcgtcgggtttgtcccctgtgttgttgtcgggaggtgtgtctgtgccggggtcccctggggcgggatcaccggagggattggaggggttgttgggggtttggttgttattgggcggggactgcgggtcctccgtgtcgtttggggcggtgggccggtccgaaggggacggggcctccccctgggcgtctcctccgttctgttctgcctgctgctctgtatccttcgaagggtcttgcgggctgtctgggttgtcgggggcggcgggatcgctttcctcgctgccagcggcggggtcctgctcgggccgctgaaagacttcaatgactgcctttggcaggagtccatctgctccccctggcaggagaagctggcaaaggcccacaaccagcaccacggcggccgcagcgcaggccagccacggaagcaagtgccgtcgcttggagggggaagccgttggggaacggggcggggaagaggaggcggacttactccagtcctggctggccagagcgtccttgagggagtcagggggctcgacccaaagggaggtcatctgggtttgaaggtcctccagctcctgggccagctggcggcagtgggggcactgggccagatgggcatgcagctgggtctcctccttgagagagagcgccccgtccagccgggcgctgaggagaagctcatattcttcgcatgggttcattttgacatccctcctttccgccccagttgattagacggggaaccggtgggaaggttccccttttgcagcagaagttttcgcagcagcagtcgggcccgggccagccgggattttacagtgccctcctccaggtccagtgcctgggcaatctcgcggtagctcagcccctcaatttcccgcagcagcaggggaatgcggtggggctcgggcagggactcgatggcctgccacaggagctgccgccgttcgtgctcctcggacagctcctctggggagggcccccggtccgggacgacgggcaggtcggggtcatccagggaaagggcaccctggtgtttttttcgctgacggagcaggtcaatggcggcgttgaccgtcagccggtacagccaggaggaaaacgctgccttcccctgaaaggacggcagcccctgccaagccttgaagaaagcggtttaggtcacttcttccgcgtcgtggtggctccctgttttgcccagggccaggttgtagaccatcttctggtggcgctccaccaggcgggtgaaggcatcctggtctccctcccgggccaaggtcaccagctgccggtcatccatcgtcgcttgcatctttcagctcccgcttgatgccggcggtgacccgatagacgtcggccaaggtggagattttggagatttcgcttttccagtacccggcataggggacccctttcaaataccaggcatagtgtttccgggcctccagacaggcgattttctcgctcttgtactgggcggccagttcaaactgacgcacggcggtgtcgcaccgctgggacaggggagggaggggaggaatgggccgcccgtctatggcggcctgggcttgctggaagatccaggggttgccgaagacaccccgggcaatcataaccccgtctgccccggtgtagcggaggatacgcgcggcatcctggccggagaagacgtctccgttggcgatgacggggatggacagggcctgtttcaccctccgaatccagtcccagttggcggtgccggcatacatctgcaccttggtccgcccgtggagggtgatggcggcgatccccaagtcctccaggcactgggccaattccaggcagacgatgtttcccttgtcccagcccaggcgcattttcacggtgacggggatctcgccggctcctttccgaacggcctccgccacccggcaggctttgtccaggtcccggagcaggccggagccgtccccgttgttggcgaccttggggacggggcagcccatgttgatgtcgatgatatctgggtgggccacctcccgcacaatggcggcgccctcctccatacaggccaagtcgctgccaaagatttgcacgcctgctggatgctcgtcttcccccagccgcatcaggggcagggtcttttggtcttggtagcacagggccttggcgctcaccatctccgttatggtatagcccgcccccaactcccggcagatggtccgaaaggctaagtccgttacccctgccatgggggccaggaccagaggggagggaatggatacagaaccgatccgcaaagggatcacctcatttcaaaaaagtagagatttcgcactgtttttattatcttatcatagatcgacgctttctgacaacccggaggccctggtaaaccagggaaaggaagaaaatcccgggcccacgggccgtgcgtccccattgcaaaggcagggaaatgtgatatgatgggaggaaagcacagcgcagagaggcggggggaaccatggaagagcaaaaaagagagcgccacaccaggcaccacccggtccgggccttcttccgggggatgtatacggaagtggcattcagcggagagagccttcgcatcaacggccgggggctgttgtttggtctggtggtggggctgcttgtgggggtctggggtggcttgttcgcccgtctgttgggggcggcgaaccacctgcgggagggcaccggatgggcgatgttcctgctgcccctggccggcttgctggtggtgtggatgtaccgccggggcggcatcaaaacggccgggggaaccgaccttatcatccaggctgcccggggggagcagccggtctcccgtctgctggccccggtgatcttcgcggccaccctgctcacccatggttttggaggatcggccggccgggagggcgcggccctgcagctgggaggctccttggccgagctggtgcgcaaggggggaaagctgggggccgagtttcaggacctggcgatcatgtgcggtatgagcgcgggcttttctgcggtcttcggcagccagattaccgcggcgctgttcgcgctggaaatctcctgcgtggggattctgcccctggggggcctctttccctgcgtggtctcctctctggccgcagggacggtggcccgggccatgggcgtgcgggccatgcgcttttatctctccgcctccacccccgacgtgttgttctatggacaggtgctggtgctggggattgcctgcggcctgctgagtattttggtctgctataccttttccggtgtccgggcggggctggcgcggctgtttcccaacccctatctccgggtggtggtggggagcgccggtgtcatggttctcaccttaattttgggcacaaaagcctatctggggacaggggaggccctcattgcccaggccattgaccaggggagggcggcgccccaggattgccttcttaaactgttgctgactgcgttgaccctgggcgcgggactcaaggggggcgaaattgtgccctgctttgccattggggcctcctttggctgtgtggtgggtcccttgctggggctgccggcaccctatgccgcagctgttggcatggtttccctcttctgcggggtgacaaactgccccctcaccgccctgatgctggggtttgaggtctttttcttctgcaatcccgggggctttctcatggcggtggccgccagctttctggtctctgggtacagtggactctacgccaagcaaaaatttgccttttccaagaccgccagccccgagggactggcccatgaggcgcgccgggagcgcaccggtcctctgtgaggagcgcgcgcccggccctgccggcgctgcgcacgcggggctgcggctgggatcagaacccacggacgaaaatctcattttctgttagacgccccctggggagaaaagttcctttttcccccaggggacttgacaaatttctctaccttgtattacaatgtagctataccttgcgatgcaaggtagctggaaggagagaggagccttgattccatcccagatgctcaaaggtgtcctgcagggcagtgtgctggccatcctgggccagcgggagacctatggctacgaaatcgtgcaggccctgcatggctatggatttggcagcgtttccgaggggacgatctatccccttttgctccgactggagaaggagggatgggtttccgcccggtttatggactcggacctgggaccgcggcggaaatactatacccttaccgaccaaggccggagggagctggcgcagttccgggccagtttccgggagatgacggcggcagtggagcggctgccgggatttggagaggaggagatgacatgcggaagtcctctgtgaggaccttgcggcaggagaacaacgcccgggagagggcgctttcccgggaaagtcagcgggagatgaccgatgtggtggtctatctccgggggcaggacctgagccccttggaccaagaggagatccgccgggacattttggagatggtttgggaggcggaggcccggggggagaccatggcccaagtggtggggcaggactaccggaccttttgccaggagattgtagctgcggtgccccgccggtcccgccgggtgcggatggcggcggcggtggaggagcttctgcctgcgctcagcgttttgctgggcatttggctggtgaaaaaggtggtggaggctctgctgcgtggagaggccgtgatgcacctcaccctgacgctgggggaggcgatctccatgggggttctgctggcggcctctgtggggattgtgacctatctctgccggactgctttggagggagagagaggacgatcccggggaaaagggtttttcatggcctgggcattctgtgtggccctgctggcggcgatctttttgcccactttcttgctgacgaacccgctgctgacactctggcttcctgtggctgtggccgtggtcatcctgccgctgctggtccatggggtacttgccagatggatggaaagatgatataataaacaaaaagcgacaacaatggcgccgacggcgccatcgggtgagcacctaccggatgtaaggctatccttgcatccggtttcattttgagacaaaaggagagaaccattatgtggaacctactctggcccatgctcatggtggtgggggccaacacggtgtacaacatctgtgccaaatccaccccggagaagctcaattccttcgccgccctaaccatcaactatggggtggcggcggcactgtccctgctgctgttttttgtgaccacagggggagagaagaacctgatacaggagatcggcaagaccaactgggccccagtggtgatggggctgtccgtggtgggcctggagctgggctatatcctgatctaccgggcgggatggaaggtcagtgtggcctccctggtggccaaccttgccctggcgtgtatcctggtcctggtaggggtactttggtataaggaggtactgaccggccaccagatcctcggcataggcgcctgcgtggtgggcattctgctcatcagccgctgatctgatcccggtaaaaatacagcatgcccccagcagggaacgtgagccctgctgggggcatgctgcgtttcagggatgggcggcaaaatattcccgggtctgctctgcgttgtgcatcacttccgcagtcagggccgcgaaagagggaaatttgcgctcctcccgcaagtacttataaaactccatttggattttctggccgtacaggtctccctgaaaatccaggataaagccctcaatggtcagctgattcccgtcgtccaccgtggggcgggtgcccacattggtcacagcggggtgggtctccccattttccaaaatcaccttggtggcatagacccctttggcgggggagaggacgttttccttcagccggaggttcacggtgggaaagcccagggtggagcccagcttcttcccgtgggacacccggtcgctgagggtgtaggggtggcccagaaactcgttggcccgctcaatttcgccctgggccaccagggtgcggatataggtggaggagacggtgatgccctcctgctccaccttggggatgatgtcacagccgatgcccagggcctggcaggtctgctggagccgctggggattgccctcccctttgtagccgaagtggtagtcgtgaccggccaccagatggaccgcgcccaggtcccccaccagggtttcctctaaaaattcccgccagggctgcttcatccgctggggggtgaagggttccacgatcacatcctggatgccgtagtatttccgcatcaggtccgcccggtcctcgggggaggtgagcaggggcatgggccggcccaaaattacggtttgcggatggggatcaaaggtaaaggcggcgggagtggcgccgatttcccgggccacctgggcggtgcggcgcatcagcgcggcgtggccgttgtgcacgccgtcaaaaaagcccagggcgatcacacgttttttctgttccaacttcttacacctcgaaaaaacttttaatagtggtgagggcaccctgctccaaacggctcagggcgagaaaatctccccctcggctgtaaacccggtagacaccgtcctgcccctccagcgtcaaacgattcccgtttcgaagttttttctccgcggtcccatgtcgcagggtgagggcgggataccggctgaaatagcggtccaccgacagcagaagctgttggggggccggatgggccgacacttggtccatggtgaccgcctggtccagggaaaacccggccgactgggttcgacgcagggagaacagagcgccgccgcagcccagggcctgtccgatgtcgtggcagagggtacgcacgtaagtccctttggaacaccgtacccgcagggtgtattctgtgggggagacctgatccagcaggtccaaggcctcaatggtaatgggccggggctgccgctccacctcctggccccgccgggccagctcgtagagcttcttcccctcccgcttgatggcggagtacatcgggggaatctgggtgatctccccccggaaccgggccagtacagcctctacctggggacggtctgcacagaccggatgggtctccagcacggtccccgtggtgtcctgggtgtcggtgaccacacccaggcggaggccggcaaggtattccttttcccgttccgcggcgaattccaccgcccgggtggcccgccccacgaaaaccggcagaacgccggtggccatggggtccagggtgccggcgtggccgatccgtctctcccggagaagtccccggagcttggcaaccacatcgtggctggtccagccggcgggtttgtcgatgattaaaattccgttagccatgctgcacctgctcaatggcggccagcatggctgctttggcctgggcgggggtcccccaaatggtgcatccagcggcggcgggatgtcctccccctccgtggagggcacagacagcggaggcgttgagggtcttgccgtcggtgcgcagggaaattttgcactcctggggggacagctggcggatggtgaccgcgttgtccactccttccacctgaccgatgaaggaggagatatcctccaaatcctcctctgtggcctggagatcggcgatgagagccagggtgacataggcgaaggccagcgtgcccccctgggccagctccatctcctgtaccaggcgcccctccagctgcatccgcttgagggacttgacccggaagtggcgccggttgacccattgggcgtcaaagcccaccgccatgagggcggcggcgatccgatgggtctccggggtggtgttggagtaaacgaaacagccggtgtcggtggcaatggccatatacaggagcatggcaatttccggggtgaaggagatcgccatggcctggaagatccggtagagcagctctccgcaggcggcgcagctggggtccacacaggtctctcgaccgtatccctcgttggagccgtggtggtcgatcaccaggtcgatccggtccttgtaggccccggcgctgtcagggagcatgcccagggatgccacatccaccgccacaacatgctggggcagaaaccccgccggggccaggacaccctccagatagggggtgaaaagaccgtgggcgtcctcgttgggcaggacccaggcggtttttcccagctgccggagcgccaggcacagggcgctggcacagccgatggtgtccccatcgggccggcggtgggtgaggatcagcacttgatccagtgccgccagccggcgggcggtctggtggtctgtcatgggttgcctcccgtctctttccgttcgatgtcgttgaggagctttaagatatgggtacccttgtcaatggagtcgtcctcctggaacaagagctctggggtataccgcagggagagagcccggcccagctcccggcggagatacccgccggcggatttgaggccccggatgacttcttttccgtcctgctggttgagcacgctgacgaaaaccttggcgtaccggagatccggtgtggtgtccacgtgggtgatggagaccagcccgtggactctggggtccttgacggtgcgcagcagggctgccagctcccgctggatttcttcattgatccgaccaattcgattggaggccataacgcccctcctttccagggtaaccccgcccgggcagcctgccggagcgggccgcgggcggggagtcggttacacttcgatctgctccatcacgaaggcttcgatgatatcgcctaccttgatgtcgctgtacttttcgatgccaatgccgcattcgtagccctgggcgacctctttcaccgcgtccttaaaccgctggagggagctgaggaccccctcgtggatcacgatgccgtcccggaccagacggacctgggcgttgcgctgcactttgccttcggtgatatagcaaccggcgatgatcccggcgccggtgatcttgtagacctcccgcacctcggctgcacccagggccacttcccggaacttgggagccagcatgcccttcatggcggcctccatctcgttgatgcagtcgtagatgacccggtacattctcatatccaccttcatccgggcggcgtagtccttggcattggcgtcaggacggacattgaagcccacgatgatggcgttggaggtggaggccagcatagcgtccgactcgttgatggcgcccacggcgcagtggatgacccggacccggacctcttcgttggagagcttttccagggaggcctttaccgcttcggcggagccctgcacgtcggccttgacgatgatattcaggtccttcagctccccctgctggatctgggagaacagatcgtccagggtgaccttttggctggaggcactggcggccattttattttcatgcttacgctgctccaccagggttctggccatgcgctcgtcgtccacggcatggaagtcgtcgccggcgccggggacctcccccatgccggtgatctccacagggaccgaggggccggcctcggtgattttccggcctctggcgtcggtcatggcccggacccggcccacggcggtgccggcgatgatgacatccccctgacggagggtacccttctgcaccagcagggtggcgatggggccccggcccttgtccaggcgggcctcgatcaccgcgccgtgggcggagcggttggggttggccttcagctcccgcatctcggcggtgaggaccaccatctccagcaggctgtcaatgcccagaccggttttggcggagatggggcagcagatggtctcgcccccccattcctcagggaccaggccatattcggtcagctgctgctttacccggtcggggttggcctcgggcttatccattttgttgatggccacgatcacggggatctccgcggccttggcgtggttgatggactccaccgtctggggcatgatgccgtcgtcggcggccaccaccagaatggcgatgtcggtgatcatggcgccccgggcccgcatggcggtgaaggcctcgtggccgggggtgtccaggaaggtgatgggggagccgttcacgtccacctgataggcgccgatgtgctgggtgatgccgccggcctcgccttccgccacctgggagttgcggatgtagtccagcagggaggtcttgccgtggtccacgtggcccatgaccaccaccacgggggcgcggggggccagatcctcctctttgtcctcagcggtgtcgatgagcttttcctcaatggtgacaatgacttccttctccaccttgcaccccagctccatggccaccagggcggcggtatcgtagtcgatgatctcagacagggaggccataacccccaatttcatgagctgcttgaccacgtcggccccggtttttttcatccgggaggccagttcgcccacgccgatttcgtcgggaatcttgacggtaaggggggtcttcttggcgatttccagctggagccggcgcatcttctcctgctcctcctggcggcgcttgttgccgaagttgccgcccttgcggtggttgccgcggctttgaatcttctgcttgccgctctgcatcttgttggcccgctccggcgccaggttctccaggtgctcgtcgtaccgggccaggttgacgttgcccgctttccgggtgtccaccagcttcttctcggggacccgggtggtggggcggttggcggcctgcttggcctgctgtccctgttggggggcggccttttcccggggcgcctcgccgttgttccgggggccatcgttccgggccgggcggtccccgccccggctggatttgttcccctcaccccgcttctgctggccctgcttccggccgctgtcccggttgtcccgggggcggtcgtttttggcgccttcccccgccttgggggcgttggcgaaaacggcctgcaggtccgcgacctggttgtgctgggtcaggtattcaaagatgatggacagttccttgtcgtccagcacctgcatgtggtttttcggggttgtagcgtatgtggtgaggatctgggtgatgtccttggtctgtttcccaaaatccttggctacttcatgcacacgatatttttcaaaactcaaataaagccacctccatcacagccaggcccagacagggaccggctgcttgctcttttctctccgcggccggggacccggcgcggctacctacaaagtatgggaacggcgcttatccattcccttggctgccgtcgttggatgggccgtccggctttcgttttccggcccggcgcgcgcccttgtttttgtggggggagcgcttttccgcgcggcgtttcttgacccgggcggccttgttggacaaggtctcccaggcggggccataggcctcggggtccagctgggccagcttttccgccaccgccgcggcaaagcccacgtcggtcagcgccagcatggcgcaggaggcacggcccagcccgctgcccagctcctgtttggtcagggggagggtgaggcaaatggtttttccggcttggcagaaatgaagggcccggcggatggtgttgtccgccgcgtcgctggccagcagcagcaggtaccccttgtggcaccggcaggcgaccccgacgggctcctcccccacggcaagccgccctgctctgagcgcgaggcccagcagggagggaatgctatccatccagaccacctccctccatctgtgcggccagggcgtcatagaccgggtctgggatgggaagggcaaaggcccgctccagggctttggccttgcgcgcccgtttcagacagtccggactggggcaaaggtaagcgccgcgcccgggtttctttccgtggaaatccagggagatctctccctccggggagcggaccacgcggatcagctcccgttttggcttcatttcccggcagccgaggcattggcgcagggggattttttttggcacggtgccacctccttataggttgtatggacggtcagctctcgctgtcggtctctgggatgggatcgggctgggggtcgggggagggagtctccggggctgtttcctccggggactggaattcctcctccaggccagctgcttccgccgcttcttgggcagcccgctgggcttccgcgtcctcctcctcccactcgtgggcggcggaggcggccttgatgtcaatcttgtaaccggtgagcttggcggccagccgggcattttgcccctccttgccgatggccagggagagctggtcgtccggcaccaccacccggcagctcttagtgccctccagagggaggacggagaccacgtcggcgggggagagggaggcggccacatactcggcgggatcgtcgctgtacttgatgatgtcgattttctcactgcccagctcggccaccacgttgttcacccgggcgcccttggggcccacgcaggcgccgatggggtccacgttttcgtcggcggaccagacagccagcttggagcggctgccggcctcccgggcgatggagcggatttccacagtgccgtcgtagatttcagggacctccagctcaaacagacgcttgaccaggccgggatgggtccgggagatgaggacctggggcccccggctggagcggcggacctccaccacatagaccttcagccggtcgccttcccgcaccacttcgccccggacctgctccgagggggagagataggcgtcggtggactccccgttgctggtgatgcgcagggagaccgcgccgttgcgggggtctacccgggtaacagtgcccagaagcatctcgtgctctttggagctgaacatgtcatagatcatgctgtgctccgcctcccgcatgccctggatgatcacctggcgggcggtctgggcggcgatgcggccgaagttgcggggcttgatctcaatgcggaccacatcccctgtctgggcggaggggaggctcttgcgggcctcgtccagggcgatctcggtgaaggggttggtgacctcctccacgatctctttttttacaaacatgcggacggtctcggtgatctcgttggcctccacaaagacgttgtcggtgatgccctcgtggtcccgtttataggcggagaccagggcctgggtgatcttttccagcatatagcttttggggatccccttttccttttcaatcagggcgatggcggcaaagaattccttgccgtccagctcgttgctttttgcggttttcgatgttttcttagccatgacttagattctcctcaatagaatgttaaaagccaacgtgcaaacggacgaaagcgatctcctgcttggggaaagtgacggtgtcctcccccatggttaaggtgaccgcgccatcctcatagccggccaggatgcctgtgcaggtcttctgcccgttttttgcctggtaaaacttcacgtctacctgggcgcccaggtaggcctggaaatgctcgggctttttcagggcccggtccgcgccggcggaagagacttcaaaggtgtaggggtcctgaatggggtcggcctcgtccagcaagtcggacaggacccggctgaccgcctcgcagtcgtcgatggagacgccggtctccttgtcaatgtatacccgcagataccagctgcccgcctccttgacatactccacgtcccagagggaacagccgttggcctccaccacagggcgggccagctgggccgttaaatcggtgattttggacatcataacctccccgcgccccatgggcgctgcaatccaaatcgaagtggttcagacaccggaccggtcccccccgccggaaaagggagcgggcccggtccagttcataaaagaaagagcggggcaagccccactctacctaacttacatcttaaaatcgtgcttattataacacatgaatgaaagggttgcaaggggtttccggcaattccttggaaaaaccccggccggacccatcgccggggagagcaggaagggcgcctgtgtatttgtttgtacaaacgaaaaaaagatacaaaagtgggtaggaattatgaataatacgaaagttaaggacaaagacttgccgaaaatgggcaaattatgtacactacatttatacatgcttttttgaccccttggaaaacacaacaaaaggaggccagagccttggccaaacagaagaaacgtcgattgaaaaaaaagtaccgtgtcctgcggggcatttatgccgctgtggtggcagttgcagctgtcattgtgattggatatggtgtttataaagtagccgttccagcccctgagatgaagcccgccgcagcgaatgccacccaagaggaggaagtggcgccggggatggaacagggcagccacaccaggagagagcagacctacaccttcttgctggcctgcccggaccaggtcagcggcaatgccgatgccatcatgctggtcacctacgatgtgcccaaccagaagatcggaatgctctcggtgcccagagacacgctggtggatgagtccagcccgaagatcaattcctcgctccatggagggatagagaacctccaggatgtggtgtccgacctggtggggtatcccattgacttctatatcaccatcgacctggatgggtttgtggaactggtggacgcagtgggcggcgtggaatttgatgttcccgtggagatgtattacagtgatcccacccaggatctgaacatcttcttccagccgggcatgcagcacctggatggccaggcggccatggaggtctgccggttccgaaagaacggggatggcacagggtatcccttgggggatatccagcgcagcgagacagtgcgcaacctgatggtcactgtggccaagaagctggtctccaacatcgggaagctggatcagttcgtggatattttccagcggaacattgagaccaatctctctgggacggacatcacctggtttgttaccaaggccattggggtgaatttgagcaccggcgtgaccggtggggcgctgccgggagatggcaataccacctatcgggggacaagctactgttatgagctggagccggcggagagcctgactatgatcaaccagctggtcaacccctataccacctccctgaccccggaggatgtcaacttcttccaggtcaacgacgccaacggcaggggtatgcgggcagacgccagtatgtttaagaccgcagagaccgaagacggatcggcgggcacgggcagcgcggacacctctgtccgggacccggaatatgactgatccagcggaaacgcgaagagcagacgaggcttcggcctcgtctttttttgcggcaagggagagaattgacggatataaaatagtggcttgcaaaatgaaattggacaggattacgaaacgatgtgttttgtagggaacgcagggggtatttcgtaaaaaaattgagaaaatgttgaattattattcagttgcttcacaaattgtacacaaaaaattctgatttcagccaaataaattaaagaaaacgatcaggaagcgcctgaaaaggaatgatttcttgtgcaaatagtacacgttcgtggaaaatgacgaagggatatctgttgcgttttggtgaaaacgtgctataatgacgttgtatcgattgaaaagatgtggaaaagaagaaaaggaaatgcgctcatgcgtttttccgacagaaaaattgcaagtcaaagcaatgtgtatttttatgaggagggaccgtaaatgaatctcatgcttccaaccgcccggcggaaagacggtgagaagcagccctgcatcaaaatctggaagttcgaccttcgtattccctttgtccattacgaatgggaaattccggagatgattcaggcctgcgtcgtctttatgaccggctctgcggccactgcgtatctgcaggacctgtttggctttacttttgagatggctttgtccattgtgtttgtccatgagctgctgtacatggtcaacaacactttgggcgaccccctgatcggcgggtggattacgccggctgtgccgctcatcaccgcgttcctattgaattttgagggaccggaccggatgtacgccctggtggggctggaactgatcctgggcctgatgtatgttatcttgggcgtcaccggcattgccacaaagatcattgacatttgtccgcagagtttgaaagcggggattctcataggctccggctttgccgcctgttgtggccaatacggctttaaggcgttggaagacggcggggccggcttcttcaaatatcccatttcctggtccattggctgtgcgctgggtctgttcctgctgttttccaatgggtttggcaaggtgaaatttggcagtaaaagcaaactcattaaactcattaccaaggctggctttgtccctgccattattgtagcgggtgtgatcgctatgatcattggggagtgcgatctgccggacttctctacggtaaccagtttctggtttaaccccttcccgggcctgcaatgggtatggaacaacttctctattctgggcattgggattccgcccgcccatattttgctgcaggacctgcccatggcgattatgtgctacgtcattgcattcggagatatcgtgggcggcacggccttcctggaggataccaaacggtaccgggaggatgagtacatcgacgtcaaccccgaccgcaccaatatgtgctgcggattccggaacctgatcgaggctttcttcagccccacctgcaccatgtcgggtcctctgtggtccgccatgacggtgtccgtggccgagcgttataagacaggcaaagagaacatgtactccattttcggcggtgcctgtacgtttaataccaccaaatggatctgccagctgattgtccccttgatggcgctgatccagcccatcctgcctctggccatggcgcagaccctgattattcaggccttcggttccttctacgtgggcatcaacatgtgccgcaccaatgtggagcgcggcgtggcgggcatcaccgccggcgccatcgccacctgtgccaacccgtcctatggcctttttgtgggcattgcgctgtgtatcgtcatggagatcattgggatgtccaagaaggagcgccgtgccaatgtggaagagggcattgagatttatctgaagaacacccgtgctgagctggatgaacaggatgctaaggcagctgccaagctgagcaagaaggcttgagcagagtccatcgggtcgatcgcgtcaaatcattgttttccaaaatccaatcaatcgatctcgttctttttaggcatcgtcccggctctttgtcaaaggcaaagagccgggctttgtttccaggggaaagggatgaaaaatcccctctgccgacgggcagaggggaacggtgaaaaggggggcagggcaggggaggatcacttgccgctgccgtcctcccgcagaaaatctttatacagcatgctgggctgaacgccggtgttgttctggtatttcccagagtcgtacttttgatactcgccctgtatggtgtggtaataaatctggcagatctctacattgggatagatcacaatggggtggatgcagaacatctccagggtccagtaccctgcaaagcccacatcgccaaacccagcggtgacatggataaataggcccagccgccccacagaggagcgcccctccagcatggggacaaactgctctgtcttggtgtactccagggtgcggcccaggtagagcttattggtctccagcagtaggccgctgtccgggatggttaggtgtcggacaggattgttggccttcatgtccagggtgtcggtgtcgtagaccagcagctcgttggacaggcgtagattgtagctgttggggttgagctgagaggggtgatagggttcgatgataatgttcccacccagattcttctggatttcctcaccggacagcagcatgtgggtccctccttattttattatagggcaatgacaatggggaaacgagagcgtaaaggcggtctattgggcggcggtactgctccgggagagttccccatactgaaggcagatccccttgatacaggtctgcagtgccttacgcagatgtccgtagtagctttgattcagccgttccaccagagggtctggccctcgggtcagcgcgtagcccaccagaagctcccggatgaaccgtcgccccaactcggtggccatagtgcagtcggcatccaggatggtccccgtggaggactctgcggtgaccaccaggaccaagtggttgtacagtttttgcgccgtggtgttgtccggcagcttggcataaccagagagaaaaaccttgggcacggtcatttccccttccttttttatggactttactctatcacaggcagtctgggatgtcaatataagggtaggagcagctgaaagggggcaagaaaagtggagttagcgaaagataacaaaatgttgtgaacacccggtcgaagaaatcacgaaaaatccaaaaaaaccagaaaaaatctctcgatttctgttgacattctgtttcaatcgcgccataatgtccatggatttttatgacccctgcaaagcattattgaaggatgtgaatatgtatgcagccaaacaatcttgcaaaagaagtccggaagctgcttccgggcacggactgcactggccgaggcggatgcggatttgccacctgtgacgaatgcgccgctgccatcgcggaaggtggtccggcaaacctatgtcctgcgtgcaaagaggaggacattgctgccattgtcgctttgacaggcggcgagctcgtccccgccaggcaggaaaccgcgtttatcaaatgttccggttgcgcggccgggaagtccagactgaaggtatacggctcctgcgaggaggcggtgaagagcggctttgccgagcatgagtgcgtctatggatgcgtaggcgccggttcctgtgtggccgcctgtacctttggggccctgtctattgtggatggcaatgtccaggtggacaaggaaaagtgcaacggctgcggcgcctgcgccaacgcctgtgtacagaacctgatccacatggtgccgtccgatgcctccaacttcgtcccctgttccaatcaggacgaggaggcgcgtgccatccgcctgtgcggttacagctgcattggctgtggcgactgcgtggaggcctgtcccgagggcgccatctccgtggtggacaactgcgcccagatcgactacgacaagtgtgtaggctgcgcggcctgcaccgtctcctgccggaagaagatcattgtggacacctatcatgacctgaccaagctgaagtccacggtctcctttgtccgctgccgcggcggctggcataaccatgaggtctatgccaaggcgggggccacctcctgccgtgaggcggtgaagatggccctggatggccactgcaactatggctgcgccggctttggcgactgcgtgaaggcctgccgctttgacgcactggagattgtccagggtacggccaaggtcaaccccgacaaatgcgtgggctgtactgcctgcgtccatgtctgcccccaggaactgcccgtcatcgtgccctacaagggcgccaagatggtgccctgcgcctccaaagacgaccccgaggtccgcaaacagctgtgctgggtgggctgtatcggttgcggcgactgcgtggacaactgcccggatgggctgatccacttggaggacggccgtgctgttattgaacccgaccggtgtgaagactgcaacatctgctcctatgtctgccccaacggtgtcatcaccgcccgggagatgccggagtttacctatgttcaggttcgtgccatggcagcacagaaaggaggcgcagcgaaatgagagataccagaccctttaagagtatggacgccaacgcggccgccggccacgtggcgtatgcgtttacagaagtcgctgccatttaccccatcacgccctcctctcccatggcggagcatgtggacgaatgggccaaccaagaccgtagaaatatttttggacaccgcgtcaatatcgtggaaatggagtccgaggccggcgccgcaggcgcggtccatggttccctgtccaccggcgcgctgaccaccacctttaccgcctcccagggcctgctgctcatgatccccaatctgtataagattgcaggcgaggggctgcccggagtcttccatgtggcggcgcggaccctgaccacccacgccctgtccatcttcggggatcaccaggatgtcatggcctgccggggcaccggcatggcgatgctggcctccggcaccccccaggaggtgatggacctggcgccggtggcgcacctgtccgccatccaggccagcatgggctttatcaacttcttcgacggcttccgcacttcccacgagattcagaagctgcggacctgggactatgagaccctgaaggggatggtggactgggatgccattgaccgcttccatgcccaggcgaacctgccccatcatccctaccaccgcggctccaatgagcccccggagaccttcttccagcacagagaggcctccaacaccgcctacaaccacctggtggacgtggtggtggagaacatgaacaaagtcaatgccgccatcggcaccaattataagcccttcaactattacggcgccccggacgccaccgatgtgattgtagccatgggctctgtctgcggtaccctggaggaggttgtggatgtcatgaccgcccagggcaagaaggtaggcgtgctggaggtccacctcttccgccccttctccgccaagcacatgctctctgaactgccggagaccgttcagcgtctggcggttctggaccgcaccaaggaacccggtgcctttggcgagcccctgtacctggatgtggcggcggtgctcagcgacgccggccgcacggacatccgggtgatcggcggccgctatggcctgtcctccaaggacaccacccccgccgacatgtattctgtcttccagcatctggccaagggcggccacaaccactttaccgtcagcatcctggacgacgtgaccaacctgtccattgaccggtgcgagtttgccctgccggacgatcccacccaggcttccgtcaagttctggggcatcggctcggacggtctggtgggcgcctccaagaacacctccaagatcatcggcgaccacacggacaagtatgtgcaggcctatttccagtacgactccaaaaagtccggcggcctgaccatcagccatctgcggtttggtgacaagcccatccgctcctcttactatgtgggcgctgccgactgcgtggtctgcggcaaccccgcctacattggcaagtatgacatggtccgggatgtgaagcccggcggcatcttcctgctcaactgcgactgggaaggggaggagctggaggcccgtctgcctgcggagatcaagcgggccattgcccagaagcagatcaagttctatacctgtgacgcggtgaatatcgcccggaagatcggtctgaaggggcggatcaacaccatcatccagtccgcttacttcaaactggccgacctcattcccgcagaggatgccatcgagtatatgaagcagggcatcatcaatgactacggcgccaagggacagaacatcgtggacatgaacgtggccgcggttctggctggacagaccgctgccaaggaggtttccgtccccgccagctgggccaacgcccaggacggcgagaagccggtgctgcagctcaacaccgtcaacgccgagcaggacgcctatgtccgcaatatcctgattcccaccaacaacctggagggcgacgcgctgcctgtctccgctttcctgccctatgtcactggcaaagtgccctccggcacggccgcctttgaaaagcgcggcatcgcggtggatatccccgtgtggcatgcggagaactgcacccagtgcaactggtgctccaccgtctgcccccatgcggtcattcgtccctttatcctcaagccggaggatgcccagggcctgaccacggtggattgcaagagtgcccccggcaagcgcttcctgattgccgtgtccgctgaggactgcacgggctgcggctcctgcgcggagatgtgccccgcccacggcaaggcgctgtttatggagcgcgctgccggccggatgcacgacgatcaggagacctttgagtacgccaagaaggtgggcgtccagcagggctcgggcaagaatgtgaaggaggcccagttcctgcgtccctatctggagtattccggcgcctgccccggctgcggcgagaccccctatgccaagatggtcacccagctcttcggggaccacgccatcatcgccaacgccaccggctgctcctccatctggggcgcctccgtgcccagcatgccttatgtagtggatgagaagggccgtggccccgcctgggccaactccctgtttgaggacaacgcagagttcggctacggcatgtccgtgagcatgcggacccgccgggagggcatcaagaccgtggtggagcgtctggcaaagaatcccgccttcggcggcattgccaacgcctggctgaagaatcgaaacaccgccgaggccaaccatctgggcgagtccctggtggagctgtgcaaggtctatccggagaatgaggacgcgcagttcgttgtcaagaacgccgacctgctgccccgtccctctatgtggattttcggcggcgacggttgggcctacgacattggctacggcggcctggaccacatcctggcctcccgggagaactttaacgtgctggtctttgacaccgaggtctactccaacaccggcgggcagtcctccaaggcaacccccaccggcgcggtggctcagtttgccgccggcggcaagcccaccggcaagaaggacctggcacagatcgccatgaccaacggccatgtctacgtggctcaggtggccatgggcgccaaccccgcccagaccctgcgggccctgaaggaagccgagagttatgacggcccctccctgatcatcgcatacgccccctgtatcaaccacggcctgaaggctggcatgaaccgctccatggtggagatgaagaaagccgtccgggctgggtattggaatctgctgcgcttcgacccccgtctggcggaagagggcaagaaccccctgcagatcgacagcgcgaaacccaatgaggattaccagagcttcctgcggggcgaggtccgctatgcctccctgcgcatgaagaaccccgagcacgcggatgccctcttcgcagagtccgagaagaatgcactgggccgttatgagagtctgattcaaagacacaacagtctggagccgaaggagggactggcgagatgattaacaacgtaagagaaagaaatcccatgccggagcaggcgcgggaagttcgctgcaccaacttcaacgaggtggctctgggctataccgaggccgacgccattcgggaggccatgcgctgcctgaactgccgcaaaaagccctgcgtggccggctgccccattcaccagcagatccccgagttcattgcccgcgtggcagagggggactttgaaggggcctatgacattatcaccgtgcgaagcaccatgccctccatctgcgggcgggtctgcccccaggagcagcagtgtgaaaagaactgcgcccacgcggttaagggtgaggccgtgggcatcggccgtctggagcggtttgtggccgactggtacgccgcccgccatcccgtctccgccccgcaggtggagaagaagggcaaaaaggtggcggtgatcgggtccggccccgccggcatcgcctgtgccggtgacctggccgccatgggttatgacgtgaccatttttgagaaactgacctatgccggcggcattctgacctacggcattccccagttcgtcctgcccaactcggtggtggaccgggagatcgaaaccctgaaggcccggggtgtggagatcgtcaccgggacgcccatcgacaaggacaagagcgtggacgacctttttgccgcgggctatgaggccatctttgtgggcaatggcgccgatgtgccccagccgcccagagggctggacaccagcctcaccggggtgtggtctgccaacgattacctcacccaggtgaacctgcacaacgacaccctccccgccaacatcaaggacgccaagcgcgttctggtggtgggcggcggcaacgtggcggtggacgcggtccgctgcgcccggcgcctgggggcggagaccattatggtttaccgccgcaccatcgccgaggcccctgcccgccgggatgagattgcccacacctacgaggaggacattgagatcagggaactaaccaacccggtgtcttgttacagcaaggatggggttctcaccggggtcaagtgtgagaagatggtgctgggcgaacccgacgagtccggccgccgccgccccgtggggacaggcgagttcttcgacgtggactgtgacaacctggtcatcgccaccggtacctcgtacagtgacgccgtggtggataccaccaccggcattgacaaggacaagtgggggggcattgccaccgacgcatccggcaagaccagccggcccggcgtcttcgccggtggcgacgcggtcacaggcccccagacggtggtcaaggccatgggtgccggcaagcaggctgcggtcagcattgacgcgtacctgtccggccgataagcaaagatattttacggttttttgttcacgggaccggggcagccgccccggtcccgcgttgtttttggaggcgtctatgattcaaattgtgcggtccatggcctctgtggcccctctctttgctggctggcaggagaccatcatctggtcctgcctgcagggggagatgggggaagtttatgccccggtgggggaggcccccgtctcggccctggccacgttgggggattttacctttctggcgggggagccccgggaggagttggtccggttccttcccccaagccgccggccagactatcacattctggttccccagaacgagggatgggcccggtgcattgccggggtgtacccccaggcccgccgggtgacccgctatgccacggaaaagacagggatgctatttgaccggacccgtctggcccgtctggccgcccgcttgtccccgtcggaccagctctgtcccgtgaatacaaccctttatcaacggtgtttggccagtccctggagccgggatctggtggcccagtttcccacccctgcggtctttgcccgccgcggtctggggatggcggtcctccgccgggggagactggtggccggggctgcctcctattcccggtatcgggggggcatcgaggtggaggtggacacccaccctgcctgccggggccagggattggccacggctgcctcagcggcgctcctcctggcctgcctggaccgggggctctaccccagttgggatgcccacaccaggcagtccctggccctggcggaaaaattaggctaccgatacagccatgcctatccggcctatgaggtggcctggaccccatgaaccccacggacccccgtccgggcagagaaagcgcccggacgggggttgtttcttggactgttttatgataaggttctctcggatagacaagaaaaaggaggtattccatgagaaaacgatgggtttgggggctgatctgtctgcttttgtgccttctcccggcctgcgggcaggagaagcccgctgccaatgacgtccccccggccagtgagagccccgtggaagcggccccgcagaagcgggaggcggatttttcagcggcgtttggagggattcagggctgtgcggttctctatgacccggggactgatcaatggaccttttaccaggaggagatgtgccggcagcgggtgtccccctgctctaccttcaagattgtctccaccctcatgggccttcacacaggggttttgtccggaccggagagcaccatgacctactccggcctgacctacccggtggccgcgtggaaccaaaacctgaccctggagcaggcgtttcagtcctcttgcgtctggtatttccgccaggtgatcgaccaggtgggccgacaggcggtggcggagcagctggcggcactttcctacggcaaccaggacatctcccaatgggcgggcagcggccagaatcagagccaggagctcaatggtttttggattgactcctccctgaaaatctctcccgtggaacaggtccaggtgctggccgaaatttttcagggggagagcccatacaccccggaggaggtggccaccctccagaagatcatgctggtccaggaccagggggagcagcaggtctatgggaagacgggcaccggctttggcgagactggctggtttgtgggtttcacccaggagaatggacagaagacctattttgcggtatatttgagcgatgagagccgggagatttccggcagtgatgcgcaagcggttgctctggccctgctggagtaacctgaaaagggagaaaggaagaggctgatgcgtacaagcttgtcccaccggtgtgcacgatttttggatgcccgcgatatgctccggcgggcgttcccatttgcgcatgcccaaatgatcccgatctgtgccgggatggctgccggccaggaccgcccctgggacgcggggcgtctgtatgcctgccgggatttgatccaggaagaaaccgggctgttctcgaacttccggggcgccggccatttggccgtgattacgctgctggccctgagccccgcgccggaggagcggatggcgtttgcacttcagggctacaaggttctgcggacgcggttttacgcctcccagtacctccctctggccgccctgctgctggcagattgggcgcggggaagggacctggatggggtggccgcccgggcggaggagatttaccggcggatgaagcgggagcacccctttctcaccggtgcggaggacagtgtgtttgcggttctgctggccctgtcccccgatacagagcaggcggtggtggatcaggtggaggcctgctacgacgcgctgaaacacccgtttggcacggggcagtatacccaggcgctcagccatgtgctggcgctgggggaggggagtgcccaggagaaacgtgacaaggtcctgggggtgtaccaaggtctcaaagcagcgggccggaagtacggcgccggctatgaactggggacactggggagcttggcgctgctgcccgctccggtggaagaactgacagcggatgtgctggaggtagacgagtttctgtcccatcagaaggggtatcgggggatactgggcctgccgaagaaccagcggctgatgcacagcgccatgctggtttccggggattatgttgaccagagaaaaacttctgtcatgggagccgctgcggtcagcgggaccgtggcgatgattgcggcgcaggagatggccctctgtgcggtgatggttgggggcattggtgcctctgctgctgcaaataacgacggttgagcggggaagaggcttccgctgcccagaggtgaccggcgcggcgctacctggcagcgccgcgctttttgatgggaagtgcagaaaatttttgctgtttccccttgactctgacacggtgtgaggggctattctgtgtttgtgcacaaccaaaacagatctgtgaggacgaaacaatgctgaaaatcggagaattttccaagctgtcccgggtcagcgtccgcatgctgcgccactatgacgagattggcctgctgcccccggcatccattgattccgccaccggctatcgttattacagcgaggaccagctgcctgtggctgggcggatcacggcgctgcgggatatagggtttggcctgggggagattcaggcctgccagcagggacgggagaatccccaggtgctggcggcgctcttctctgcccggcgcgaggcgctgcggggggaactggcggcgctgcggcggcagctgcgcctgttggacaccttggaacagcgactgagaaaggaagacagcaacatggaataccctgtgaatttgaaaaccctgccccagcggcaggtggccagtgtccgcatgaccattccggcctatgaccaggagggcatcctctggcacaccctggtccgggagacggagcacctccagctccagccggacgacccctgctactgcacggtgaccttccacgacggggagtacaaggagaccgatgtggatgtggaggcccagaaaaccgtccggggaacctatcccgacacggagcacgtggtctttaagacggttcccccggtgacctttgcttcggtgaccttccagggaccctatgacaagatccaagcggccaacgccgcggtggccgcctgggttcgggacaacggctatgttttcgacggccccgctttcaacatttaccatgtcagcccccacgaaaccgacaaccccgaggaatttatcaccgaggtctgctatcctgtgcggcaggcctgacccaacccctggagaaaaaacggcgccccctggaatgctccagggggcgccggtcgttggcgtcgttattttggcggctgttcgttgagccaggtcaggaagctctgggccagggacagctggtccggggagaggggacgcagaagttccgccacatcccgccaggcctcatcctgctggcggaccgtgcccaccagaaattcatctggtgtggtgtccagcgcgatggccagacgcatgaggacctctgtggagggagtggaggtagcccgttcgatacaggagagatatttctccccaatatctgccatttcctccactgtggcctgctttaatcccagttgttttcggcggtgggcaatgcgccttccgatttctttatagtcaagtttcatacggcacctctcctactgataggatatgagaaatgcctgataataaaacggtctaataactggaatacggcttgacagaagaaaaaatagataatatagtcgaattataaactggaaagtaggtgaagagacgtgaaaaagagtgtaaaagaatgcttgcaggagtggaaggttccccgacactatgtggggtaccaatacctgctggatgccgccgacctctatgcccagggtgtgccggtggggtggccaatgctgttccagattggagaaaagcgcggccgggcgatgttccgggtacgcaaagggctgtatacggtggttaagtatgtgcgcgccacgccgtttgggctggcctggcaggcggccaagggtcacccccttcaggtgggggaacttctgttttacctgttggagccggaggggcagggagacccgctgggggaaaggccggccaacgaggaggggtagccccatgggagggaaaagaacagcccgggggaagcgtcgctttcccccgggctgttctctttcgttataggctctgccgcaaaatatccacaatctcctggtgggtgaggactttatagcccccctccatgataaaggaccccttggcaatgccgtccagcatatcctcggtgacgcccagctccgccaggtggagcaccaggcccatctccttcatccagtcctccatggcggccagaccttcctgggcgatggcctcatcggtttttccctctgggcgcaccccccagacgttcactgcgaacttcttgaactgatgcaggccgtagggcatcacataccggtagtagggcagggagaccgccgacagggtcatgccgtgggtggcgtcggtgtaggcgcccaccgactggccgatcatgtgaaccatccagtccgtgtcctttccttgggctaccaaagtgttcagggcccaagtggcgatccacatcaggttgctccgggcctcatagttctccgggtccttcactgcgatccggctgctgtggagcaacgagcgcatcaggccctccatgaggtagtccgaggtgcagtcatcctccccggagaaatactgctcggtgatgtggttcataatgtcgtaaatgccggccaccatctggtacttgggcagggtataggtatacttggggttgaggatggagaacttgggaaagacctcctccccgaagacgtggccgatcttctgcttggtggcgtgattggtgattaccgagcccccgttcatctcggaaccggtgcccaccatggtcagcacacagcccacgggaatgaggcggttggcaggctcctccatgcggacatagtatttctcccaggggtcctcgtcgcaccaggcggagacggacacgcccttggcatagtcgcagcaggagccgccccccaccgccaggagaaggtccacgttgttctcccgggcgattttgcacccttcatagagtttttccgttgtgggattgggcatgaccccggggtcctcaaagatttctttgcctgcggccttcaggatggataccacctggtcgtaaatcccgtttttcttgatggagccgcccccgtagatcagttggacccgcttgccgtagtgggccagctcaccggccagggcatccaaagcctccgggccgaaatggagtttcgtggggttgcagtagctgaaattaccgagcattgtgagaatctccttcgctataaacttctttcgccatccgcagggcggcccaggccttgggccagccggcatagaaggcggcgtgggtgagaatttccgccatctcctgggcggtgacgccatggtttttggcgttttgtatatgaaaggaaagggaactgtccaaaatcccgctggccatcagggcggttaccgtgaccatggaccggtcccggggagagagttcagcctgccgggaccacacctctccgaataaaacatcgtcgttgagctgggcaaacttgggggcgaattcccccaactcgtcccggccagctgttaccttttccatcataaatgatctcctttccactgtcaaatcaaactatggttagagctccaacccggtgatgaattccaccgtagcggggtcgtagtgggagaaaaaggcgctctcctcctggtccagggcctggatggccgccatatcctccgcatccaaactgaaatcaaagacctggagattttccgccatccgcgctttgtgcacggatttggggatgaccaccacatcgctctgcagcaaaaaccgcagggcgacctgggccacggatttgccgtgcttggcccccaccgccgccagaaccgggttggtgaagaaatccttccgcccctcggcaaaggggccccaggactcatggacgacgccatacttctccatgatggcatgggccgccttttgctggtacagggcgtgggtttccacctggtttaccatggggcgaatctccacgaactggcacaggtccaccagacggtcggggaagaagttggagaccccaatggcccggaccttcccagccttgtaggcctcttccatggcccgccaggtgccatagtagtcgttgaagggctggtggatgagcagcaggtcaatgtagtcggtctggagtttccgcagggattcctcaatggaggcccgggccttttcctgcccggcgttggagacccagaccttggtggtaaggaagatgtcttcccggggcaggccggagcctttgatggccctgcccacgccctcctcgttgtggtaggcctgggcggtgtcgatggcccgatagcccacctcaagggcctcccgcacggaggcctcgcaggtggtggggtccacttggtatacgccatagcccaggcggggcattttgacgccgttggagaggggaatggattccagattcatacgaattcctcctgatatagtgacatggtttatttcttagcgttgacctgatagcgcagccagagtgcgctgcccgctctggcttccgcgccaagcagggtaaaggagatgggcttgtcggtgctcagcccctcctgggcccggaagagggattgggtgcgggggttgccatcggcggcgggggccaccacaaggctgagctcatcgcacatccccgcctggaggaaagaccagttgagcacgccgccgccccccagcatcagcacctggatgccaaacagccttttcagcttttccagggccagggcgtagtccagggtgtcttttcccgccaggaggtaggagatccccagccgccgcaggaaggctttgtagtcattgctggcctgctctgtgagcacttccaccacatgggcggtggtggtctcgtaggtcagcgtgtcagactgccaccccagtttccccttggggtccacggagacgtagtacatgggcgcctgccgggcgacaaaatccccggcggggacggtgggggcgtggggaatcaggtcaggcgttcggtagtgggtaaaattgtcgtcggtggttacccgtccagacagccatccctggtggcggtaaacaggctcgggcccaaaggcgatgtcatagaacagatcactggccgcctcacaggcgggcaggtccatatagtttcccatgattttcccatccagggagacaaacatgtggcagaaaatatagggtcgatccacagggacacctcactttagtcgattgtattcgtccgggtccaccggttccagccattggctgccggtgtcctggccggggacctcaatggccaggtgctggaaggggctgtccggtgcggccccgtgccagtgcttgacgttggggggaatgtgcaccacgtccccggggtgaagctcttggggcggctgtccccatgcctggtagtagccccggccagcggtgaccagcaggatctgtccgcccccctggctggccttgtggatgtgccagtggttccggcagcctggggcgaaggttacgttgcccacggccacctgatccaggctcaacatatgcaggtagctggtgccgtcaaagtaaggggcgtaggcggtattctcctcccccacgggaaagagactgttttgtatcaagtgctgtaaagtcatattactttcccctttttacccaggcggccagcgccgcctcctcccggcagacggcggtgcccagaatggccagccccctgcccacccgggccccggggcatagccggcggatgtcggcctcgctgcggcccaggccgctgccctcatgggtgcagaagggaaggatggtcttgccggtgaaatcaaaggatgctaaaaaggtgaagacgcacatgggcatggttccccagtagttgggatagcccaggtagatggtgtcatagtcctccagatgatccggcagggcccgcagggcgggccgggcatcctgccgctggtcggcctgggcctgctcaatgcactggttatagttgtcggagtagggatggacaggctccagttggaacaggtccgcacctgtgagcacttgcagacggcgggcgaccacctctgtgtttcccacggacagcggctgaatgcggccgctgacatagttttctccccggcgggagaaatagacgatcagttgtgccatgatgacctccttcattgacgggatcccttttgatgcccttattttaacgcgccttctcttgacagggaagaatcaatcttgtaccatggcaataacaaaaagttagaacaaaaggagggaccccctgtgtacaacagccagctgaccacctttgtccaggtggcggacagcggcagtttcaataaggctgcggaagccctgtatatctcatccacggcggtgatcaagcagatcaacgccctggaaaagcatctggaccttaccttgttctctcggaccaaccacggcattgccctgacagagtccgggcggatcatttacaagcacgcgagaaagctgtttgcctattcggaaaaagcgattgcggaggcccgtctggccgcggcagaggcggccacaaccttctgcgtggggacgtccatcctcaacccctgcaaaccatttatggacctttggtaccgggtcagtgagcagctgcctggcttcaagctccacattgtcccctttgaggacgaccacgagggaattctccgggagatcgcggccctgggggagaagtttgactttctcatcggtgcctgcgactcccgacagtggctggaccggtgcaattttcttccccttggagtgtatcgtcactgcgtggccgttccccgggaacatcctttagcccggaaaaccaagctgaccatccaggacctgtatggacagacgctgatgatggtcaagcggggggactcccccacagtggaccgggtccgggactatgtggagaaacaccctgccattgccattgaggacacccctcagttctacgacatggaggtgttcaaccgctgcgtgcagacgcgaaatcccctcatgtccctggagtgctggggggaggtgcatcccgctttggtgaccctccctgtggactggccgttcactatcccctatgggattctctatccccttcacccggacccggataccctgcggttcctctccctggtccggcaggagatggcgggagcgccggacctcccccagggagaaactccgtcgccttgacaaattaggactatcgtgctattttgtttgtacgatagtcctaatttttgctgccaaagaggaggaacctgccatgaccgcgcccccacgccaaaccatgctggccaccgcgcctgtgagcaagctgatctggacctttgccattcccgccattctcagccaagtggtcaattccatgcacaatattgtggatcagacctttctcggctggggcattggagatttggccattgccgccaccaacattgcctttcctctgtctaccttaaccaccgccctggcggccctcatcggcatgggcggcgcggcgggattcagccttgacttgggaaagaagcaggcacgctccgcccgaaagaattggggcaacgccattgtgctgtcggtggggctgggctgcctgctggcggtgctggctgtggcctttttggagccgatgctctacctcttcggcgccacagaggccatgatgatttatgcggtcccgtacgcccggatcatcagtatggggctgccctttgccattttctccatggccatggcccattttatccgggccgacggcagccccaagttttccagcggggttctcctgtccggggccattttcaatatgatttttgacccgattttcctctttgcctgttccatgggcatccagggggttgctctggccacggtgctgggacagggactctccagctgtctggccctctattatctggtgcgccggcgccacatggtgaccctggagcgggaggatttccgtctatctgctggtacgatcaaagggatcggcgcgctggggggcgccatctttttcaaccatgtgattatgaccgcagcccaggtcatcctgatgaacatgctgcgtacctacggggcccagtcggtctatggcagtgagatcgccatcgccgggtccggggcggtgggaaaggtgatgattgtctttctcagctgtgtcatcgggattgctctgggttgtcagccgattttcggcttcaactatggcagtaaacggtatgaccgggtcattgaggcctaccggaaggcgttgcgctacggcaccaccctggcggtgattgccttcctgtgcatccagctgtttccccggcagattttgagcatctttggctcagaggacccgctgttttatgagttttccatccactatatccgcatttatctgcttatgacctttgtcaacgcctttcagcccattacctccaacttctttacctccattggcaaggccaagctgggattttggatggcgttggtccggcagggactgctgctaattccgctgctgttgcttctgccgctggcccttggtatggatggggtcctctgggcgggacccatttccgatggagtggcagcggtgctggtcctggttctgggggcccgggaggtccgccggctcacggtgcagcaggaggagaccccatgaagcgagatacccgacgggccattctggacatggccaaaacgctcttcagccagcaggggtacaacgcggtctccattggggagattgccggtgccctggggatcagcaagggcaatgtgacctatcatttcaaaaggaaagaggacatcatggaggccctgctggccgaggcgaagcccaccttttttcaagagccccctcggaccatggaggaactggacgcctttctggaggacatggaacaggcccgggagaactatgccttttacttccagcaccatgcccagctgggccagctctcccccgcgatccgggcgcggcagcaggcgatttatcacagccagtcggcactgtttgcccaggcgctgtccattctggcccgtcagggcatgtttcgaggggaggattttcccggggcgtatgcccgtgtggcggataccattttcctcacctccctttactggcttcccttctgtgcggtcaaggggcggaaggaggatttccggacccaggcctggtctgtgctgtatcccttgctgacccctttgggcagacaacgggggcgggagctgggccttcttcttggggaagatccataacataaaataagcctgcgcgggaaatccccgtgcaggcttatttttgtggacgaggcgttctctcttccacagaggccattcccgtgagacgccggagcttttcccggtccagaatggtgatggtcccccggcgcagtgcgacaatgccctcctgggcgaagtatttcagcaccttggtgaccacttcccgggcgctgccgatgtagcgggccatctcgtcatgggtgatccggaggacggggcccttttgggcggactcgtcccacagaaaaatggcggcccgccggtccatccccatgaaaagaatttgctgcatggtccacatgatatcggagaaacgctcactggcggtcttgtagagaaagagttcgatctccggccgctgctgagccaggggagagagggctgtgacgggaagggtgatcacatgggtctcctcaatggcctcgatgagtacgtcgaagacgatggcgtccatcaggcaggaggaggagagaacacaggtctcaccttcccgcacccggtacagtgtcacctcccgcccttcctcggacagaagaaaggcccgaagctggccggacaaaagcagcaggatgcccttgcagtcctggtccgcccggtgggtgatggtccccttgggcagggtggagggaacgctggcctcccgcagggccatctgttcctgtggggttaggtgttcccaaaagggaagcatctgggaaaatatatcgtccggttgtttcatgaaaacctccttgggagaagctggttgccctgttggatcggatgcgttgagtgtaccataggtcggggaaagatgcaaatgggatttccccggggaacccaggcggcgccccggggatgaaaggggtcagcagccggttccatgccagacgggcctgtaaccctggggtggccagaccggagtggtgactgcggcggtgctctgtccggcggtctgggaggagatcaccgctgtgttggtaatggttccctgggcgcaggggtggaccaccccggccacgaggagtgtagccgttgcgccgggcgccagggtgccgaaggagagcaggccctgccaaggccgccaggtgatcccgccgtcaagggaatagaccccggcggagagcgacggcggcagatggtcctgtaccaccacgccctctgccgggatgctgccccagttgaccgccaccaggcggtataccaggtattgacaggggactgcccagcagggggaggttttggtcagacgaagctctgtgcttccctggacagggaccaggctggtggcggtgttgctgttggggtttgggtccggggtggagctggccaccacagcggtgtttacaagggtgccctgggcagaggaagacaggctgccgcgcagcagcagggttcttccctgaccggctggaagcgctcccagggaataggccccggtccacggggtccaggtgcgcccgttgtccagggaaacttccacgcgggacagaccgccgggagtctggtcggtgagaagaacatcctgggcggtggcagggcccaggttggcgatggtgagcgtataggtcagcaggccgccaggggcagcagtgtcggtatcggccaccttggtgatggccaggtccgcagcgggctgaagggggtcctcccgctgggcggtgttgttggtgagatccgggtccggggtggaactggccgccacagcggtattgagaaggggaagggtagcggcggggtcgatggtcccccgcagcaggagggagcgggaggcacctgcggccagggtacccagcagataggggctgtgccatggggtccaggtggcgccgttgtctgtggaaaactccggcgtccagagttccgccggaaccgcgtcggtgagaagcacgtcctgggcatccgagggcccggcattttgtagggtgatggtgtagagaaagggagtgccggggacagcagagcctccggtgttctccttccgtacggaaaggtctgcggaggggagaaggggaacctccacggtgtcctcattgttgtccggattggggtctggggtggagctggtcaccaaagcggtgttctccagggaactggctgtcgtggaggggtccacctgcccctggaggagaagggtggcggtggtgcctgggagaagagtgcggagcacgtaggtaccgctccagggctgccaggttgccccgccgtcagcggagaatactggggacagaatggctgccggcagggggtcctggagtaccacgtcctgggccgcggagggacctgcgttggtaacttgaagggtgtaggtcagagtctcgcccggatggacgcgggcaggttggacctgcttgagaacggccaggtccgcagcggtgtcgatgggcgtgcgctctgtggcctggttgttgtccgggttggggtctggggtgtcgctggtgacaacagcagtgttgaccagaatcccctctgcctccaggctgactgtgccccgcaaaaggagctctacacgctggcctggggccaggctgcctggctgccatgtccctgcccaaggctgccaggttgccccgacgtctgtggagaacgccggttccagcagaaggggcgacaggggatcggtgagcaccggatggaccgcaggatcggggcccagattggtcagggaaagggtgtaaaccaaggcctgcccgtggagcaccggattgggtgccccagatttagttagagctaggtccgcagcggtgtccaccggggtgagtgctgtggactcgttgttctccggccggggatctggggtgtcgctggcgacggtagcggtattggtcagggtgccgctggtcccttgggccacggttccccgcagcagaatctggcggtggtccccggcgggcagggttcccagggccagggaacccgtccagggctgccaggtgcccccattgtccagagagtatgcgccgtcagagaggggtgggggcagggggtcggtgagggacacgttttgggcatcggcggggcccagattggttaggtccagggtgtacgtcagcagaccgccggcggacactggactggggctgcccagtttggtgatggccaggtccgcagccagctggacaggcagctcctccgtgtcggtgttattgtctgggttgggatcgggcgtgtcgctctgtacggttgcggtgttgatcaaaagagcgtcggcggaggcccgcacggttccccgaagcaaaattgtctgggcctgcccgggaagaagggtccccaaggccagtgtccccgcccagggctggaaggaacgtcctccgtccagagagacctcaggggaggccaaggcatcggggagggggtcagagagtacggtattttccgcgttcacaggcccggcattggccacggcaagggtgtaggtgacaaggtcccccacagcggcgggcttaggagcgcccacttttaccaccgatagatcggcctgctctgtcacgggggtttccactgtggcggtattgttgtctggattggggtccggcgtgggagaggagacctgggctacgttggtgaggatgcctgtggtgagggggtctaccaccccccgcaggagaaccgtaacccgttctcccacggccaggtccccaatggattgggacccagtccaaggctgccatgacaggccgccatccagggagtattccgggcgcagcagcccccgtctgtctttgggctccgccagaggcccggagatgatatctgccatggagatcagcttcctttccgatggattcttcccccggttcgggtgggaagggggtcagtcaatgtgacatcccgggcgggagagggcccggcgttggagatggtgatggtataggttaggggcgcgccgggatctactgggtccggggcggcggttttctccacggccaggtctgctgcctccagcaccagtacgggaacctcattggtggagacgggaaacggaatgggaatgcctccctccactggggtgtaggcgtaacgcaggtctgctcggttccaggcagggttgggcacaggcagggcatcggctttggcctgaaaggagacggtgatggtctctccgccacggacatcgggcaggccaaagcccagctgcgggtcggcggcggggaacggagtgccattgacctgaacggtgtctggcacaaaggaaaagccgctgggaagctggtcctgcaaaaagagatcggtcagcgggctctggcaggcattggtcaggcggacggtgaagaggacggtctcccctacggtgattacctggcggtctgcggttttaactggcaggaacaggggcacttgaatgggggagagggcgatgtcgtcgatgacgtagtcgtttccgatgacctcaggcccctcgctgagaaattcaacggtgagccgggtgttctcctgggaggagagaacgctgccgatctgtttccactctggggcgtttgggctgacagggatgagggcgcccagggtggcggcatacaggggattaccgacctggtccaggacccgtacgcccagttccgggtctgggtaccccgtaactttgaacaggttcaaaatccaggcggtgaagagatagtagtggttgggctccacggctacctcagcgcggaagaagacggcgccggggttgtagccgttgaccaccagcatccgtccagtctcgttgccctgggtgtggtcagccacccgccaccaggcgccgatctgctggctcaaggcatcggtcataagattttgaacggtgtactctccgccggccggggtgtagacagcggggttgggcaggacgtatgagaaatccggtgtaaccccaggatagggttctgtgggcgcgcccgtgttggcgggggtccctggggggaacgtcccaaaggtcccgcggtcggcggcctctaagaggttttcctcggagactgcggcgcagggatcaagaatggtttcaatgggggagtagatgacagggccgctgaggaaggtctgctctcctatgtctgcccccgtcacagtgagaaaccgggtgttgggcgtaactgcgtctagatgggtggcgcctgccgggggattgggggccgcggaaatggggggattgcctcccacagggacaggcccgaccgccgcgccggagaaatcggcgggggagggaagcccatctgtttcgtagggagcctggaccaggcggtacgctccggcggggacgtgaagaaaggcatagtctccggcctggtccgtgaaaacggtgcatcgtgccccggtgtccagattttgcaggaccacgggaatcccgggcaggccggcatccccactggagcgggtggcgctgcggtcccggtcaaataggacgctgcctgttatggttgccatggcttccacctcacttaattgcgcagctgcgttttctactatcttatgcccgcctggtgcagggggcgcataagacgaggggagcacgacaaaaagccctgccgcaaggagcggcagggcgaagaaatagagcggggaagtcaggggaagccagccggacgggcccgcagctgccagaaggcgacggcgctggcggcggctacattgagcgaatccacaccgtgggacatggggatgcaggcggtgtagtcacaccgggcgatggtggcggcggccaggccatctccctcggtgcccaggacaatggccagcttttccgcggccatcagccggggggcgtcgatgggcagggcgttgtcactgagggccatggccacggtttgaaagcccaaggcgtgcaggcgctccaggccgccggcgggccagtcctctgcccggtcacccagacgggcccagggaatttgaaacacggtgcccatgctcacccgaacagcccggcggttgagcggatcacagcaggtgggagagagaagcacggcgtccatgtgcagggcggcggcggaacggaaaatggcgcccacattggtggtgtccacaatgccttccagcaccgcgacccggcgggccccctggcagatgtcctccatggcgggcagctgcggccgccgtatggcgcataggattccccgggtgaggggatagccggtcagggcggccagaacgtctcggtctgcggtgtagacagggatgtccccgcagcgggccagaagggattgggcctgtccctgcacatgcttgcgctccatgagaaaggccacgggggcgtggccggcatccagagccagctgaatcaccttcgggctctccgcgataaaaatccccttttccggctccagccggttgcggagctgggcctcggtcagccgggcgaagagatccagccgagggtcagtgaggtcagaaatttctattatactgggcatgacagcctcctgttcgtttttttgcatgataccatggcgggcagagaaaggcaagtctcctaccatcaggcggtgttgccgcaggaaatggtttgcagagcaaaacactgcctgcaggccggagagggcggaaccctgtgggaaaccgcctgcttgctcaaagctgtgtttgatgctatgataaacagaagaagtacgacgcagtggagtccgtttccagggcgtgggctgcatgcgttggcatgacgggaaaaggaaggcgatgggatgaagtgcaccgtttcacaggaaaactatttgaaagcaatctaccttttgcaaatccaaaaggaatctgtccgggctgttgacgtatccaactatatggcgctctccaaaccgagtgtgagcaatgcgctgaaaaagctgcggacagagcgtcttttgaccgtggacaaagagaaaaatctgatcttaacagacgaggggctgcaggcggcaagagagattttctccaggcactccttttttgagcggctgctcattgacgcgggggtggacgagggacaggcccatgaggatgcctgctctttggaacacgccatcagcaggcagagctttgcggtactgaaagaccggctggaaggcttggcagcccaaaaggccgcggactgactggttcgattacaaaagctggggcaaagacggaaagagcggtacttccgccgcattgaaaaaagacagagccgaccacaggagaggcctctctcgtggttgtcggctctgttttttgctgtttgattacaaattcagacctctgtatcggttgaagcaggcaaagatctcctgccgcctgggccgggccaggaagggaatgccggactggccctcacacagaccggccagggtccgctgctggatcagccggtccaattcatccaccacttggcggagggtctttttcccgtccagaaggtgccgctgggcgtacagaacacagtaccccagcgcggcggtttgttcgctgtcggtcagctgctccacgtaccgcaggtcgatggtttcccgttgaatcgacaccccatcccgccccagtgctttgagcttccagcgatcgccgcgccggaattctggcgaggccttgggccggcggtccaggttggggagaccggtcgacttcggcgctgtcccgtccggggggaaagccagggcctcctgctttgcccggacggtgatatcccgggggaggtaccggtccatctggatgatccggtcagccacatgaaagtaagccccggagctgccagccaccaggatggtggagatgccctggtccctgtacagggcttgtatccggtcaatgaagggggtgatgggctccatgtcccggtggatgacccgctgcatcagggcgtcccggaccatgaaattggtggcgctggtatcctcgtcaatgagaagcagggaggcgccggcctccatgctctccaccacattggccgcctgggaggtgctgccgctggcgtcttccgtggaaaaggccgtggtgtccttgccgttgggcaggttgctgatccactgggaaatgtctgtgcgtcggatgcttcggccatcctcagcccggattttcatggcagtgtcttcggtgatcacatactcccggccgtccccggtgatgtggttgtagacccccaactccagcgcctccagcagggtggacttgccgtggtagccgcctcccacaatcaaggtgatgcccgttggaatgcccatgccggtgatctgtccccggtggggcaggtccagggtgaccgccagttccggcggagactggaaggccacgccgttcttcatggaacgggcagagacgccggaggcccggggcagaatgcttccgttggccacaaaggcgcacaggcccatctggggcagggcgtcccgaatgtactgctgatcctccgccagatccgccacggcctgcagctgtttgctgtctaagttccgatagaacagggtggcatggatacactggggaagaaagtcaaatagaattttttccagttcccgggcctgaatggtccgcccctgggcggggaaccccacctccaggcgcaggcagagatcaccgtgcgtggggtccagacagcaggcggtgcgctccaagacctcctgcccgcagcggctgaccgagatctgcccgctgtgtcccgagcccttggcccggaaggacacggcttccgcctgccgggcgaaccgacgggtcagcgcatcctgaagcgcgatccgctgaacaggagttcggtagagggacggaggaaaagccgcagcgcttcccctcacgtgaatactgactttggagggggcggcaaaggggtccccctgtacatggtcgatggacagcacatagtccgggaattggtatgcgcctttggtgtctttgtaggccgggtagcccttccggtcgattctggccagcaggtttctcaggtcagttgcagtctgcatgatattgttcctccattgagttgccccgcacggcaaagggagctggtgttcagggcggagtggatttcaagagagctatcttgacaatagtccatttccaggcggttgtcaaaagtttttatgggtttgcaggatggcattcgaaaaaagtccctcgatcgtgcggctttattgtttcaaggatctctcggacaagtgattggtttttctcggcatatatttggaacaatacaggcagagcaactgggccgcaagggcgccatttggcgtcttggagggtaaaaaacccagtggcggtgccgtgtaaaatatcaaatcggtaggactgatactgggcgccaagatcttcgacaagatagctgtcccgctcgtccctgccgccccaggtcacggtttcaagcagggcggcaagactgccatggtaatatttttttatgagctgcgagaacgtcaacgccggtcccttgggcatgaggagaatggcgttctgtgcttcctcgaaaagagcttcgtcacaggaaatgatctgcaggcatgtttcgtccgggagcatttggacagcggcgtatgccatgtactcataggttggaggggagaagctggcaagcgaggcgaacagcgacgcctgtggaaccttcagcatatttgcaacctcagacagcagggcggcacgtcgctcttccgggggagagggatccggcaggtaaaaggaaacgatcacatagtcgtcaattcccttcgcgctgtacgccccttcaatggcagcaatccctctttgaagggcatctttgtccgtgtaccaatagatgtgatgccatggtgcgatgagccgcccccggatggttgcaagaggcgatatagggcgggcctgacagtcagaatgatcctccgttacgtcaatctgtattttttcgatggaaaaaccggcgtcctcacaaaaacgagaaaaggggagaagcagctctccccattcggtggaagcaatgatcgcgaatatctcggaatcctttgcgccaaagtgctgcttgacttgttctacatatttgctgacttcatggagtgcttgccgcgcagcggtattgctgcgtttcaattcaatcagaacatggcgccccttctcatccctggcatataggtcgatgaagctcttcgtgccgtgctcacccgggatatactgctctttttgaagcaaggtcaatcccggttttaattgagaaattttctgtgcgatcaaatcacgcagtgcagattctttcataaatactcctgtttttcctctgatatggttcatcttcgtgaagtgcagagaggcagggacaaaggggcaagacaatgccccttcagcaaaaaggattttggtctaagagcgtctgaagatgcgctttcagcgtctgctctcccaaccggtcacatgctgcaatcaattcttcctgagggctgtctgcgtaagcactttgaaatagctgccgtgccaagcggtcgtcctgcttgagctgcgccaggagcttgggctgaatgctttcattctgacagaaatcatatagatcgtttccgagcagttgttcagcggcctccgtttcctggaggtgttcctctgctgtgtccagcagcaatttcatcatctgaatggcggtgttgggatcttgctcgccagtctcgagcaaaagttccatggtgtccatcttcaaaagttcctctaccgtccagcggccgactgtgtcaggaaaggcggcaatcaacaggtcgcggcagatccactcattttctgagaaatcccaccgacggactgcggcctccagcgcagcgcgatctggctggagaatgggataagcgcgccaatgggaattcaaggcgttctgaagggcatccaactgggccgggctgccctcgccggaaaaaaagcatgcgatctggcttaggccatccaccgtctgaaaaagccagttgggccagggtttgcatgcctcatagcgtggcagcttgggcagcagagaggcccagaaagatccgagctgctcttcggtgagcagaaattgcgcttcaaaggccggccttccggtgtgggcagcgcgcagcacctcttccgctgtgcagaaaggatagttttggaaaaatgactggaggagagcgccattacgctgggtttgcttccttagaaggagaactatgtgataatcagccccatgcgctccaactgccgctgatggacgccgccactctccatggtatagatacgggtggtgttcacgctggaatggcccagaatgtccgccatccgggacaggtctttttccaaagagtagtaggtccttgcgaataaatgacgcagattgagggggaataccttgcctggttccacgtccgcgctctcgcagagggctttcatatcccgccagatatttgaccggtccaacggcctgcccgtccgggtggtgaataccgctccggcggtctttttttgcttctgaaggtatttccgcagcagccggcgtagccggcccgggaggaagaccgtgcggcgtttgcccttgttgcagatctcggcccgccccgtagtcacggcctcaacggtgataaagcgcagctcggacacgcgggtaccagtggcgcagatggtctgcatgaccagggacagccgctcattgcccaccttctgagctgcgctgaccagccgggcatactccgcgcgagtcagctcccggcgttcatcgcagaagagggccttttgtatcttcaacagctttacagcgatgtccttccaacccatgaagcgaaagaaaccattgacggcggccaggatggagttgacggtagctggggcgtggctggtgggcacccgcaaaactagggtcaatgtctcgtgcttcgtgataccgaaatcatccaggcgctttgtagttagaaatacgctggtaattctggctgtttcatcctggtatagcgccacaatcgcatcagataccgggatgtgggaattgttttggtgtttgccttcccagaaatttcttcccgcggcaactgaaccacgatatccacttacaatattgagaggaataaaatccatccaattctactgttttataataggcgagatactgatattgttccattattttctatctatatatctttcgcgcataatccttaaagcaacctcaagggaatcataatgacaaactgcaggggaaaacgcagaaaaaccacctaaataggcggtttttcagtaaaaagtggtccgagtgtaattataggacttggaaagatccagtcatatcaatggttttagcgcagcaagaggttcttatctcaaattgtacgatccaaaactgtaacacgtgtaatcacatcacgcaagcggtctgaaccaaccatatactccaacgcatcatcagcggtgtcaaagcagcattccgtttcaggacgattccaaacatagattgtgattttatcatctgtcccatatcggataatgccataatgaatgccgttccattcgatttctacttctccaccacatttcatacaccacttgaaatcgctgatcgatttaaaacggttatcttccagtgaattttgagattttaaaatgtgataggacatatcatacctccaatatgacttgaaatcaggaatatctccatcccaatagttttctgctttgccccagtttggtcggtttccttcccatgaaatggtatggtcgtgaggaatagagtgttgtttgggactgccgtgatctgagtagtgccgctccttgactgcccttccgtctgcaccgattttagtttctcttaaattcccgttacgatctgttgtgtggttgatactgccgggttcacctataaaacgtccatcatccggcttagacggtttccacgctccgccgtatgcgctgcctccgccttttccaatcaggtacggttctattgtatcacgattcccgattggtgcaccatccattttgaacgcatccaactcttcttttgggaatgaacgctcgtagtttagataccgccaagaactgcgttcgtaatcgacatagatgagattgccctgcatttcgggaaacggtgtattgtaacagatgattttttccggctcaatatgccgcagcatttcgttgtagcctgccatgaaccattctttctggtcgcagcggttgtcgtgctctgaggccatataagtggagacggcaacaacgcttcctttttcaatcccctcaaagcagaaatcaaatgtggattcatcgccccagttgacggtaggaatcacgcgaatccctttggatgcccagtaagcgccgcaccagcgattgcgaaatacgttgtaaagctgcatgacagacgccatctccaggtacatactgaaatctggcgaaagcaccgcacggtggcgggacagtttttcaatgtcgttgtccggattcttccacacccgctcaaagcgatagtcgtataggaagaagtggaccatgcggtccaggtgattctgatcctccacatgtttttttcaaaaccgatcagcaaaagattatcaaagtctccgggcctttcttggaacctgggaatgatagggattttgaactttccttttacaaaaaattaaaaaacgggtaagtcctatacagacttacccgtggtccgagtggggagactcgaactcccggcatcctgctcccaaagcaggcgcgctaccaactgcgctacacccggataggaaccaaagctacctcgtgtgaaggagaggaacgaaaaacattataaaggaaacaaacaaaaattgcaaggcgagaaagagaattgaccaaagaaaatttccgtgttacactgtaactgattgtagattcctgtggcttgttggaggaggcaacgatatgaaaacagaaatacgcacgctggagaccgttgcggcgaagggacggcttctggggttggacatggtgtaccattgtgcgtcggggcacctggggggttctttttctgccatggacatcctgacggttctctattttgaggtaatgaatgtagatcccaagaaccctgcggacccggatcgggatcgctttgttttgtctaaagggcattgcacacctgcgctttacccaatcttggcgcagaaagggtattttcccgaggaggatttggcgctattccgcagcgtggagggccatctgtccgggcacgcggagatgaaccatgtcaaaggagtagatatgtccacgggttctctggggcaggggatttccgcggcagttggcatggcgctggccgggaagatggacaagaaagcgtatcgggtttatacagttttaggagatggagaggtggaggaaggacaggtttgggaagctttcctcagcgcagccaaatacagattggacaacctctgcgcggtcattgatgtcaatggtctgcagattgatggaaagacagcggatgttatgcccacagagccgctggatcagaagctgaaagcatttggctggcatgtcctttccgtggacggccatgatctggctgggttaacggcggcgtttgcacaggcgaaaacgctcaccggagcgccgactatgattttggccaaaacgatcaaaggcaagggggtttcctttatggagaaccaggctggatggcatggcaaggcccccaacgcggaacagtatcagcaggcgcggcaggagctggccgctgccttggcggaaaaggaggggaagtaagatggcagagaaaattgcgacccgtgccgcttatggcaaggcactggtggaactggcggatcaggagccgaatctggtggttttggatgctgacctgtctggctccacaatgaccaaagagtttgccgcagcccaccctgaccgtttttttgatatggggatcgcggaggccaatatggtgggggtggctgctggactggccacctgtggaaagaaacccttcgtcaattccttcgcgatgtttgccgctggacgggcttgggaacaggtgcgcaacagtgtggcgtatcctggcctgaatgtgaaagtggtgggttcccatggcggattgtctgttggagaggacggggcaacccatcagtgcattgaggatctggccattatgcgtgccattcccaatatgacggttttgtgcccctgcgacggctatgagatgcgggaggcggtccgggcgcttttggcttatgaaggaccggcctatatgcgtttgggacgcctggcagtggagacggtgacagatcgtgtggagggataccagtttgccattggcaagggggcgttgctccgggacggacaggatgttaccgtggtagctgtgggtatgatggtgcagatggccctgcaggcggcggaacagctggcaggagagggaatctccgttcgggtcatcgacatgcatacgctgaagcccctggatacagagatccttttgacagcagcacgggagaccggctgtgttgtaacgacagaggaagccaacgtgattgggggcttgggcagcgcggtggcggaatatctttcgtctgcatgcccggttcctgttgtccgtcacggtgtggcggatgaatttggacgttccggcgcggcacaaaaagttctggaggcgtattccttgacaacagagggaattgttgacaaagtgaggcaggcggtttctataaaacatgctttgacactttgattagtttcagttgaaaacaacaaattttcgggtctgagaagagaaaattaaattaagaattgattaaggcttgcttttttggcaaaacaagattaaaatgaatcttgcaaagtgaatcccgtcagatgaattcttcggtggctggtatccatttccactcctggaaataaaatggtaaggagaagggagggaaccggtgccgcggatggatggcaatctggagacatctgcgtattgcaggggccgaaggggcaagaccaagactctcaggcaaaaggacagactcataggacgaatttacagtgcaaaaaacgaagtaaagagccctatttgaatggaacttttgaacggagtgctgcggtcttgcggcactccgttttgtgatctcagaggcggacatttgcagttcgagcgaagagaattgagaaaaggagagatttgcatggaattgatcgcaagtattaacagtgcaatcaatggctttgtctggggcgtccccatgctggtccttctggtgggcggcggcattttgctgaccatccgcaacagaggcgtccagttccggaagttcggctatgccatgaagaacaccattggtaaaatctttaagaagggggaagcaaaagaaggcgaaattactcccttccaggcgatgagtacggcgctggccggcacggtgggcaccggtaacattgcgggtatcaccaccgcggtcaccttgggcggccctggcaccatcttttggctgtggattacagctctgattggtatggccaccaaatattccgaggttcttctggcggtgaagttccgggaaaagaataagtatggcgactgggtaggcggcccgatgtactacatcaagaacggtttgggcaaaaattggaagtggctgggtgctatcttctgtatctttgccgctctggccgcctttggcatcggtaacgcggttcaggtgggcaatatcaccgactctgtcaacaccgtaatcctttcctttaaccctgatttcagtggacagtccacagtgaatgtggtgctgggtctgattctggtggtgctgaccgcaatcgttctgttcggcggcattaagcgtctgggcgcggtgacggagaagctggttcccttcatggctgtggtatacattgtggcatgcgtgatcgtgctggtgtactatggagcctatctgcctgctgtgttttccaaaattttcaccggcgctttctcccctgaaggcgtgacaggcggtgcagtaggttctgttattctggttatcacttggggcgtgaaacgcggcgtgttctccaacgaggccggccttggttctgcgcctatggctcatgcggcaacctctgagaccgatcctgtaaagcagggcctgtatggcatttttgaagtgttcatggacaccatcgtgatctgctctctgtccggcctgaccattctgtgtgcggccgagggcggtgcgctgaatctgaacattggtacggaaggaaccactgcgttgaacgcccaggcgttgggatctgtcttcacccagaagggcggcgcaattatcatcgctgtgggtctggcgctgtttgcgttctccaccatcctgagctgggcgctgtatggcacccggtgctgcgaattcctctttggctctaaggcgattaagccctatcagatcatcttcttggtgatcatcttcgtcggcgcgacgatggaactgagcctggcttggagtatcgctgacaccctgaacggcctgatggcaatccccaacctgattgcgttggttggcctgtccggtgttgtggtccgggaaaccaaacggcacttttctgaaaaagtaaataagtaatcttttttagaggaaagaatttcgatccgcaggacaacatagttgtcctgcggattttttagatggaaattttctgggacttgggagggagcgcatgatagggggaatcgtcctaatttgcatgctgttttgaaacatcttgcacagacgagatgtcgaaaatcgaaaaaaaacgctacaatttgtggattgtagaaagaaatgctgatatagtatactactttcgcaatttgaaaaagacgggagcttggcaaaaatttacaaattgaggggaaacagccggcaatccgtcaaaaacgaaaaagggagaagcgtatggaattgattgcacaaatcaacggcgcggtgaacagctttgtatggggggcccccatgctgattctgctcattggcgtcggtattctcatgaccgtacggaataaggggctgcagttccggaaattcggctacgccatgaagaataccattgggaagattttcaaaaggacccatgcgggggagggggagatcaccccgtttcaggcggtttcgacggcgttggccggtacggttggcaccggaaacatcgccggaatcaccacggcggttaccttgggcggaccgggtacactgttttggctgtgggtgacagccctgattggtatggccaccaagtattccgaggtgcttctggcggtgaagttccgggagcggaacaagtacggagactgggtaggcggccccatgtattacattaagaacggcttggggaagaactggaaatggctgggcatcatcttctgtgtttttgctgcactggctgcgctgggcacgggcaatgccattcaggcgggcaatattgtgggttccattcacacagcagttctggcgtttaatcctgatttcagtggagaagccaccctgaacctggtgttgggcattgtgctggcgatcttggcggcagtggtcctctttggtggagtaaagcgtctgggtgcggtgacggagaagctggtgccttgtatggcggtggtctatattttagcgtgcctggcgatcattctttacaatgcctccagcctgcccacagtatttcacgacatttttgtgggggcttttacacccaatggtgtgacaggcggtgctgtgggctccatgttcctggtcatcagctgggggatgaaacgggggattttctccaatgaggccggtttgggtactgcgcccatggcccatgccaccacgtctgagcgggaacctgtcaagcaggcgctctatggcatttttgaagtctttatggatacgatcatcatctgcagccttaccggtttgacgctgctctgctcggggattgatttgaattatggtgtgacaggcgaaatttctctggtgtctgaggcgctgggtaccctgttcacccagaaaggcggcgcattggtgattgcagtggcactggcgctctttgccttttctacgatcctggggtgggcgctttatggctcgcgttgctgtgagttcatcttcgggtctaaggccatcagaccctatcaggtcatctatgtcctaatgattgtggtaggtgccacagttgatttggagttggtttggaatattgccgacacgctgaacgggctgatggctctgcccaacctgattgcgctggcccttttgtccggcgtggtggtcaaatgtaccaaggagtattttgccaagggaaaatctctggaagaaccgaaataaattggaaacaagaatcccatggaacaggaaggtgttccatgggattctttgattcttggagaagaaagattgtacagaggagaaaggggaaaatgcgcaaacctttacaatctatcgcttgcgaaaccagcgtggttatagtataatcgaacgtgtaaaatcaagaactttttgtgactgacggaagtgggagaaccacagggagcaaaaagcatagttgcggccgaccgtctgggcagttcaattttcacacaaagggaattggactgcctttttttcgtaggataaaaacaaagagggcctgatcaatcatggaaaagagaggatggtttgtatgaaaaaagtaggcgttatcatgggcagcgacagtgatttgcctgttgtggagaaagccattgacaagctcaaggaatacggggttccctatgaggtccacgtgtactctgcccaccggaccccagtccaagcaggggagtttgcccggacagcccaggagaacggatttggggcgatcatcgcggccgcggggaaggcggcgcatctggcaggggcgctggcggccaacaccacgctgccggtgattgggattcccgtcaaatcctccaccttggacgggctggacgcgctgctgtccacggtgcagatgcccacaggaatccctgtggccaccgtggctattgacggggcggccaacgcggccttgctggccatccagattttagcagtttcagatatggcgctggcagagaagatccgtcaggccagggctgcggaatcccagaaggttttggagaaaaacgccggagttgaggcaaaattcaactaagggcatatcagaaatggaggaatgaaccatgggtggtttttgcggcgctatctccagccgggacgtggtgttggatgtctattttgggacagactatcattcgcacttgggaacccgccggggcggtatggctgcctgggacccggaactgggattccagcgggagatccataacattgaaaacgcccccttccgcaccaagtttgacaggacggtgggggaaatggtgggcaagtgctgtattggcagcatcagcgacacggacccgcagcctctgctggtccgctcggtccacggaacctacgccatctgcgtggtgggggtcatcaaaaatgaagatcagctgattcagcagctgctggatcaggctgacggccactttgaggccatgagcggcggacgggttaattccaatgagctggtggctactttgatcagccagcggcccaccattgccgagggaatccgctacgcccaggagatggtggaggggacggtatccgtcttaattatgacgccggactgcctcatcgctggccgggataaatttggccgtttgcccattcatgtgggacaggatgacgagggctgctgtgtggcctttgagtcctttgcctaccagaagatgggctaccatgacgcctatgagctgggtccggcagaagtggtgaagatcacggagcgtggttgggagaccctcctgccggcggaaaaagagatgaaggtctgcgcctttctgtggacctattacggctaccccaactccaactatgagggcgtgaacgtggaggtcatgcgcaaccgcaacggggtgagcttggccaagaccgaccgggagaaaggggtggcccaggatatcgattatgtcagcggggtgcccgattccggcaccccccacgccattggctatgccaatgagagcggcattccctttgcccggccctttatcaagtatacccccacctggccccggagctttatgcccaccaaccagaaggaacgggaccgggtggcgaaaatgaagcagattcctgtgcacgatctcattgaggggaaaaagctgctctttgtggatgacagcatcgtgcggggaacccagctccgggagacggtggagtttctctacgccaatggcgccaaggaggttcatatccgctcggcctgtcctcccattatgtatggatgtaagttcctgaatttctccaccagccgctcccccatggaactgctggcccgccgcacagtctatgagctggagggagaagagggagataagcacctggaggagtacagcgaccccaacaccgaccggggtaaaaaactccgggaaaccatctgtgaaaagctccattttacctctctggagtatcagtccctggacaagctcattgaggccatcggattggagccctgcaaggtatgtacctactgttggaacggaaaggaataaacgcgatgaatatgcaatcaagatcggacagttacgccgcagcgggcgtggacattaccgctggctatcgggccgtggagctcatgaaaacccacatcgccaagaccatgacggcgggcgccctgtctgacatcggtggatttggcggcctgtttgaactggacctgacggggatttcccgtcctgttttggtctccggcaccgatggggtgggaaccaagctgaagctggcgtttttgatggacaaacatgacacagtgggcatcgactgtgtggctatgtgtgtcaacgatattatttgcgtgggggccaagccccttttcttcctggactatattgcctgcggcaagaatatcccggagaagattgcggacattgtctccggcgtggccgagggatgcgtgcagtccggggtatctctcatcggcggggaaaccgccgagatgccgggcttctatccggtggatgagtatgatctggccggattttctgtgggtgtggtggataaggcgaaggtgtttgacaaaaccaccatccagcccggagatgtgattctgggcctgccctcctctggggttcattccaacggcttttccctggtccggaaggtcctggatgtggagcacgctgacctgaaggcgccggtggaggccctgggcggccggtctctgggagagaccttgctgacccccacccgtatctatgtaaagagcatcctggccctcatggagcaggtgcagatcaagtctgtctcccatatcacagggggcggattctatgagaacattccccgcagcttgccccaggggatgacagccaagatcaaggaagccaatgtgccagtgctgcccatcttcaccctcattgagaaggccggcagtgttccccgccgggagatgttcaacaccttcaacatgggcatcggtatgacggtggtggtggcccgggaagaggcggagaaggccatggaggttctgcaagccgctggggaacagcccgttcgtctgggcgaaattgtcgccggcgacgagggtgtcatcctatggtaaaaacaaagattgccgtgctggtctccggtgggggcaccaatctgcaggccctgctggacgcccagagggagggggtgctgacagatggagagatcgtcctggtcatctccagcaacgacagcgcctatgccctgacccgggctgcccaggccggggttcccgctgtggtgtgcagccgaaaggcactgggaagccaagcggcttttgaagcggccatttcccaggcactgtccgaccacggcgtggaactgcttgtcctggcgggctttatgagcattctcagcgcggactttaccagccggtggccccggcggattctcaatgtccatccctccttgattcccgcgttctgtggaaagggattctatggtctaaaggtacaccaggccgcgttggactacggggtgaaggtcaccggtgccacggtccactttgtcaacgaggtgccggatgggggagagattctccttcagaaggcggtggagattcagccgggggataccccagagacactgcaaaggcgggtgatggagcaggcggagtggaagctgctgccccaggccacccagatgatatcagaggagatcaggagggagaaggaccaatgaacgtctatgaaacccacgacctgacggccctgctggccgccaattcctacccgggacgagggattgtgctgggaaacacagccgacggaaaacagtcggtggcggcgtatttcatcatgggccgcagcgaaaacagccggaaccggattttcgtcaaggagcccgatggactccgtaccgaggcctacgacccggccaagctggctgaccccagtctcattatctatcaccccgttcgtcagatgggacggggactcattgtcaccaacggggaccagacggacaccatccggtccttcctggaacggggccttcccatggagcaggcgctgcggacccgggaatttgaaccggatgggcccaactggaccccccgcatttccggactgctctccccggacggcagttataagctgtcgattctgaagagtgcggatgcccagggcagtgcctgtgcccgctacacctttgagtatcctgccctggccggggtgggtcattttctccacacttatgtctgcgatggaacccccatccccacgttccaaggggaaccagagcgggtgaccatttccggcaccatggaggagtttgcccacgggatttgggatcatctgaaccaggagaataagatttcgctgtatgtccgatttaccgatttggcttctgggacgtaccaagagatcattctgaataaaaatcaataagcgggggagcgaacgatgaaacaactggaactgaagtatggctgcaatcccaaccagaagccagccagtatttctgtcaatgacggccgggacctgcccattgaggtgctcaatggcaaacccgggtacatcaactttatggacgccctgaattcctggcagctggtgaaggagctcaaggaggccacgggactgccggcggcggcgtcctttaagcacgtctctcccgccggcgcggcggtggggctgcccctcagtcagaccgaccgggccatctactttgtagacccgcaggccgagctgacccccatggcctgcgcctatatccgggcccggggggcggaccgcctgtgctcctatggtgactgggcagccctgagcgatacctgtgatgccgccacggcggcctatctgaagccggaggtctctgacgggatcatcgcccccgactataccccggaagccttggaaatcttaaagtccaagaaaaagggcggatacaatattgtgaaaattgacccggcctacgttcctgcggtgcaggaacacaaggatgtctttggcatcaccttcgagcagggacgcaataacttcaaaattgatgcgtctttgctgaccaacctggtgacagagaataaaacccttccggatcaggccaaaatcgacatgattgtggccctgattacattgaaatacacccagtccaattccgtctgctatgtaaagaacggacaggccatcggcgtgggggcgggccagcaaagccgcatccactgcacccgcctggcggggaacaaggcggacaactggtatcttcgccagcaccccaaagctctgggtctccagttcctggataccctccgccgtccggaccgggacaacgccattgacgtgtacctgtccgatgagtatgaggatgtgctgcgggaaggtgtatggcagaccaaatttaaggtgaagccggaaccccttacagcccaggagaaaaaggaatggattgcgacccagaccggtgttaccgtgggcagcgatgcgttcttccccttcggggacaatgtggagcgggccagaaagtccggtgtctcctacattgtggagcccggcggttcgatccgggatgacaacgtcatcgagacagcaaaccgatatcacatggtcatggcctttaccggcatgcgcctgttccatcactgaggcagaggaggtccctatgaaaattcttgtggtaggcggcggcggccgagagcacgctatcatcaaaagcttgaaaaaaagccctcgggtgacggagatttacgccgctcccggcaatggcggcatcgccgccgatgccatctgcaccggcattggggcgaaagacctggcgggcatcacaacctttgccaaggacaacgccattgattttgcggtggtggccccggacgatcccctggtcctgggggcagtggatctgctggaagaggcgggaattgcctgctttggccccaacaaagcggctgccattctggaggggagcaaggtcttttccaaggacctgatgaagaagtatcacattcccaccgccgaataccgggtttttgacaacatggacgaggcgctggactatctaaagaccgcccccatccccactgtggttaaggccgatggcctggccctgggcaaaggcgtcaccgtggccatgacacgccaggaggcggtggcggcagtgcgcgcctgcatggaggacaaaatctttggagagagcggcagccacattgtcatcgaggagttcctgacgggccccgaggtctcggttctctcctttaccgatggcaaggtggtcgttcccatggtctcctccatggaccataaacgcattggggatggggacaccgggcccaacaccggcggcatgggcaccattgcccccaatccttactacaccgaggacgtggccaaggtgtgtatggagaccattttcctgcccaccatgcgggccatgaatcaggagggccggaccttccgaggctgtctctattttggcctgatgctcacggagaagggccccaaggtgattgagtacaactgccgctttggggacccggagacccaggtggttctccccttgctggagagtgatttgctgaccatcatggaggccactgccaagggcacgctctcggagaccccggtgcagttcagcgacaagtctgcctgttgtctggtgctggcctcccaggggtaccccaagtcctatgagacagggtatcccatcaccattcccgcggacctggatgcccaggtctttgtggccggtgccaagctggaggagggcgtgctcaagacctctggcggccgggtcctgggggttactgccgtgggagataccctccaggaggccattgacaaggcttaccgggagggggccaaggtgacctttgagaacgcgtactaccgaaaggacattggtgcccgggctctgcgggcaaaggaagaggtaaaataaatggtatatcgggtctatgtagaaaaacgcccagggctcacagcggaggctgatgccttggccagcgatatccggacgcttttggggattgcttctctggagagactgcgtctgctcaaccgctatgatgtggagaacatcacgccggagctcttcgattacagtgtcaaaacgatcctctcagaaccgcagctggatctggtgacggatacactgccccaggagggaattgtctttgccgtggagtatctccccggacaatttgaccagcgggctgactccgctgcccagtgcatccagattctctcccagggggagcggcccttggtgcgctctgcccgggtgtatcatctgacggggcagctgaccgcggcggaagtggcgtccattaagaaatatctcattaacccggtggaggcccgggaggcctctctggagccctttgaaaccctggccatggactatgctgtccccgagacggtggcgacgctgaccggcttccgggagatggaggagacggaactgcaggccatggtggccgagtatggtctggccatggacctggatgatctgcggttctgccgggactatttccgcaccgaggaccgggaccccaccatgaccgagctgcgggtcatcgatacctactggtcggaccactgccggcacaccacgttcctgaccaccattgacggggtggagtttgccagccccattcttcagcagacctatgaagagtatctgaatacccgcaagcgactgaaccggaccaaacccatcaacctcatggatatcggcaccattgtggccaagtacctcaaaaagcaggggaaaatgcccaagctggatgagtccgaggagattaacgcctgcacggtcaagatcaaggtggacaccgaggcggggaaagaggactggctgctcctgtttaagaatgagacccacaaccaccccacggagatcgagcccttcggcggggcggccacctgtgtgggcggcgccattcgggacccgctttcgggccgtgcctatgtatactccgccatgcgtttgacaggcgcagcggacccgctgacgcccattgagcagaccatggaggggaagctgccccagcggaccattgtcaccaaggccgccgccggctactcctcctatggcaaccagatcggcctggccacaggccaggtggacgagctgtaccatcctggttacgcggccaagcgcatggagattggcgcggtcatcgccgcggcgcctgcggccaatgtccggcgggagcgtcccgccccgggggatgtggtgattctgctgggcggccgcacaggccgggacggctgcggcggcgccacggggtcttccaagtctcataccacagaatccctggagacctgcggtgccgaggtccaaaagggcaacgccccggaggagcggaagctgcagcgcctgttccgaaatccggaggcctcccgtctgatcaaacgctgcaacgactttggggccggcggtgtctccgtggccattggcgagttggccgagggcctggagattgacctgaacaaggtaccgaagaaatatgagggcctggacggcacggaactggccatcagtgaatcccaggagagaatggccgtggtggtggaggagaaggatgcggcccgcttcatggagctggctgaccaggaaaatctggaggccaccgtggtggcggctgtcacaggcaagggccgcctcaccatgacctggaatgggaagaagattgtggacattgcccgtgctttcctggacaccaatggggtggaaaagcatatcaccgcggtcacagcccagccggagtccattctgaaggagcaggttacagcgttccggcagggctacctggacctggccggggacctgaacgtctgctccaaacggggactggcagaacggtttgacgccaccattggcagtggtacggtccttatgccttttggcggtcaataccaactgacgcccactcaggcgatggtcaatcaaatctccatggaagaggggagcaccgacacctgttccctgatgtcttggggctataacccctatatcacagaaaagagcccctatcacggggcctacctggcggttgtggagtcggtttccaagctggtggccaccggcgcggggctgaaggagacctatctcagcttccaggaatacttccccaagctggggaaggacccgcaccgctggggtcagcccctggctgccctgctgggggctttccgggcccagaaggagctggagattgcggccatcggcggcaaggactccatgagcggttcctttgaggacttggatgtgccgccgaccctggtgtcctttgcggtgaccaccgaccaagtggggcatattgtctcccctgagttcaaaggggcgggccatcctgtggtttggctctgcccggagtacggtcccgacggactgcccgtggcggcctcgctgaagaaggtctatcagagtgtgaaccggctgatgaagaaaggaaaggttctggcagcctatacggccaccttcggcggtgtggcggaggctgtgctgaagatggccctgggcaatgggatcgggttccggtttgatgagggctgtaccctggatgaactcttcgcttactcctatggctccttcgtgctggagctgacagagcaggaggagatcggtctgcctctgggggttaccacggaagaggggagctttacctggcgggaggagagcatcccgctccaagaactccaggaggcctatgagggcaagctggagcccatctatccctgcaacattgcccagggccagaaggagattcctacgctgtctgcccatggtgacagctggaagaagccgctgatcaaagcggcaaagccccgggtgctgatccccgttttccctggcaccaactgtgagtatgacgcggccaaagccatggctgcggcaggagccgagccggagattgtggtgatcaaaaacctcaccgccggggccattgcacagtccatggagcatgtggcccagcggctggcccaggcccagattgtctttttgcccggcggcttctccggcggggacgaaccggacgggtcggccaagctgatcacctctttcttccggtccggtcaagtgaaggagcaggtgaacgaactgctgaagaaccgggacggcctgatgctgggtgtgtgcaatgggttccaggcgctgattaagctggggctggtaccctatggagagattgtggacaccgacgagacctgtcccaccctgaccttcaacaccatcgggcggcatcagtcccggctggtgcgtacccgggttgcctccaaccagtcgccttggctgatgaagacccagccgggggagatttataccgttcccatctcccacggagaggggcgcttcctggcttcggaggaactggtgcggcagctggcggagcgggggcagattgccacccagtatgtggacctggcgggcaatcccacctcggatattcactacaatcccaacaactctgtctgggccattgagggaatcacctcccccgacggtcgtgtgttcggcaagatgggccacagtgagcggacgggcccgggcctgtaccgcaacgtccccggtgactatgacatgaagctcttccgcgcggcggtggagtatttccagtgagaaaggaggagcccgttatggctttttattatcccgaaccctctcataccttcagtgagtacctgctggtgcccggctttacttcggaagagtgtattcccgacaacgtctcgttgaaaacccccctggtcaagtatcgcaagggggaggaggactgccccatcagcttgaatatccccatggtctccgccatcatgcaggcggtgtccaacgacaccctggcggtggccctggccaaggagggcggcctatcttttatctatggctctcagtccattgaagacgaggccgcgatggtgcgccgggtgaaaagcagcaaggccggttttgtcatcagtgcctccaacctgacgcccgacgccaccctggctgatgtgttggccttgaaggagaagaacggcttctccactgtggccatcaccgaggacgccacgcccaccggcaaacttttggggctggtgaccagccgggactaccgaatcacgcggatgagcacggacattcccgtccgggagtttatgaccccccgggaaaagctcattacggcgcctgcggccaccacgctgaaagaggccaacgacatcatctgggacaataagctcaacgcgctgcctgtggtagacgatcaggaccacctgatgtattttgttttccgcaaggactatgcagaacataaggagcaccccttggcccttcaggacgcggacaagcggtacctggtgggtgccgggatcaactcgaaggactatgcggaacgggttcctgccttggtggaggccggcgcggatgtgctgtgcattgactcctcggagggatattccgtctggcagaaaaagaccattgactttatccgggaaaaatacggcgacacggtcaaggtaggtgccggcaacgtggtggaccgggagggcttccggtacctggctcgagctggtgcggactttgtcaaggtgggcatcggcggcggttccatctgtattacccgggaaaccaagggcattggacgggggcaggcttccgccctcattgaggtagcggctgcccgggatgagtattataaggagaccggcgtctatgtgcccatctgctctgacggcggcatcgtgtttgattttcacatgaccctggccctggccatgggggcggatttcctgatgctgggacgctattttgcccgctttgacgagagccccaccaataagctgatggtcaacggtgcctatgtgaaggaatattggggtgaggggtctaaccgggcccggaactggcaacgctatgacctgggggggaagaacgacctggcgtttgaagagggtgtggattcctatgtggcctatgccggttcccttcacgacaacgtggaaaagagcctgtataaggtgaagtccactatgtgcaactgcggggtgatcaatattcccgatctgcagaagaacgccaagcttaccttggtctccgccaccagcattgtggagggcggataccatgatgtcaccctgcggaccacaggtgggggacagtaagaggttcgggttctcagaaaggggaacccgtgccccctcaccggtttagaacggttggaagcacggtgcggtttttcaaagtgcttgaaaggagagcggattcccatgaagagtgacattgagattgcgcaggcttgtccgatgagacacatccgggagattgcccgggaagtgggcgtggaggagcgatatctggagcagtatggcaactataaggccaaaattgacgacaagctgcttcaggagaaaaaaggacccgatggcaaactgattctggtcaccgccatcacccccacccccgccggggagggaaagaccacaaccacagtgggcctggcggacggcctgcggaagctgggcaagaagtccgtggttgctctgcgggagccctctctgggaccggtgttcggactcaagggcggggctgccggcggcggctatgcccaggtggtgcccatggaggacatcaacctgcattttaccggggactttcacgccattggcgcggccaacaatttgctggccgccatgctggacaaccatattcagcagggcaacgccttggggattgatgtgaaaaagatcacctggaaacgctgcgtggatatgaacgaccggcagctgcgcaacattgtggacggcctgggcggacgggcccagggggtgcctcgggaggatggatttgacattaccgtggcctcggaaatcatggccgtgctctgcctggccacctccataacagatctgaaagcgcgcctgggacggatggtggtgggctacacctatgaggacaagcccgtcaccgccaacgacctgaaggcggcgggggccatggcggcgctgctcaaggatgcgatcaagcccaatctggtgcagacgctggagggaacgccggccctgatccacgggggcccctttgccaacatcgcccatgggtgcaactcgatcatggccacccgggcggcgctgaagctgggtgactatgctgtgacagaggccgggttcggcgcggacctgggggcggaaaagttcctggatatcaaatgccgcatggccgatctgcagcccagtgccgtggtggtggtggctaccgtccgtgccctgaagcaccacggcggcgtggcaaaggccgacctggggaaggaggatctggccgcgctggagcgcgggctgcccaaccttctgcgccatgtggagaacattaccacggtgttccgccttccctgtgtggtggccatcaaccgcttccccttggacacggaggcagagcttgcgctgattgctgacagatgcagggaactgggggtccatgtggccctctccgaggtctgggccaaagggggcgagggaggcagggccctggcggaagaggtggtgcgtctgtgtgagcagcccaaccaattccagcaggcctatccgctggactgctccatcgaggaaaagctccgggccattgtcaccaagatttaccggggcaaggatgtggttttgacccccaacgcacagaaacaggccagacagcttacagagcagggcttcgggggatatcccatctgtatggccaagacccagtatagcttctcggacaaccaggctttgctgggggcgccggaggactttacggtgaccgtccggaacctgaaggtctctgcgggcgctgggtttattgtggccctgaccggagacatcctcaccatgccaggtctgcccaaggtgcctgccgcggagaagattgacgtggatgagacgggaaagattaccggccttttttaagcaaaatatcttaaaaaaagcgacagcaccggggctccggtgctgtcgctttatagacggacgggattctgcgtgtactcatttttcccgggaacccgcccgaactctctgcggcaaagatcgtacagcgcggtgcagcgggcttccagggcaaacacccgcctggcctctgaggggagcttggccccatgggcgggtttaactatcacgggcagagtggcggtggttttcatctggcgcagtaagttctgtcccttggctgtgaaccccagaacccgcaggtaagggggcgcatccaggcggtcctgggcggtcagccccaaaaaggcccacagcaccagccggcggattcgggccaggggataccgtttcgttttgaccaattggtagagtgccggcagagagtcagcggactgaaccgcatcatacaggcggtgactcagaccttctccgctgtcaggtagttgggaaaagtcttctgcctccatgccccgcagacgggccaaaaccccctgggtgcaaaatgccaggctggcagggttggcccgcaggcgcgcttccgcctggggggagagatggggggccagagaagtttccccaggttcttccaaaagcctttcccgcaggtaagaggcggagacatgagacaggccggtttgcccctggtcgtggcccgcccccaggcgggggatggtgtggggaaccaggggggagcccagggaccgaagcgcccgcagatattcaatgcccaggttgttgttgggatggcgcaggcactgggcgttttctcccaaaagggcggtggcagcccgctgacgggccacgggaaaggagaggccctgcgccagtgtctggcgcagcaggcagcgccaggcctcgctctccagacagtctgccactgcctggaggggggataggatgccggcctcactgccgaagctgagggtatccaccacgcctgtggcagtcagaagcgccactccgccccgggcaaaggattccgcagaggagacagcccagagggtgggaagctccagaatcaggtcggccccttgacgcagggccagttccgcccgggtccacttgtccgccaaggcggcgtctccccgctgtacccagttgccgctcatgacgcagaccaccgcgcagtccggtccgaaggtctgggagagcatgcgaagatgatgaccgtggccgctgtgaaagggattgtattccgcgatgacgccgattgtatgcatagaccaacctcgcttcagaaaaaatttgaaatttggggaaaaaacagttgtccttttcataaaaatgggctaagataaatgcgtatgaactattttaccctgaatgggtaatccaagcaagaacctatcgcaatgattaacaattaaggagtggaaaataccatgaaagttttggttatcaacgcgggcagctcttccctgaagtatcagctgctggaccccgatacgaaggaagtcctggccaagggcctttgtgagcggatcgggatcgatggccacattaaacatacccccaccgggaaggatgtctatgatgcagaccgctacatgccggaccatgaggctgctatcaagctggtgatggaggttctgacccataattactatggcgttatcaaagatatgtccgagatcgacgctgtgggccaccgcgtggtgcatggcggcgaggagttcacccactctgtgatcattgaccgggcggtgatgaagggaatccgggactgcattcccctggcacccctccacaaccctgccaacatcactggcattgaggcttgccaggatgtgatgcccaatacccccatggtggcggtgtttgatacggcattccaccagaccatgccccccaaggcctacatttacgcagtgccttaccgctggtatacagagaataaggttcgccgctatggcttccatggcacttctcaccagtatgtttctcagcgtgccgcggagatgctgggccgccccattgaggaactgcgcattgccacctgccacctgggcaacggcgcctctacctgctcggtgaagtttggcaaatccattgatacctccatgggctttacgccccaggacggtctgcccatgggcacccgcgccggtgccattgacgcggccatcacggagtatatcgtggatcagcgcggctattccggcaagcgcgtggagagcgccctgaataaggagtccggcatgctgggcatttccggcgtttcctctgacttccgcgacctggaggctgccgcggcagagggcaacgagcgtgcgcagctggccattgacgtcttctgctataaggtcaccaagcggatcggttcctgtgccgccgccatgggtggtctggacgctgtggtattcaccgctggcgtgggtgagaactccgcgaccctccgtgccaagatcatggaagggctggaattcctgggcctgaagatggaccctgagaagaacaacgtccggggcaaggaggccatcatctccaccgatgactcccccaataagattctcctgattcccaccaacgaggaactggtgatcgcgttggataccgccagactggtcagagagcaggaagctgcagtcaaagaagactgattgaatctgacggcaataaaccgaaagcggaaaacgctgggtcctgtatagcagggcccagcgttttttagatcggtcagggagttatgcggtgtatttcccaccactggctttatgaaataaaagactcagaccttccagggctttgttcagcagccagatgacagagggaatcagtagaataaataccgtgagaaccaaaataccgccgaaggacagcggagacagagagaagagaccggggatgactgcgatgatgaagagcaaagcaaggattagtccccccatcatgcccagatggagccggttgacaggcttggccacccgccagaccataaagaatcccacgatggtgaccagcagtgcggtgatggtggaaatttcgttgttgctgatttggaaagcttgctggaaaagaagtacaaaaatgatgataaacaaatctgtaaacgccgccggaagagcccggacgatggcgttgcggagaaattttccactgaccaaattttcgttgggctccagagctaggatcagggaggggataccaatggaaagcagactcatcagtgtcagctgcgacggagagaggggataggagaacacagcggtaatggagatcacagccaagatcagggagaaaatatttttcaccagatacaaggaggccgcccgttcaatgttgttgatgacccggcgcccttccgccaccacagagggcatggaggagaagtcagagttcatgagaaccagatcggaaatctgggcggccacgtcactgcctgaggccatggccacgctgcaatcggcttccttcagggccagcacgtcgttgacaccgtcaccggtcatggccaccgtgtgcttgttgctttgcagggcctggatcagaagctttttctgattgggcttcacccggccgaagacgttgtactcctcgcaggcggcttcgatgtcctcataggtctccagggtggaggcatccacgtagcggtccgcaccctcaatcccggcctcccgggcagctgcggaaacggtgacagggttgtccccggagatgactttcacggtgacgccctgcgcgtggaagtaggcaaaggtctctttggcattttcccgcactgggttgcgcagcaaaacgaaagccagaggcagaggagaggagataccccgtccgttggggccaggctggcaggcggcaaagagcagtacccggctgccgtcggccatggcttcctcagccacggagcggtagggagcgtagccctcagcacccaaaataaactccggcgcccctaacacatagctctcttggccgccgtaagataccgcgctgtacttggtctccgaggaaaaccccagcacctgcagagcctttcgggcggtgtcagagcgcagggatttttgcagggcctgcatagtctcattgtcgggttccatgttggaaacaaagtccgacaaaagcttttccagctgtgcctccgtgacctgggtggccagagggagcatgccgcagtatgccatctccggttgggtgatggttcctgttttgtccacacacagcacgtcgacccgggccagcgtttccgtgcatttgaggtcctgtactaaggtgttctgggcggccaggcgaagaacgctggcggccagcgccaggctgaccatcagatatagcccctctgggatcattccgatgactgcggcggcggtggtctcaaccccttctttgagggagaggcccaacagagaggtttgccgatagaagagcatcccgccgatggggacaatgaggatgccgatggcaatcagcagccggttgagagagcgcatcatgccggggagatgattttttttggatttcttggcctcattggtcagctgggaggcgtaggaatctgcccccacgtgagtaagaatggcgtagcattttccagagacgacaaagctcccagacagaagctcgctgcccacgcccttggaaatttcgtcggactctcctgtgatcagggattcgttgacctgcacggagccggaaaccaccttggcatcggcggcaatctgattgcctgcggatagaaccaccaagtcatccttcaccagatcggcggtggggatggtggtgactttgctgtcccgaatgacctgggcccggggggcggagagaagagagagggcgtccaatttcttttttgcatggagctcctggatgatgccgatggcggtattcgcggcgaccaccagcaggaagatcaattctccaaaagagccaacggcaatcaaaaagccggcaatgatgaaaaaaatcagattgaaaaaagagaacaaattttccagtacaatccgcttcaccgacttggtgggggactccggcggggtgttgacctgaccggcttggattcgtgccctgacctgggacgctgtcagaccaaggggactttggccggcgggttggtgcaatgacggcatacgcacgcctccgatttctgggagatttctgatgcgaaaaaccggaggcccgggggcatagatcccatggggcctccggtttttgcaaccaaaggtagtatactatttttcgtcaaaaataacaacgaatagattgtaaacaattcccggttactttcccacagccaccttgccgcaggttgcacagttgtgagagcagtcccacagatgctcggcggtgggagcccagttctccgcgtaactgtcgcatttggcgcacagatcatccacgtcttccagggcggttacgtcactggggtgtgccccggatttgtggaccatttcccgcagtttttccggattctccagcatggggcagggccgcagatggttttcattgaacggttgaccatcgtggtatgccatgaacaggggagagcacagtgcttccagcagagtcttttcccggatgttggaatcggaataatgaatgaacacgcagggatcgcagtcaccgttggcgttgatgtggaggtaacggcggccgccggcgatacatccgcctacatactcgccgtcgttctggaagtccagcatgaagatgggcttctttccccggagctcccgaatctggtgatacatatattctctctgttccggcgaggggagcagttccggcaccgcatccttgcccacaggcatgtagtggaagtaccagacaaaataagcgccccattccaccaactggtccacataagcctctgtgctgacgtctttgatattggcgctggtgtagcaagtggagatgccgaaaggcagacgattgcgcttaagcagattcatggcgttaacggctcgttgatatgtgccattgccccgacgggagtccgtcgcttcttcaaagccttccacactgataacaggcacaaaattctttactttcagcatgttctgtgcaaactcttcgtcgatcagagttccgttggtaaagcacataaagatggcgtcagaatgcttttcgcagagcttaatcaggtcttttttccgcaccaggggttcaccgccggtgtagatatagaagtaagtgcccatttccttaccctggcgaatgatatcatcaatttcatcataggacaggttcaacttgttgccgtactctgcggcccaacatcccttgcaatgaaggttgcaggcagaggtggggtccagcaggatggcccagggcacgttgcagttgtacttggtgcggtactcgtcctgctttttccagccggtgatgctggcgttgaggaaaaggttggacaataaggtctcggtaaagcccagatccatttcagtcatcatacgaagcaccagcttgtgggcggtggagtcttcgttgttgatggcgtcacggatggcctggcgctgacgggggaaggactggggaccgtcacccgcgaatttgtccaccatgtccattacatgggttaagtttttgatggggtccttttcaatgtaggaaaaggcctgactcaatgcgaattttttgatgctgtcgcctaacataataaatttcctcccttatgtgcgatatcaagaaagctccgaccaaaataagaatagagtggaaagcaagaatcaaaagcggtcagtgtatatcatagtacgttctgttgcattttgcaagcgtcaacccatacaaatagtgagaataccatgaaaataagccagaccattttgatcggaggagaggcaggaaaagcctgtcgcttattataggactttattttttattttgcaagtgttttttacaaaagtagttacataaatggaaaaatggagtttgcaatccatatttttccaaataattgaaaatgagcgcgtgttatgttacaatacaaaatctgagcatatgaggagaggggggcgggaagggacggttaaatcgttgtttaccggttcccaaaagaatcggcaacggaaggttgaaagcgtaataaaggccaaagagacatgagtaacatggccattttatgagattttatccacgaaaaagaaatatttctttacagtctgagcaaataggagggatagacatgtttcagggattttcccagcagaccaatgactttctctgggggatacgctttaacaatgagcggtcttggtttgaggcgcataagcaggaatacctggactacgtacaaagccccctgcgccagctggcccaggaggtctatgcacggttttctgcggcccatgaggaactgcctttgatggtgcgggtcagccgcatctatcgggatgcccgccggctctatggccgtgggccctataaaagccatctgtggttttccctgcggatgtccggggagaactgggcggagcagccggtgttctggtttgaaatttatccagccggctatgcctatggtcttggtatctatgaggcccggccggctctcatggcaaagtttcgtaaggcaatggacgaacatcccgaggatatgctgccgttggcaaacgcctttcagaggcaaacccggttccggctgggagcagaggaatacaagcgccccaaaggcaccgcacagccccctttggaccagtggtacaatcgcaaaaacctggatcttacctgtgaccgggagattgatgaccttctctacagccgggcgttggtggatgaactgctgcaggcttatgaggcgctgatgccctattaccgctatttctccaggatttgcagccaaggggaatgagagctacttttttaagatgcggaaccaattatggtggtaatcgatgatcccttcccggcgcatattggacagttctctggacagagcactgcggtcagcgcctaaaaaattggccatactggcccggtcaaagggaacggtaaaggaatcgccctgggcagcggcgtattgggagagaaaggtggtcagcttcatccgcagggtgttgcgggagagaatctgaattcgctggttcatgtgcagcgtccgggtggccagggcggaaatgaagcggttggacagggcccagtccaagggacgaaatggtggcatcggcgctttgatccggttgggactcatccagagaatttccgattccgtgacggcgcagatgtaaatgggagcgtcggtccccaagaagcaataggcctctccaaagagcccccctgcgcccacactgttcatgatgatgtggtgtccgtccatgtcgtccatatagacctgaacggttccggagagaaccagaccaaagcgttccaaagggaaggaaacgtggtggagaaattcccctttttcataggtctttgtctttgcatcaaagtaggagagtgcgtatgcctgctcttccggcgtgaggccctgaaacagcgggcattgttccaattgggggtggtgcatcgtggttgcctccctgggggattagaatagtgtatgcaccttattatagaaaaagtccgttgcttttgcaacggactttttggaatttcaggcggcactgccggcagggggacttcccgcagtgtcgtacttttcccctaagatggtgtggcatccttccagagcgtattccagtttctggtagacagcgtcagagacagtggtggtattgcctgctttgtactctgctatcgcggcgtttacatccagaatgatgtagcggtcttggacattggccccccggttgaggaccaggagaggaacgtaattgatatgggagacggtcgtttcccccgttgcggggtctttggtgagttccaggttcaaaatagcagtggtatcggtatagttgacattgaccgtggcagggctttggttggagacaaagtttcccagggaatagcacaccagacccgaccgggtagagccgtcatccagcgtgacggtgcgggtttccaatggctgagggacatgagagtggctacctaaaatcagatcggctccgtgagagatcaaaaagtcagccacttgctcctgatatgcgttttgcgtggtctgatactcaatgccccaatggaccatcacagcgatcaaatctgtccccagactttctgcgtaagccagctcctgctgcagcttttcctggtccagggtggcgcatgcgccagtgtaatcggtgttgaaccgattcagagaaaaatccttatcctgaggaactgcaatcccgttggttccgtaggtgtatcccagaaaagccacggaaattcctcccacgtccgctacaatgacaccgttgttctgggtgaacgcttcctgggtccggtaggttcccacgtgttggagccccgcctggtccaaaacgtccagcgtccgggcaagcccttgaaagcccttatccatgctgtgattgttggccgtggtgaccagatcgaatccgatggttttcaggtcatacgccagggcatcgggagcacagaactggggataccctgagtaagggggaccattgagggtggtttcgaagttggccacggcatagtccgcggcttcgatccaggaggagacggactgaaagcaggggagatagctgtatgtgtccgtggcagcgtcataggcgtcgttggtctggggagagtggctcataatgtccccgcagactgccaaggtagcggtaataggttccttgttgtcctgggaggctgtgctgccagcgggggcggcgttttgtcgaagccctaaaaagatgaaaataacgcagagaagaacgaggatcaaagctgaaaaaagcagttttttcttcatgtgacttcctttcattctgagaagccccctgctcgatgacacaggcggagtaaacgtggcatttgttgccaccagacaggatgggaacaatcaacagggagcggtcaggtgcggtagagtgcggcagcggctgtccccacaggaagggcattgtcaccctgccagagtgtgacgtgaaggcccaaagtgtctcgcagataggcttggacctgtgcttcaaagatggccatgaggggaggcgcagagaaggcgcttccctggagggacaaacagaccggtgcgttggcgtcccgtccgccgccaatgaattggatgacagcggccagattcgcgcagaccagacgggctgctcgttccagggcggcctgagcaacaaccagggccacctctcggtcctctggctcccggcagaaatgagccagggtccctcctgcctggggatcggccatgaattgcagcaccgtctccaggtccagttgggtaagagagaggatatcccgactgcacccaaaggaaaggagcttccgttccgcagccttgatcatgaccagacggaagatctcccccagatagtcagtggagaccattttcaaatataggtccagaccaggggcatagcagtctctgtctttgctgtaatccaccaggccaaaggggacgcactgggcctgggagaatcccccggtaaagagggtcagatcccccggaatccccggccagcggagcacaatgctgcctggggcgacaaaacccacatcaatgctgctcccccaagtcacccccaagtaccggccttgccccggattttgcacccccgctgccaaaaggacagcgtctgattcattgatgagggtcataggaggaatggggcagccacggctctgcaattcctcccgcagggaagccagcaccggtttttcagagaaaccgtggatggtcatggagccggggaaacgggaaatggtgccgtcccccttgccgtcatagaccacggggaaggggagacagagggccagcccctgtgcccggtccagaaggggctgcgtcagttccccaatggcatagatcaggtcctcccaaggcgcaggatattcccggccggggataggaaaacgatcctggtccgagaagtgagcctcgccgtgggagaaggtgaccagagaaacgcggatttcctgatcgtccagttcggcgacagcgataggtttgttttcagtgagggtcccaaaaggcggcaagaaggtggggaacatcgggatggaagcgaccccgccatagagagagatccgcatttgagagagaaaaagttgggttagggtagacccatccagcgtatctggggtcatgctgttggcccgaagaaggttggtcaattgttgctggacagctgcattcatagaaaagcctcctcaggggtgggaagatgaaagcttcccgtgaaaatatcaatagataaggatagtataccatgttttcccgaaagataaagagcaaaagacaaaaaaagagaccggaaaaacccggtctcttttttatagattcctcctatgttggaagaattatttgtacatagccttgtgatacagggcctcaacatccttcacggtggtgattctggggttaaccatgacgttgccgctcttcatggcgtcaacagccatctgaggaatcttgtcctcggtcacacccacgtcggccaggcaagcggggatgcccaggtcattgttcagctgacgcagagcgtcgcagagcatctggggcacgaagtcggggccggcttccttaccagtgatgtactgataaatgttggcatagcgctcgtcagcagccagagcgttgaactcgaagatggtgggcatcagaacggcgttggccacaccgtgtgcaacatggaagaaagcggacacggggtgagacatagcgtggatgtcacccagacggttgttggcgaaagcgataccggcaaaggtggagcccagcatcatggcacaggcagcatcgggatcgttgcggcgtgcgacgaacttgcggatgttgccgccgatgagctccatagccttctcacccattgccatggcgaaggggttggcatcggtgttgatgtaggattccatggcgtggatcagagcgtcaacgccgcaggcagcagccacggaagcgggagcggtcatgatgagctcgggatccagaacggcataggtgggagaaatctcggggcccaggacggacagcttgtagttacgagcttcgtcggtgataacagcggccacggtgacctcggagccggtaccagcggtggtgggcacagcgatcagggtgtcgatggggccgggcaccttgccgacgccttcatagtcaccgatggtgccgccgaacttagcaacaacgcccacagccttggcaacgtccatgggggagccgccgcccagagcgatgatggcggtgcagccagcagccttgtactgtgcggcacactcatccacgatggtggtggtggggttgggcagaacatccaggtactcgctgtacttcaggttggcacccttgatgatctcacggactttgtccacaacaccgatggcttccaggccacggtcggagatcagcataacattgtcggaaccggcagctttcaggaagtcaggcagcttcttcagcgcgcccataccgaactggcagttctgagggatgatgaaaccaaaatctttaatcatagggaatcgcatcctttccaagtaactcaaatgtgtttatacggtttaaccacaaagaatggctaaactgttgacagctttagtataccattgataaagggtgctggcaagttgttagccgatgaaaatatgcaacaagaatagaaagcattttttgggcacaatgtatacttgacaaaaagaataaaggaaaagaattggagaaaagatgctatccccgtcgttttgcaaaaaagtgtccagatgaacagagggataacagcaaaaaaactctgtccgcttgccttgagaagggacagagaagaaaaaagcgcacacagcgcacaattttagaaagccccgctctggccgtggggacccaattaaaacctgcacgagatggcaggtgggttgcctccgcggtgcttcgttgcttccaacttccagccgaggctgggaggcctgcagttcacacagcgagtgagcgtcccgtttcaaaaatgtgggtttaaaagggtccagttccacgcaccgagcagggcgtccttgctccatgataacaacaactgatgcagagaaagggagttattccggggcctcttcctcttcggcgaagagctctttcatgaattcgttgtagaccgcgtcaatctcttcgtcactgtccagagtggaaaggatttcctctccgttttcctggattgctttgagaatcaccaggcccatttcttcctcgttctgggcttcttccccatcctggacagcggggaaaaaggccagataggtctgcccctgaaactcgatggtgtccagatgctccagttcgaactcgttgccttcctcgtcggttacggtgataaaatttgcgccgtattcttcgctcatgaaatattctcctttgcttatctgcctgtattgtaccttgtgaaaatgaaaaaagcaagcccaaaggggagaaaagtttcagtaaagtttcctcaaaaacctgccctctcacggatagacaaattggaatcctgtggtataatacataaaataggcacggttcacaatcattgcacgacagaaacagacgcctttttcggaagtgcgtcgcgcttttcatcataacgatcgaattcggaggtgtcaatttggactatcatcgtgagacacgcccctcccgtgaccggcgggatcctggagatccccgcaatcggcaggggaaaaatgccaaacgaaaacgaaaaaagcatgggaagacctttaaggttgtcatgaccatcgtgctgatttttgtcatcacggctgccatgctgctctgtatggcggcggcctatattaagaatgtgattattcccaatgcgggcctggagatgacggcttatgacttaaacctgaccagtacgattctatgtaaagacccggaaacaggtgcctataaagtgacccaaaacctttatggagctgagaaccgtgtttgggtggacatcgaggagattcccaagaatcttcagaatgccgccgtggccattgaggacaagcgtttttataagcacaacggcgtggactgggtccggacggcgaaggccgtatccttgatgtttactggcaaggacatccagggcgggtccaccctcacccagcagctgattaaaaacatgaccagcgacaatgaggtgaccgtcaagcgaaagatcatggagattttccgcgccttggagtttgagaaaaagtacagcaaggaagatattttggaggcgtacctcaattacatttatctggggcagggatgcaacggggtgtataccgcctcgtacacctattttggcaagcacgtttcggagctttctctggcggaatgtgccagcctgatcgggattaccaacaacccctcgaagtatgatcccctgggtaccctggaagtgaaagatgaggagacaggagaggttaagacctcccgtgacttcaacaaagagcgccaggagaccattctgaacgctatgctggagcagaagtatatcacccaagaggagtacgatgctgccgtggcggaggagcttgtcttcaacgaggatgggcaaaacgaaggagaggtacagaccaacagcaccatctattcctggtatgaggaccaggtcatcaacgacgtgattgaggacctaatggagacttataactggtctgagcagtatgccaaagacaaggtgttctccggcggtttggaaatctattcctgtatgaagcccgaggtccaggctgcggtggacaaggtctatcaggaccaaaacaacctgaatgtgacctccagcagcggacaaaagctccaatcggccatcaccattgtggacaatgagaccggtgaggtggtggccatggccggcggcatgggagaaaaaaccgccagccggagcctgaaccgggccaccagcagtaagcgtccgccgggctcctccattaagcccctggcggtttatgccccggccattgagttggggaaggtgacccctgccaccatggtggaggatagcccttatgggaaagttgacgggcgagattggcctgtgaacgccactggcgtgtaccaaggcaacgtctccgtggcgaaggcggtgcaggagtctatcaacacggtggccgtcaaggtgctggatatggtggggacagagaccagctttaacttcatgcaggataagttccacattaagctcatcaagtccctgaccaaggggggaacgacctatacagatattggcctggcgcagctggcactgggaggcctgacggaaggtgtcagcacctacgagatggcagcggcatattcggtattcccccgccagggcacttacgttgagccgaaaacctataccatggtcatcgacaacaacaaacaagtgctgctgcgcaacgagtccgaaccagaaaaggatgtcctttcccagcgcaccacctattatatgacagagatgctgcagcgggttgtgaccggcggcagcggcgccaccggcaaggcagccaactttactggtcaggatattgcaggcaagacgggtacgaccacatcccggaaggacctgtggtttgtgggatatacgccctattatactgctgcggtctggacgggctatgaccggcaggaacgtttgtccagccacttgggcaatccctccacaacattgtggcggcaggtgatgtctgaggttcacaagacgctgccctataaggagtttgcacagccggatgcctcgagtctgaagacggtgacctattgtctgtccagcggcatgctgcccggccccgcctgcggcggccatttggcgacgggtacgttcttcgcagaagatgtgcctacgggaacctgtacctatcataaggttcagaagcctgcggacacaaatggaagcaatggttccgatgggaacggctccagcacagatcccggcgacaatacaacagatcccggaaccgatcccggcgggggcacgacagatcccggcggcggcaccacaccggaaacaccgccggcggaggggggcggaacagagaccacgccccggcgccgacgcatggcagcggccggctgatctgcggaaagagagcggaccctgatgtttcagggtccgcttttgcttgatctgactgaaatcaggagaaaggaaggagaaaaactgtcgtccagacaaatactttgggttgccatacacggacagatgtgatagaatatccctcgcacgaatcaaaatgacgatcgaatgggaacggaggcgaatcatgtcaaaggcgccaaactattacattgtagacgcggaggctcttccggaaattttccgcaaagtggtggatgcccggcgaatgctggataccggagaagctgagacggtgaaccaagcggttcagctggccgggatcagccgcagcgccttctataagtataaagacgcggtccggccctttcaggatatgctccatggccggatcgtcaccttccagatcatgctgaaggatgagcctggaatcctctcccatgtgctcaatctgttcgcggggtccggggccaacattttaaccatcaatcagggcatccccatcaacggatgcgcggtggtgacggtcaacgcagagacctctggcctggaagggagcctgcaggagcttctggcccgcctcaacggggcggaaggcgtcctccggggtgagattttggcggggtgaccgccggcagcatgggatgatcagatcaaaaaaggatgggatagaaaatatggtaaacgtagcaattttaggcttcggcgtggtgggttccggtgtagcggaagtgcttactggcaatggcgccgggatcagcaagaaagcggatgaattgatctcattaaaatatgtactggatgtgcgggattttccggacagcccttttgccgcttgctttgtcaaggatttctctgtcattgagcaggatcctgaggtcaatgtggtggtggagaccattggcggtgtgggcgctgccctggattttacagaacgggcattaaaagcgggaaaaagcgtcgttacatccaataaagagttggtggccacccacggacgccgcctgctggaactggcggcagagcatcaggcggtctatctgtttgaagccagtgttggaggaggtattccgatcctgcgccccttgagtgagtgcatggcagccaacgatattttggaaatctgcggcattctcaacggcacggccaactacattttcacccggatggtgcaggatggcattccctttgcgcaggctctcaagggggcgcaggccaatggctatgcagagcagaatcccgctgctgatgtggaggggcaggatacctgtcgcaagctctgtattctatcttccatcgcttttggctggcacctgctgccggaacaagtgcctaccacaggtattaccagcattaccctggctgacgaggcctatgcagatgcctgccagcggcggattaaacttttgggccgggccattgccagggaggatggtaccgtctgtgcctatgtggagccccattttatcagtctgcaaaatcccctggccggtgtggacgatgtctttaacgccattttggtcaaaggggatgccacgggagatgtgatgttctatggacggggagcgggaaaacttcccaccgccagcgccgtggtggccgacgtcattgccgctgcccgtcagctggagcgagccagctaccggccttggcagcccaaccgcccgtccagcgtggtctcttctgaccagctggccagccagtggtatgtccgattggcggagggcacctgttctggagagcgtctgaccatttccggcgggaaggaaggggagagcggctggatcacgcctgcaatgacccgtccacagctggaccagatgttggaaggtaagcaggtgctggcagtgattcgggtgctggattgacctttttcgtccctgcaacataagatgaagggacaacatattaaaataaaaacaatctcgttccccctgacgcggcggtccgtgtcgggtgacaggaggtatgtgagatgggactgattgtacaaaaatttggcggcacctccgtggccaatgcggagcggttgcgcaatgtggcgcagatcattgccgacacctatcgccagggcaaccgggtggtggctgtgctatccgcgcaaggtgacaccacagatgacctgattgagaaggcacgggagattaaccccaatgcctcccggcgggagatggatatgcttttgtccacaggggagcagatttcctgcgccctctgcgccatggccattgagacgatgggactgccggtggtttctctgactggctggcaggcgggcattcagaccaacagcagttacagcagtgcgcggatcaagaagatcaatgtggagcgtgtccagtctgaactggaccggagccactccattgtcattgtgacgggcttccaagggatcaacaagtatggagatgtgaccaccttgggccgagggggatcggatacctccgctgtggcattggccgcggcgctgaaggcggacctgtgccagatttacaccgacgtggatgggatttacactgcggacccccggcatgtgactggggcgcggaagttagaggagatcacctttgacgagatgctggaactggccagcttgggtgcgcaggtgctccataaccgttctgtggaactggcaaaaaagtatcaggtgaatttggaagtgctgtccagctttgagaaaaagccgggcacgaaagtcaaggaggttgcgaagcaaatggaaaagacccagatcagtggtgtggcaaaagacaagaacgtagcccgtttggcgctggtgggggtggaagataagcccggaatcgcctacaaggtcttctccctgctggggcagcagaatatcaatgttgacatcatcctgcagtccatcggacggaatgaaacccaggatatcagctttaccgtccgccgcagtgacgtggatcaggcagttgccctgctggaggaacacaaggccagcctggcatttgaccacatcgacgtggataagagtgtggtcaaggtgtccattgtgggggccggtatggtggacaatgccggtgtagcggctaaaatgtttggtgcgttgtacgatgcggatattaatatccacatgatttccaccagtgagattaaagtttccgtcctgctggatgaggtggatgccaatcatgcagtgcaggcaattcacgacaagttctttggcgaataacgttggaaatggaagaaatttggggagccgggcagcagaaccggctcccggcaaagctcccctgtcatatttaggcgaaacaaccaaattccagggagaagcaggaaaaaattttttttgatgcgatactttcccggcttgtaatttgaaaaaacctttgttataatacacaccgtaatgtactggaagggcgtaaatttgtactcttccggcgaaacgtctgccaccggaggcgacttcgggtcggcgtttatctggcagagcggtttggaattttttccggtggaaacggggattgtcatgcgatgattctgaggtttcacgggggagagagcggccggccatgccaaaataaaacaaatcaaaaatagggggaaatcagaaatgaacatacttgtttgcattaaacaagtgccggacacgaccattatcaaaattgatcccgagaccaacaccctgatgcgtgaaggcgttcccgccattgtcagccccttcgatgcttatgcactcgaagctgctgcccgtattaaggacaaggataaggataccaagatcgtcgtcctgtccatgggtcccgagcaggctctggccgctctgaaggagtgcctgtctgtcggcggcgacaaggcttatctggtctctgaccgtgcttgcggcggttccgataccctggccactggttacattctgtccaaggctaaggagaagattgaggagctggaaggcatcaagttcgatatgctcatgttcggtaagcaggctatcgacggcgataccgcgcaggttggcccccaggtcgctgaggatctggacattccccaggttacttacgcttgggaagtttggcccaccgaggatggcaagagcgtgcgcgtgaagaaggagctggaggaaggcttcgagattctcgagatggcttgcccctgcgctgtgaccgtgaccaagcctgactatgagccccgcttccccaccatcaagtccaagatggcagccaacaaggctaagatccccgttctgagtgctgctgactgcggcctggacgtggagagatccggcctgaagggttctcccaccaaggttaagaagagcttcactcctcctcgtaaggaaggcggcctgaagatcaaggaagagactccggaagagtccgcaaagaagctgtacgacctgctcaaggacaagggcattatctaatagaggggaggacaaagaacaatgttacagacaagctatgaagcaaagaccaaggacgtatgggtctttattgaaaccaaagatggtaaggcaagaaatgtcggcctggagctgctgaatcccggccgtcgcctggctggcatccagggcggcaaggcggttgctctggtcatcggccacaactgcgaggacgctgtgaaggaagccattgcacacggtgctgacaaggttcttctggtggacaacgaggtgtatggccactacagcaccgacgcttacaccgccgctatcgtacactgcgttgaggcggactgccccaccaccattctgatgggtgcatcccccctgggccgtgacctgggcccccgtgtggctggccgtctgaagaccggtctgaccgctgactgtacttctctggacatcgacgaggccaccggcaaggttgcttggacccgtcccgcgttcggcggcaacctgatggccaccattctgtgccccttcactttcccccagatcggcacctgccgtcctggcgtgaataagaagctggaggctgattactcccgcaccgctgaggtggagaaggttgattttgtcttccccgctgataagatccgcattaagctgatcgagaccatcgctgaggaaggcgagaaggtagacctggaaggcgctgagatcatcgtctccggcggccgtggcctgggcggtcccgagggcttcgagaccaccattaagcctctggctgacgcactgggcggcgtggttggttcttcccgtgccgctgttgacgctggctggattccccactcccatcaggttggccagaccggtaagaccgttggccccaagctgtatgtcgcctgcggtatctccggcgcaatccagcacctggctggcatgggctcctctgacttcatcgtctgcatcaacaaggaccccgaggctcccatcttcggcgtggctgacctgggtgttatcggcaacctgtatgatgtctgccctgcactgaccaagctgattctggcggacaaggactaatttgttagcaaaaaaaatttaaatataccttgtggggcgctctcctttcggagggcgtcctccaggggaaagaaaggaaaaattatggatttcaaactgaacgagatggagcaggaaattctcgacatgctccacgacttctgcctgaaggaagtcaagcccatcgctgctgaactggacgagaaggaagagttcacccagaacgcccgcgagaagctggctgaaatgggcatgctgggtacttacatccccgaggagtacggcggcgctggtctgtcctacctgacctacatcgtctgctgcgaggagctggctaagtactgcgcttccacctccatcatgttctccgttcacggttctctgtgctcctggcccatcctggagttcggtaccgaggagcagaagcagaagtacctggttcccctggcacagggcgagaagctgggtgctatgggtctgaccgagcccggcgctggcaccgatgccaacggcgttcgcaccaccgctgtgctgaagggtgacaagtacatcctgaatggcaccaagatcttcatcaccaacggctattatgctgacacctatgtggtctttgcccgtaccaaccccgatctgagcgtgggccacaagggtctgtccgctttcatcgtggagaagggcttcaagggcttcagcttcggcaccaaggagaagaagatgggtatccgtgcttctgctacctatgagctggtcttcgatgactgcgaggtccccgctgagaacctgctgggcaaggaaggcgaaggcttcaagatcgctatgatgctgctggacggcggccgtatcggtgttgctgcacaggctctgggtattgcacagggcgccattgacgagtgcattccttacctgaagaaccgcaagcagttcggcaagcctctgtctgctttccagaacacccagttcgagctggctgatatgcagaccaaggtggacgctgctcgtctgctgatctatcgtgctgctatggccaagcagaaccacgagccttacagccacctggctgctatgggcaagatgttcgctgctgatgtggcttctgacgtgacccgtcgtgttgttcagctggtcggcggctgcggctacacccgtgagtatcccttcgagagaatgatgcgtgatgctaagatcaccgagatctatgagggtaccaccgaagttcagaagatggtcgtttccggctggatgctgaagtaatcaaacgattctttcgatgtgatcgtgaaagagagggcagtggttcgccactgccctcttttttaagagaggtggctcaaatgacaattcatcccattcgttttacgggcaggccgacgggtgagacagaccggctgccgcaggagattgcatgctatgatttattggatcagctggggatctcttatgaccgtgtggatcatacagcggcccacaccattgcggactgtgctgtgatcgagaaggttttgggtgctccgatttgtaagaatctggtgctctgcaaccgccagaagacctctttttatctccttttgatggaaggggaaaagcctttccgtactaaggagctgtcgaagcaaattggctcagcccggctttcttttgcctctccagaggatatggaagcgtatctgcatgtaacccctggttctgccaccattttggcacttatgtttgaccggggtcatcgggtgcagcttattttggatcgtcctgttgcagagtgggtgcgaattggatgccatccctgtatcaatacctctacgctgaacctctctatggcggagattcgaaataagtttctgccctatttgggtgtggagccaattttggtggagctcccggaggagcgggaggaggtccactgagtaggcggacggacccatactgccggcatgttccggcggcgtgggtctttttgtctgtacagtgtaaactatcggcggagaggagacgaccatggtacgagtttcaaatataatcttgcctccagaaggagatttcttactattgaagaagaaggccgcccgaattttaggggttcctatgggtaagattcatcgctgtgttcctgtgcgccagtccattgacgccagaaagaagtcggatgttcattatgtgatgacggtggatgtggccctttctggggaggccgatgtggtggcgcgggtaaagagcagtcaggtacgccttgccgaggagggacccgcctacacttttcccgttgtcacccgaacctcccagaagcctcctgtggtggtgggcagcggtccggcagggctgctggccgcactctgcttggcgcgggcaggcctacggccgattgtcttagagcgcggacaagcgttggaacagcgtgtgaaggatgtggaggcattttggaggggcggggatttgaatcccgcctccaatgttcagtttggagaggggggcgcagggactttttccgatggaaaattgaccacggggacccacgatccccgccggtcctatgtcatgcgcaccttcgtagaggcaggggcaccggaggatattctctggcagcataagcctcatgtggggaccgatctgcttcggaatgttgtcaggcatcttcgggaagagattcagaatctgggcggagaagtgcgctttgggcactgctttagcggcctcactgtgatcgggggccatttagagggaatcactgtggcagaagaacagggaaagtatgatctgccctgcgatgcactggttttggcaccaggtcactctgcccgggatacctttcaaatgttgcgggaggctggcgccgccatggagcagaagccctttgccattggcgtgcggatcgagcatccgcaggcccgcatcagtcaggcgcagtttggggagagctgggaaaagctgccccctgcggattacaaattggtctgccatctgcccaacggccggtctgcctataccttttgcgtctgccccgggggccagattgtggcggctgcttcggaaccggggggaatcgtgaccaacggcatgagcaaccgggctcgggatggtgaatttatcaacggaggcttcctggttggggttggccccagtgattttggaagcgcggaccctttggctggcgttgcgtttcaggagatttgggagagaaaggcttatcagtttgggcggcccggctatgaagcaccggcgcagcgtgtgggggatttcctgcgcggattgcccacccccaagggcctggcccatcggagcacctatcgtccggatgttttctttggggatctgcgggagaccctgcccgattatgttgcccataccctggcgctggcgcttcccacactggatcggaaactccatggctttgccgcgccagatgctttggtggtgggggtggagacccgctcctcctccccggtccgtattctgcgtgacaagaccctgcagtccaatcttcgcgggctgtacccctgtggagagggggcggggtacgctggtggcattgtatctgctgctgtggatggagtccgggtggcggaggcagtggcccatcctctgctttgcggggaaatgcctgaaaaatagagggaattccgcttctttttcaaagagacggttgcaatcttatcctaaaacagtgtataataaaacattattgacagagactgcatgaccggcagcggacagaggttcccgcagggatatacactgcggggctgttttgtgcacacccaagggaaagcgggggacgcgggggacgaccggcgtcttgcggttgcggtcaacgggtttggaagattcttgtaaggagtgaataccatggcggaagagaccatgagcaccaattttattcatagcatcattgaagaggagctggagcccggcgggcgctgtgcggggaaacaggtgcacacccggttcccgccagagcccaacggctacctccatatcggacattgcaaggcgctgaccattgatttcggtacggcggaaaagtaccacggcatctgcaatctgcgtatggatgacaccaacccggccaaggaggacacagagtatgtggatgccatccaagaggatatccactggctgggctttgactggggagaccgtttctattatggttctgattattttgagcagacctacgaattggcggaggacttgatccagaggggactggcctatgtttgtgaacttacgccggagcagttccgggcttatcgaggggataccactaccccggcacagagcccttggcgggaccgtccggtggaagagagcctggaactgtttcgacggatgaaggcgggcgagttcccggagggaaagtatacactccgggcgaagattgacttggcctcgggcaattttaatatgcgggacccggtgctctaccgaatccgctatattgagcaccatcggcaggggacaaaatggtgtattttccccatgtatgactttgcccaccccattcaagatgccttggaggggattacgcactctctgtgttcgttggagtatgaaaatcaccgtcccctttacgactgggtagtggagcactgtgatctccccagcaagccccggcagattgaattcgcccgtttggggatcaattatacggtcatgtccaaacggaagctgcgggctttggtagaagagggacgggtctcgggatgggacgatccccgcatgcccaccctctgtggcctgcgccgccgcggatacacccccagatccattcggaatttttgtgagcgcattggggtgtctaaggtggactccaccgtggactgggcgtttctggagtcctgcctgcgggaggacctgaacgagaccgcccagcgggtgatggcggttcttcgcccggtaaagctcaccattaccaattacccggaggggcagcgggagactgtcaccgtggagaacaaccccgtagacccggaggcgggcgtgcgggaagtgcctttttcccgcacactctacattgaggcggacgactttttggaggaaccaattcccaaatacaaacgtcttactcctggtggacaggagtgccgcctgaaaggcgcctatctaatccgctgcacaggctgcatgaagaatgcggcaggggaagtgattgaggttctctgcgagtatgatcccgcctcaaagggcggcaatcccgccgatgggcggaaggtcaagggagcgaccatccactgggtggaagcggagaccgctgcggatgcggaggtacgtctgtacgacgcactgtttaccgaccccgctcccgacggcccagaaaaaaatttcctggatttcttaaacccggagagccttcagatcttgacccattgcaaagtggaacaggggctggcccaagcccccatgccggaggctgggaagacagcgaaggcctatcagtttatgcgtcaggggtatttttgtctggacagtcaggatgcctctccaacgcacttggtgttcaaccggagcgtttctctgaaggatagttttaagaaaaagtaaaatcggaccctggaaagctggaaattttggggaaagcagggaggagaaaaccccttctctaccttgcgaaaccccacgttttctggtacaatagcaaggatcatgtaaggatgtccctgtcaggggaggtccgttcctggaattgggagtgttttcaccgtatgaagaaaaacgagataaaaaccggaagaaacaagccgccggaagtgcgtacccgagaacagattgaggatcgtgcgtttaaccggatgctcctctggctggccactgccgcagtggttgaggtggtgatggtactcatcaatcgcttctatgttcacacccgtgtcagtgaattgggaattaagatgccgctgtacaaggtgttgacggtctttcccattgcgggtgctgtgctttttgtgctgttcctggtctgggctgtgaaggttcggaacggagacagcggaaaagacggaaccctccaggcggctgtggcctgcggatttctgtgtatgggcataggcggccttttgatgcggaatttggagaccacggcggcccccatggtactggcggtggtgcctggcctgggtgtgctgatgatggtgttctatctatatcaaaaggaattttttggctgtgccgtgataggcggcatggggctgctgggcttttgggtgtatcggacatttctcagcggcgcggtgtactacggctatttggccctcaccctggtaatcgcggcagtgggggtggcattggccctcaagctgaaacagaaggatggtgtatggacgattcggggcaaggagattgtggttctccagcctggcgcggcctatctgccgtattatttgacggcggcggtgacagccattctccttttggcgccgctggcgctgggggctgctgtggcttactacgcgatgtggattatggctgcgtggctgtttatcctggcggtttatttcacctcaaaattgatgtaaaaacaaagacaggccccatcgaataagattcgatggggcctgttttatttaattatgggatttcccaaccgatgagaagacagcccgtttccacctgaatggtcacgggatttccttggaaatggttgctcacaccgatgggaaagaaaggagagacggggacacggtccaaagggtattgggcgccgtgaatcgaaaccccctgagcctcctgccccaagcagaacagggagaaaatcccttctttccgggcggggagggtgagggaaccattgcggagggcagtgaagagatagctttttccgtagagatagcccgttgcccccgcctgggccaaaaaccccaaggcctgaaggttggccagggtgtgatccggacggccgccggtaccgccgtaaaggtggaatgtgcggtatccctctttcaggccgtatttaatggccagcattgtgtcggtgtcgtccttttccacagggaaggtgtgaatgggaatccccttggggaggtcattcagagagtcgaaatcgcccagcagcaagtcgggctgcagcccggcggcttgacagtggcggtaacctccgtcagcggcgaaaacaacatcccctggggctggggagactggcagaccaaagaaagggccggcaccaaagataaagcaggcgggaggagacataaaaatcagctcttttccaaaggatttttggggatggttccatcataccatgttcttccagccttgaccagaggggaattttttgttagactgaaccggcagaattttagcatgaggagggcggagtgatgatccaaggggcaatttttgatgcggatggcaccctgctggattccatgggaatgtgggatacggtgggggagcgttacctggcctccctgggggtgacagcccgtccgggtcttcggcagattctttttcccctcagcttgtcccagtgcgcggcttacctgcgggagagctatggtctgtccctgtcagtggatgccattgaggtgggcatcaatggttccatccgctcattttattgtgagcaggtggtgtgcaagaccggcgcaaaggagtttttgcaggccctccgggagaggggaatccccgctgttttggccactgccacagaccgggcggtgatgatggaggggctccggcggacaggcctgctgccgttgttggacgcagtgtacacctgtggtgagttgggagtggataaacggacccccgccctgtttcaccatgcccgggcacaaatggggactgccatagaagccacttgggtgtttgaggacgctgtccatgcggcccagaccgcctatcaggcgggctatcgggtggccggtgtggccgatccatacagcgaccaggaggcattgaaggccacctgtcattggtatcttactgactggacagattttgctgggttctatcagcaggcataaaacgaccgcacgtctgagaggggttctcagacgtgcggttatttttagaagggagaccacagattaagttttggggatcatttggatattcaggtcaacattaccttcaatgccggggaccttaccagtgctggaatactgccacatatcaaagtggtagtagaaggttggcgttttattgtactgcgccagccaaagtggaaagtcaaccagcttggacagatcatagtggagatagaaataggtcaaattggagtataccatactgtcatacccatttgcctccactgcctgacagaaggcaacggcgcacttggtcagcatctcgtcggagagtccttccgtgcgaggatgcaggctactgtcatagggttcccagtcaaacacaatgggataggtgatggagtagtcctgaagcaggtccatacagaattgggcttcctccacggcctctgcctcattgatggcctgggagaagaagtagacgccgacttcaattccattttccaaagcgccttggatgttctgatagaagtagctgtctcttacaatggcgccggtgccgtatccccggtaacccagacgcagcatagcaaattcaaccccggcgtctttgactgccgcccaatcaatgctgccctggtaacgggagacatcaatgccgatcttgctggtgtatttgtcgctgtcgtacgtcaggaaaccattttcgttgacctggaacagagaggaatcataggtccgtttgggcatctcctccaccacatagacttttttcccgccaaagtaaaagtagtcaccggtgggttcctcaggctcttccggttcttccgggaggtcagggggattgtctggttcttccggctcttcgggggtttgatttttgagttcataaacacgccaaattaccgtggtaatctctgcccgggtgatgtggtcctggggctggaagagaagctccccattgacctgattcccctggaagatgccgtggtcgtagagaatcagggcggaaagatcctcggtgtccgcaaatggagagggatcatgggaggtgcgggagagatccaggacattgacgatgatctctgcgatttgaagacggttgatggggtcattcagccccaagctgaggccagaggggagaaacccgttctcctgggccagctgataaaatccgctggcccaatgggaaccggtgggtatttgatcgccatagccggcggacataaggaccagcttcagggcttctcccagcgtcacttgcccctggggggagaaggtggtgggggtggtgccgtggacaatgtcattgtcgtagaggtctttgacataagtatagtaccagtcatctggtgccacgtcggtaaagttcatttcacccgctgcggagaccggcgcggccagcgaaaaaaccaaggccacaagcaggaagagggaaaaaattctctgtttctgtttcattggaaaaatacctcatcgtttctttctcaggaaaaatggtgtgggaaaagtttgggacgcagacggtaaacgtacaggtcaccgatccgtcccagcagaacgtcgtacagcaaaaaagtcacattacccagcagaagcattccagccagaaccaggcctgtccaggtctgtgcctctgcctggaggtcgggcatgacaaacacaaacagcaggagcgcgaaaatgactgccaaggccaagttgaagaggagcagcttcagtatgatccgccaaggcttacgacgcaggtgctggagcttgggacggagcaggggataccagccaaacagcaggacgaagaacaacgcggcctccttgttgggggagagaatcaggcttagcaaagccacggccaggtagagcagagcgccggtgcgaaagccaaattcccagacaaccgggagcagaaggacccctgccagagccggacagatgtaagtggttgtgggaatcatggttcccaagagcatcacggcaatcatgagggcggccaaaacgccgcagaaagccacccggaaactgagtcggttacgcataagaaatcacctccaaggaaacagattaggatgacggatcatcatcagacgggggattgtctgggggggaatcctgggacggggagagggggtggcgcaggcgccgccgaagccgggcccacagactgtcctccccccggaacagaggatgaaactcaatgacagggggcggcagataggagatggagcccttctcgtcaatcccggacacatggacgtattcctgggtctccagaggaagggactttttgcggagccgggcattgatgaactcccggagcagatagtagaacgaggcgaacaaaggaacccccaggagcatcccccaaaatcccatcaagtggttaaacagcagcagggcaaacaggacccagaacgcggaaagccctgtggaatcccccagaatcttgggaccaatgatattgccatccacttgctgtaaaataatgacaaagacaatgaaaatgagacattttccagggtcggtgagcagaaggataaaagcggagggaatggcgccaaagaaaggcccaaagacaggaatgatgttggtaatgcccacaatgacgctgatgagcatggcgtagggcatgtggagaagcgacaggcagatgccgcagataatgccgataatcagggaatccaaaagtttgccggagacaaacccgctgaaaatccgattgatggcccgcaggtgcttcaaaatcacatcacaggtgctccgcttccggcataaggcaaacaatatcttttttccctgtcccacgaactggtcccggctcattagcaggtaaaccattacgataatgccgatgatgaaattcaaaacactcttggccgcggcggccacccgtcctgccaggtccaccagggcggacagagggtcgtcctgaagccatgcgttgaaggcagcggtgattttttcagagacagtggtaatgatggtggtcggctgtccatgggcggtgaggtaatctgaaattcgttgcgaaaaatccgaaaccatgttgggcaggttttggatcaaaggcgggacattgaagaccagctgaggaatgatgaaataggcaaacagcacaatgagtgccaacaggacaaaggtggagaaggcagtggacagagaacgggccgttttctttctcaccttatggtatagaagaaactgctcggaaaaacgggtaagaggatagagaaggtaagccatcacgcagcccaggacaatggcccgcagagaaccaaaaatgccgcggacagtattgcccaatgcgtccagattgagcaggacgcggcagaccagaaaaaccacgaccaggcccaacaagaccatgccgctataaaacaagatctttttgatgggaaccttcaacagttcgccctcccattcctgtgccaattccttccgaccaaaaacggttggagatgcaaaaaataaattggaacatatattttatagtatagcaaagctggcggttgcttgcaagcggaaggaaacaattgggaaaatttcttcggggaaatcagcgcagggacgggaaagcaagcgaaaacagggaaaaataatggttgcggcgtttctatgcctatgatacaattatcttaccagttcagaaatgaaattcgttggatttgatggaagagaaaggaggagtgagagcttgaattaccagatcctatggctggtgctgctcatcgcatttgcgggcattgaggggatcacggcggggttggtttccatttggttctgcgcgggcagcttggtggcgctcattgccacttggctgggggcgtcccttccggtgcagattggtctgttcgcggtggtctctgtggctgccatggcgctcatccgtcccatggcccgaaaatggctgcatcccaagatggaaaagaccaacgcggaccgtattctgggccaggagggcgtggtggtggaatccatagacaacctcagcgcctccggacaagtgaagatcgacggcgccgtctggacggcccgttctgcgggagacgagatcattccagcgggaacacgcatccaggtggagcgaattgaaggggtcaaagccattgtcatccgaaaagaaacctaacgagaagagagaagctgccgcttatgtcatgagagaaaggaaaaggtacttgcatggaaacaaaaattgttttgattgttctcattgtggtcattctggtcatcctggcccgatgcgtccgggtggtccagcagtccaaagcctacgtgattgaacgtttgggcgcgtttcacacagtctggagtgtggggcttcatttcaaggttcccttcattgaccgggttctacgggtggtctccctgaaggaacaggtggctgactttccgccccagcctgtgattaccaaggacaacgtgaccatgcagattgacactgttttgtactatcagattacagacccgaaactctttgcctatggggtggagaaccccatgaacgccattgagaacctcactgccaccacactgcggaatatcatcggtgagctggagctggaccagtctctgacctcccgggatattatcaatgcccggatgcgctcgatcctggacgaggccacggacccctggggcattaaggtcaaccgggtggagctgaaaaatatcctgccccccaaggatattcaaaacgccatggaaaagcagatgcgggcggaacgggagcgccgggaacagatcctccaggcagaggggcagaagcagagccagatcctggtggcagaaggagagaaggaatcccgcattctccgggcggacggcgagaagcaggctcggatcatggaggccgaagccgaggcggccgccatccttcgggtgaatgaggccatggccaactccctgaagcttcttaacgagtccaaccccacggacccggtcattcgaattaaggcgctggaggcgttccaagcggctgccaacggcaaagccacaaagattatcattccctcggaaattcaaggcctggccggtctggcggaagggattgtggagacagtcagacgtcccgacacaggcagggccgcgcctggtccaggtggtcccaaagcataattcacgttgtatgcaacaataaaaacctatgaaaaaatccccctgtcacctacggtgacagggggattcaatattttaggcggattacagggtcagagagggggcggtgtaggtccgggcggccatctcagcgtccagcgcatacagccctttcacatcagaggcgaaaaggtcgaaacgccccagcaggtcgttggcgttcttctcttcctcgccctgctcctttacaaaccaatccaggaactgcagggtgcggaaatcattggccttcatggcctcagcatagatggcgttgatgagggaggtgacatactcctcgtggaccagagaggcggccagaggatcgcggaaggactcatataccttgtccggggcgtcgatggcgcccagcttggggcactcaccgttgttctggagataggtcaggaagagcatagcgtggtctctctcctcctgagcctgaatcttaaaccagttaccgaacccatccaggttcttggagtagtagtaattggacatatccaggtacaggtaggcggaataaaattccttgttgatctgctgctctaacagcgcggcgacttctttcttcagcataacaaacatcctttctgaaatatcattcttatcttgtgcggaatcaaagaaaacccttgacaccgtatgggaaaacatagtgattttgtttggtaatcataccatatcttgggcatactgtcaattcccattccgaaggaggtgtggtgtgcggtctcttgacggaagggaagaactgtgccagaatggagaaaaaggaggcgaaaacggtgaaaacagtatggctgccaagcaggcggggggatcggattccgtgccatgataattgggaagggcaatcccgtgtggtgatcgtttgtcacgggtttggaagcagcaaggagagcccgatggtgcaggccctgcatcgagcgctgcccgaacgggggatcggtgtatggagctttgattttccggcccatggagacagtccaatggggcaggagggacttcgggttcccttctgtatggatgatctggagacggtggaagcctggattcgggcaaagtctccccaagtggaggtgtgctattttgcctccagctttggagcttatattaccttgctttccctgtcccgtgccccccgtaaccggccccgggccttcctgcgttcggcggcggtgacaatgccccagctggtggcacgctggctgacgcctcgggccaagaaggacctggagagacggggatactttgtaccagactatgcatacgttcgggagatgcggattacccctgcatttcttcgggacctgtgggaatatgatctgttttcccgttatacgccggagttggcctccctttttatggtccatggagcgctggatgaggtggtgcccgtaaaggatgcccgtcggtttgctgagacttttggggcccagctgcggatctttccccagggagagcatccgctgatgggcaacggggagctggaagcggttttggcctgggcggcggactttttcttgggaaaagaatgaggtaggcaggcaagaaaaagcaagtgttcccttgaaattcgtggggattgcaggtataataaaaatgtattggtctgcattttcacaatgcagagagaaagaaaaccatgttgctccctcacgccatggggagggcagggcgcgcccaaagggcgcggagaaaggaaaggaatgttatgagcaagccagtatacattaccgccgacagcacctgtgacctgacgccggcgttgttggagcggttccatgtgaagaccattcctcttcacattgtcttgggagaggagaactacttagatggggtggattttacccaggaaatgatctatgagcgatatgccaaggacaaggtgcttccccggacagctgcggtgagtccccaggagtttacagacttcttcacgcctttggtagaggcggggtatgaggttgtgtttctgagcatcagctctggcttgtccgggacgtatcagaatgcggtcattgcggcccaagatctgcctggagtctacccggtggactcccttcagctgaccactggtatgggagagatggtgctggcggcatgtgaaatgcgggatgagggaaaagacgcagcctccattgcccaggcgatgcaggaccttattggcagggtcaatgtcagttttgtcattgatacgctggagtacatgtggaaaggtgggcgctgcaccggcgtcaccgcgtttggcgcgaatcttttgaatctaaagccctgtattgagatgcgaaatggaaagctggaggtctgcaagaaataccggggcaacatcgaaaaggtatatgagaagtatattgcggagcgcctgaagggaaaaaaggtggaccccaggtacatttttatcaccacttccaacgcgcccacaccggagctggcagcacggttggagagcgcggttcgcaaagcggtccccgaggcgcaggagatctttttcacccggacgggctgtacggtaacctctcactgcggacctggcaccatgggggttcttttcctggaggcctaaggacagcattcacacttttgttacagttttgttaaacttttgttttttcttgcaatgattgggaagatatgttatactgtacctgtcgatagtggaagcatgcgaaatttaagaaccacgaggtgagtctactatgcagcacatcttatgctcgaaggggcggggaaagcggcttggcgcactggtgatgacgctggtgatggtattctttgccatgacagcggcactgcccgcagcggaggctgtgacccaaaaggacattgacaatttgaagtctcaggcagccagcctgaaggaacaaaagtctgatatccagaagaagctggacaagctgtccaattcgaagaattcggcgctggaccagaagtttttgctggaggagaagatcaatgttctgcgggagcagatcgccctttctgagcagtccatccaggagtatggtaagcagatcgatcagaaggaggaggaattggccgctgccaaagaggaagaggccaagtactacgatgaattctgtgagcgggtccgcagcatggaggagcggggcaacgtgtcctattgggccgttctcttcaatgccaacagcttttcggacctgctggaccagatcaacgccatctctgaagtgatggattacgacaacgaggtcatggacaatctggccgccgcccgtcaggcggtagctgatgccaaggctgagctggaggagagcaaagctgccgaagagagtgcaaaggctgacctggagacacagaaggccgacctggtgaaagagcaggccagcgtggaggcaaccattcaggagattaccagtcagtcctctgtctatgcgcagaagatggacgagctggaggatgattccgccagcgtctccagtcagattgcccaggcggaaaagacctatcaggctcaaatcgcggcccagaagaaggcggaggaagaggctgcccggaaaaaggcagaggaggaagcgaagaagcagcaacagcagcagaatcagaacaactccaattctaactccaactccaaaccttccggtggcggtggcacggccggttccggcggctacctgtggccgttgtcggggtatacccgggtgtcttctccctttggctatcgaaactgtcccttccacgggcaggagctccacggtggctgtgatattcccgccccctatggcacgcccatcaaggcggccaagagcggcgtggtcatcatttccacctacggctcttcctatggcaactatgtgaccattgcccacagtgatggctcccgtacgatgtatgcccatcagtcccagcgggcggtgtccgcaggacagacggtatctcagggtgaggtcattggttacgtaggttccaccggcagttcgaccggaaaccatttgcactttgagctttggctcaacagctccagcagcagccgggtcaaccccgtcgcttactgtttctaagagcaaaccgacaaagagcggaccgcccagtctgggcggtccgcttatatttttggtacgaaaggacatcctatccaagctgtataaagagaaagctccctggacaggaagagacaagggagctgaattttacggtttctccacggataacaccgtgaggaccccgtcctggacggaaaactttacctcaagtcccccgaaggccatgccatagacccgtgtggggtcttcctggtaggaaggacgggggtcttgggccagcacgccccgcagggcggcctgtttctcaggggggacctttttcagaaggtcttctggaaagcggactgtgagatgatatccctcgtagtcagcggtaaagccgctggaggcctggggatgggcatcggtataggggaggtatggcttgatgtcaaaaataggggtcccatccatgagatctgccccggccacgtgaaggacaggacccaaggttgggtgctgtacaattcctttcagccggactgaggacagaccaatggggttgggacggaagggggaacgggtggcgaagacccccattcgggtatttcctcccaggcggggcggacggaccgtcggggaccaatgcggacgaatggcctgggaaaaggaccaaatcagccataggtgggaaaacccctccaagccgcgcagggcatccgggtttcgatattctggctcaaacacgacggtggcttcaaggtcttccaccaggccgctttgccgtggaatcccgaactttgtgggaaaggcaccatgcagagtggcgatgattttcatgggaatggagctttgcataacacaccttcaatcgttgaaaaatgggaaggattcttcccttagtatactaattggcccggcccgatgcaagaaaatagttcaaaaagaggagaaaaccacacccgctgcttgctcccagaaaaaaccatgctataatagggagaaaaaagagattgcctggcctccaagggatttggggccgaaagcaaaggagaaggaataacatgagcaagatcatcaccgcggcccaggcagcggcgcttgtgaaggatggctgtacgctgaccaccacgggcttcaacgggttcggctgcccagaggacctgatcatgtccctggccgctcactatgaccagactggacatcccaaagatgtgacgctggtgaagtgtaccagccaaggggatggacagggccggggggtgagtcatctggcggaacggcctggcatgttcaaggaactcattctctcccacatgggatatgatccaggcctgcggaaactggttcaggaggaacgggtggcctgctttatgctgccgctgggaaacttgatgcagctcttccgggccattgcgggaggccttcccggcgccattgctaccacgggactggggacctttgccgacccgagaaatggcggcggcaaggccaaccaacgggcccgggacaccgggaaagaggtggtttctctggtggaattgggcggcaaagagtgcctgttttatccgtccttccccattgatgtctgctttattcgggcgacctatggggatgaggcgggcaacctgtccattcagaacgaggccatgaatattgagcagttcgaggtggccgctgcggtccacaactccggaggaattgtcattgcccaggttgatcgggtggtcaagcaggggagcatccccgccaaagaggttttgatccacggatttatggtggattacctggtggaaggccggccggagtacagtatgcagagctttgagacagatgcgtttcgtcctgaaattgccggccttgccagcattcccgcggtggggtttgacccgctgcccatgggaccgcggaaaatctgctgccgccgggcggccatggagctgcgtccgaactctctgatcaatttgggcattggcatgccgggcggcattggttctgtggcggaggaggagggactcacggacctatttacgttgtctctggagtgcggtcctctgggagggattccgctgggagggattgactttggcgcgaccatcaatccggaggccatgtaccggatggcggatattctgcagctttacgatggcggcgcactggatatggcagtgctgggctttgccgaggtggaccgcttggggaatgtcaatgcccacagcttcaacaaccgtatggtgggagcggggggctttatcgacatcacgcagaacgtcaaaaagctctgcttcattggaacctttactgcggggaagcaaactgtgaaaatgaagggggatggcctctccattcacacccagggcccccagaaaaagttcttgcaccaggtggaggccattaccttctcaggacgggaggctgtgcgcaaggggcaggaagttctctacatcacagaacgggcggtatttcgtctggagcaggaggggcttaccctggtggagattgcccacggcgtggacctccagcgggatattttggatcagatggagtttaagccggtgatcccggaatatgttcggtacatggacccccgactgtttcgggagggacccatgggcctcactccagagcagatggagatgctggaccctgaatatgaattctggcgggacctccggcccggtggagagggcggagagagccgcggatgagaaggagtcattatgctgcaggaaattgcacccaaacaatatcatgtggagtttgcgttccgtgccccaaaggaaagcggccgctgcgttgtgtttcgtggaatggagattttggagcggctgcaggatggccagttgtttctgcctacctacggggaacttcaggatcgggtggcagagtgctgctatctcttccgcattgatgaggaggagtattatctcacaagcctgcaggaaacggcctctgtgccggagggatatggctggtggagtctccgagagagccgggcaaagaaagcccgggacctgcattttgcagagaccacggcctaccatctctccgtttggtaccgggacaatcgcttctgtggacggtgtgggaaaagaacccagccggaccgcaaggagcgcatgcttcgctgtccgcactgcggaaatttgatttatccgaaaatagccccggccattttggtggcggtgacccatggagacaagctgctgatgacccgttaccaggggagagcctacaagggatatgcgctgatcgcgggatttaccgagatcggggagaccgcggaggacacggtgcgacgggaagtgatggaggaggtggggctccgagtcaaggacattcgttactatggcagccagccctggggcatggactccaatttgctgatgggcttttatgcccgtctggatggggaggctgagattcacatggaccggcaggagctgtcccaagcaggatggtaccgccgggatgagatttcgttgcggccggatgggtacagcctgaccaatcacatgatccaggcctttctgcggggagactggcagtaaaactggataagctgtgggtacagcaaggagacactgtgtaaaacagtgtctccttttgtgtttctgaaggataggaaactatgttccctccggtgcggtaaaaagctgcccttacccaatccactgcccaaacaaccaggaactgggccagatcagcaccagagcggggagaagattgaccgcactgatgtgcttgatctgtgcaatgctcagacccaggaccaaggtgagcagtccgcccacggcgacaaagtcctgaagcatggcttcggtggttagaggcaggataaaccgggcgccatagaagcaggcacacaaaatcaaaaattgcggcaatacaatgagattcattgcccgcccgagggtggtggcgaatagggtagcggcgaagatatccattaccgctttggagagaaggatggtgaagtcgccggagatcccttcgttgatggcaccaaaaatattggttccactggcgcagaatgtgacggtgacaatcaggtagaagcgcatataaacttctttgtcgccgtgaatttggaaccgcagcctctccaaaatccgctgaaagagcgatttgattttgtcatctaaattgacagcttccccgatcagtccgcccagaataaaggccaggatcacagcgggcagagagtgcagctttaccacagaggtgatgccgatggcaatggcagagaggccgaaaattacgttcatcggctggttgatccgcgcggggatgtgatttttgatggcgctgcccaagttggttcccagcaggacgcacaggcagtccaagataattccttttggcaccatagcaattctccttcctgtgggcctgccatttgacaaagcccaaaaagatggagcattttaacatatcgcacccatgtgcgtcaagaaggatcttttatagaggcgaaaatgggagaggcagtcgatcgaaaagggaaagcgggaggcagattgccttattggggggaggagacaagtattttctacaatttgtcccgataaattgatgtggaatcttgcaactttttgtcacagccattataatagactgcgaatcatggccatagcgtggccgagaaaagagaggaaagtaggtgacggcatggagaatgctccgcaatatgtgattgagatgcttcacatcaccaaggagtttccgggaattagggccaatgacgacatcacactccagctgaggaaaggggagatccatgcgctgttgggggaaaacggcgcagggaagtcgacgctgatgtctatcctctttgggatgtatcagccagatgctggagagatccgcaaggatggaaaaccagtgaccatccaaaaccccaacgatgccacggccctgggcattggtatggtgcatcagcattttaagctgattgaagtctttacggtgttggataatattattttgggggcggaggacaccaagctggggttcctgaaaaagaaagaggcgcgccggaaggtgatggatctctcccagcggtatggtttgaaaattgacctggacgccaaggtagaagacattacggtggggatgcagcagagagtggaaatcctgaagatgctctaccgggacaatgaaattctgattttcgacgagcccaccgcagtgctcacgccccaggaaattgatgagctcatgcagattatgaaaagcttagctgcagagggaaagtccattctgtttatttcccataaactgaatgagattatgacggtgtctgaccggattacggttttgcgtaaggggaagtacattggtacggtggagaccaaggacaccgacaaacaggcgctgtccaacatgatggtgggacgtccagttcagctggaggtcaataagtcggaggcgaaaccgggggaggtggttctccaagtaaaagaacttcgggtcccctccaagctgcataagaaagacgcggtgcagggggtcagcttttcggttcgggccggggaaatcgtctgcctggcgggaattgacggcaatggacaaagtgagctgatctatgggctcaccgggctggaaaagtgctctggcggctcgattaccctgtgtggggaagaaatttcccatacctccatccgaaagcggctgaagaacatcagccatattccagaagaccggcacaagcacggcttggtactggattttacgctggagcaaaatatggttctccaacggtttcaggagcctaaattccaaaagtttgggtttattaagcaggacgcggtgcgttcctatgcggaggtcttgattgaccagtacgatgtacgcagcggccaaggtcccattacggtggcccgaagcatgtccggcggcaatcagcagaaggccattattgcccgggaagtggaccgggacaaacccttgattgtggcggtgcagcccacccgcggtctggacgtaggcgccattgagtatatccacagccagctggtggcggagcgggacagagggaaggcgattttgctggtttccctggagttggatgaggtgatgagcctgtccgaccgaattctggtcctctacgaaggggagattgtgggagagctggaccccaagaagaccaatatacaggagctgggcctctatatggccggtgccaagagagcggagaaagggggcggcacggaatgaaaccacggatgtctggactgatgaagaaggaggccacccgatctattttagcctccattctctccatcatcattgggcttgtggtgggctgtgtcattatcttgattgtggggatgaccagcgataccctctctccctccagtgcgtgggatggaatccggctgatttttggcggcctgttcagcacaggccgggatgcagcgggagccttgacctttggatttaaccccactaacatcgggaacatgcttttccgggcgacgcctttgatcctgacaggactctccgtggcggtggctttcaagacgggcctgttcaatatcggcgccccgggacagtatctgatgggcaccatggtgaccctgatgctggcgctgggcatcccttccgaggtggtccctgcgtggctgatttggatcattgcctttgtgggcggctgtttggccggtgcggtttggggagcgatccctgggctcttgaaggcgtttctcaatatcaatgaggtgctggcttgtatcatgaccaactggttggcagccaacctggttacctggatgttcgacatcagcaatttcaaaaacgtggtggagaataccaagtcgggatacatttataagaccaccttcaacggtgtggcaacgcccaagatgggattggatcatctcttccccaattcccaagtcaacatggggattgtcattgccattctcatcgccattctcatgtacatcatcatgagcaaaacgaccctgggctaccagctcaaagcctgcggtgccaaccgtcacgctgcccggtatgccgggattcaggacagacggaatattgtgctgtccatggccattgccggcgcgctggcggcggcgggtgcttccttgtattatctgtctggaaacacggagttttattggtccacctatcagtccctgcccagcacgggattcaatggcattcccgtggcgctgctggcggtgaacaatcccattggggttattttcacaggctgcttcatgtccatgctggatatttcgggactccagctgaccaatttgacggcgtataatgagtatattacagacgttattatcgccaccatcgtctatctgagcgcgttctcgctggtgatcaaaatgttcatcagcggacggaaaaagcggaaagccaaagcctctcttgcggcggcttcagattccggcggagctgaaacgccgcctgcagggacgaagccggagaaaggaggcgagggcgcatgacctttttggtacagcagacactaatctacgcggttcccctgatgattgtggcgttggccggcgtcttcgcggaacgaagcggcatcatcaacctggccctggaaggcatcatgatttttggcgcgtttataggcgtccttttcgtgcggaccatgcaaggatcggaggttttcgcagcggccaaggcagcgggagattacgccaccctgcaggggctggaaatcatggcgatggtggtggcggcgcttctgggggcgattttttctctgcttctgtcgtttgcctccatcaacctgcgggcggaccagaccatcggcggtacggcgctgaacctgatggcgcccgccctggtgctcttcttcatccgtattatcgccaaccagaataccctgcaaatggcggacggagatgctgccagctggttcatgatcaaaaagaccatgtttggatatggacggatggaggacatgggccccttgggggagaccttcatcaaccgaacctatctggccacttacctgtgcatccttcttttccttgttttggcggtcctgctgtataagacccggtttggtctgcggctgcgtgcctgtggtgagaatccccaggcggcggattctttgggcatcaacgtgtacaaaatgcggtatgccggcaccaccatctcgggcgctctggcgggaatggggggctttgtctattccttgaccacggccaactgcaccgccaacggggacgtggctgggtttggcttcttagccctggcggttatgattttcggcaactggaaaccgctgaacattgctggggcctctctcctgttcggcctgtttaagtgtatcgcggccagctattccagcattgatatcaacggggacggggtttacctgttggcggacctgggaatcagcgcccacttctatcggatgctgccgtatctgattaccctgatcgttttggccttcacctcgaaaaattcccgtgcgcccaaggcggaaggcattccctacgataagagtacccgttaaaccctttcgcgccgcctggtaccaggcggcgcgtcttttatcaggaaaggtttcacgatattttacaaaccaaatagaaatgagaggagtggaacagggatgaagtccttgttggtggttgtcgatatgcagagagattttgtctccggcccattggggacgaaggaggcgcaaaacattctgcccgcagtggttcgccgtatccaggaattccaaggggatgtggtttatacccgagacacgcataacgggaattatttgcagacccaggaggggcagcagcttccggtggtccattgcgtgcaggggaccccaggttgggagattgtgccagaagtgcgggacgcggggaagggaaagaccgtggcggtcatcgacaaaccgacgtttgggtcggtggccctctgtgattttgtggaggccggcggatacacggcggtagaattggtgggcctgtgtaccgacatctgtgtgatctccaacgccctttgtctgaaagcacgattgtgggagattccaatttctgttcgggtttcctgctgcgcaggtgttacgccggaaagccacgaaaatgcccttgccgccatgaagatgtgtcaaatccatctggtgtgactggggtaagggaggaaaccgttgtggagaaagaaattcttctctttggagggctgctgctggaccactatttttccgttgatcggtggccgcagcggggacaggatggatatgttgttgggcaggcgcgctttgtcggcggatgtgccgccaatatggcagtgaccatccacaacttaggcgggcatccccacgtggtgtcctgcgtgggcagtgaccggtcgggggagaccatccagcgctattggagagagcacggcctgtctcagcgattcattttagagaccgaaggggagaccggaagctgcttggttttttctgagccgaatggggagcgcacttttttgacccggaagggggtggaactctcttttccggctgacttggcggaagcggtgcttttgtgcgagccggcgtgggcgggggtaacgggatactatcttctgggggaggaggggccgcagatcctttcttgcctggagcgtcttcacagaagagggacgcgcattctctttgatcccagtcccttggcaggggacattgctcccgcacttcgcaagagaattttggcgatcagcgatgtgctgacccccagtgaaaaggaattggacgcgcttggcgggcatgaagggggggagcggctggtccaggctggcaaaacggttgtttggaagcagggggcacggggcggtgtggtacaggcaccaagggagagattttcctacgaggcagaaccctgtctttcggtggataccactggggcgggagacagcttttcaggtgcgctgctgtacgccctggcacagggtggtaccctccgagagggcattgtgctggcggcccggtgtgcggccaagacagtggaacttcgcggcccccatggattttggaagaagagagacggtttctctctttgaaaataagcaaaaaagccctaagggatggccgaaatggtcggttatcccttagggcttttcggtacgatggaagccttctgaatggtttgaatttcttgttgcaggcgggagaggaattgtgcggcaggaacaccgtccaactgtgtgtgatggaactgaaaagagagcagcagggtacgtttgagaaagccctttttatacttcccccagatgagaaagggattgttgtaaaagccggcatagagattcacagcgccatcaatgtcatactgagaaagggcagaggtgccgatcaccatgtattcttccgccaggttatacgcctctcccgtgtcgtgtacacgccgtgtcagattcagatagtcctgctggaattgggagaggtctgtggagaagggaatgtcacaggtgctgattgcgtgatctgcggtgggcaccactgtgctgatggccagtttgtcgtattggatcaatttttggtccaccggcaacaggtaaaacgcttcggtttgtgaggcggctcttccaatacaccaacacagcagcatgtggaacttgcagcccgttctgcggctgtatctgaccaaaggcgtgacatcaagcgttttgaatagggtaatcatcggcatgggcgcatgcatccagagggagaatgctgcggcgcgtttggtttgcgtgggatcaatttcttggatcatggggcctcctttttgctgaaatgtacggaatgtttgtgcagaggcgtcaaaagtagaaaagctcttcaaattttttgtccagagcgatacaaaggatcaacgccaatttcgcggtggggttaaactgcccggtttcaatggaactgatggtgtttcgtgacacgccaaccagctgcgccaaagcggactgtgacagctttttctctgtgcgggcttctttcagccgatttttcaggatcaatgcgtctttcataaaatcactccaatcggccaagttttcttggagtatagtatacctgtgcacagttttcttgtcaatgttttttcagggcctttgttgttcaatgaaatggggacttcaccgaagaaaaatgggagaagctttctgtttttcacaaaaatttcaaaagaattcttgacggaaccggataatatgctttactatgataaaatagaatgccatttttggccattgtataccgcaaagatgtttttcagagaggatgtgagggaatggagaactatggtgtgctgagcttattgccggtagcggtggtgattgtcctggtgtttttgaccaagcggacgacggtctcccttttggcgggaacgttggtgggggcggtgatgctctacggggtccactttgccaaaccgtggctggaggtggtctacggggtcatgggcagtgagctgtggatttggctggtgctggtctgcggctttttcggcagcctggtggcgttgtttgaggcctccggggggatctatggctttaccgacatcgctgctaaaatctgcaaaggggagaaacgaacgctgctcgccggctggctgttggggattgtcacctttgtggatgactggctgtccatcctctctgtgggcacagcaatgcggcgggccacggaccggtttcacattccccgggaaatgctggcctttctcagcaatgccacggcgtcttctatctgtgtgattgttcccacctctacctggggtgtttttatgatcagccagttggtggcaactggcgtttgtccgtcggaggctgggatggcgacctttgtggccacgctgccgtttttgttttatccatttgcggcgcttctctgcggacttctctacggggtgggggttctgcccaaatttggccccatgcgaaacgcatacacgttggcgcaacagagggaagtcccggtggagcagacagaggagagcagcggaaagaaacccaaggcacggaactttttgcttccggtgattctggtcactgggatcaccattgccacaggggagattctatatgggacgttggccagtttggtgttctgcgcccttctgtatcttccgcagaggcttatgagcccgggaaaatatttggataccatcctgaccggattcaaggacatgataggggttttgtttattgtgaccagtgcctttattctccgggatattaacagtctcttgggaatgccagagtttgtcatcggaatggcaaagacggccatgagcccgcaggttctccccgtggcggcgtttttgattgttaccctcctggcggtggcggcgggaaacttttggggggtctgcgccctctcctttccggtgatcatccccatcgcgcaggcattggataccaatgtgctgctcacggctggagcaatcatttccgccacggcggcggggtcccacctttgtttctttggggcggaggccacattggcctgctcctccacggggattgaaaatgttcgttacgcccagacttccgttccgatgctggtgatccccgtggggatcagcatccttttgtatttagcggcggggtttttcattggataatacaaaaagccagggcagtttggccctggctttttgagaaattacagccgtttccataggggaatccgcgtgtcaaaggagacagaaagtgcccctttgtcctttaaccaggacaggtacgagcgaaccgtgctgcccaccagaacatattgggagaagtccatggtcaggtgatagagatcgaacaatttttgcagcaaatgttcaaagcagatgggctcttggcacagggtaaggatgtgctccgccacttggtgggtgtggtcaatgttatattgggccagaggagcaatgtcgtctgtggcctctgcgtgggcgggaacaaagcagtgggcacggagggttttgacccgctgcaatgtatccaagtaggcccccacatcatagagaacgccgatttggtattttgccaaggtctctttgctggagaggcaatcggccaggtagatgacgccgtcctccgtctcgaaccctaccatattaaagaagtggcctgggaggggaagcattttccagcccttgggcagcacatcatcggtgaggtactcggcttggcttggctgtgccaggaggaatttgtggcgcaggtctttgggagggaacccgccgtacaggtaggagggctccagcagtggatgtcgggtcagggcacactctatgccaggggcgtaaatatggcatccggtctgtttttgcaggtattgatttcccccaatgtgatcggcgttggaatgtgtattgagaatcatttgcagctgccacccgtgttgctccaagagctgccgaatttttcgcccggcgtctttgtcatttccgctgtcaatcaggcagacttgattgtcttgcaaaagggagaggccaattttaaccggtgcgttgatatagtagctccgcggcccaacctgaatcagttcatacataatggcggtatcctttcccgtggaatttttttcattataacagaaaaaagaaaaaaagtcatccgggacaggaagatcgttgacgacgttctacaaatgtagtacaatacggagggatgtgttctactaatgtaggaggtggaccatgacaaatctatggggcgttttgctgcaaacctgttccgtttccctggtggccggactgcttctggggctgaaaagggtatggaagcagaccctttccccacgctggcagtctgctttgtggggaattttggcggtccgaattttatttccggttactatgacaggaaagttcctgcttttgcccctccctttttgggtggagacgttaaaaactgtggttgaggggcacctgtcctcctcctatacgtctttttacgagatgacgcaggtgacagcccctattccatggattgctggccttccatccagcgtgacagactggctgttccttctttacagcttcggggtgggggtgatgctgctgcggtatcttcttgcctatctccggctgcgctgctgtcttcgactggggcatccggcaccattggaagtccagagaaccgttcatgaaatagggaagcggtatgctttgcgggtttgccgggtggttgttttgcctgggctttcttcccctctggtctttggtgtgctgcgtcctgtgatggtgctgccggagggaacggtggatgaggcgatgcttctccatgagctgctccatatcaagtactgggatgcgctgcaaaatagcgtttggtgcatttgccgggctctgcattggtgcaatcccctggttctcctggctattgaccgtgcggaactggatatggaatccctctgtgaccagcgggtgctggagcggttggagggggaagcgcggcgggcttacgggtatacgcttttggctatggccgatggctgctattcttgcattccggggaccacttccatggccgacggcagccgaaatatcggccggcgcattgaggtgattgctcggttccggcggtatcccagaggaatggcccttgtggtggcctgtatgatggttttgctcttgggagggaccgtgctgggaacagggagccagggagttcgaccgatgctttccgaggggcagacgggaggctgggagaaggctgcggcgttggcttcgcttcgcctggcacactgctccactgtggccggtgcactggacacctacgcgaaaggaatgatgacaggggaacccacctacctcgccatagcctctccgcgagaggttcgaagagaatgggagcgagaactctcacgggcactgtatcagggagagaagatggaaccaatagaaatggggacggacctttctgtctatgtgctggaccgtggggaggaagggagtgtccctatctatacgggacaaagcacggatatctctttgcagggaaatgcggagatgtatacgatccacaatctccgggaggaaccagacgggacgatgacagcgcagctgttgttctcgttggaggacctggatggaatggaaccatcggagggcagttcaggtgttctgcgctatggagtgcggatcatgccagaggaaggttgggtggtagaagggacaggactgcgggaactttatttgggggacttggcccgggagaatatgtcgggagtttttctggatgttgcggtctatcccggcggccggacgcagagggcggagggggtatatggtacggtgacgcggaggacgctgacggaacaccatattctgacagagggagaggaagccgagggattctttggaaatgcctgggattcctccgaactggtgccggatctggatgcggtgtttgacaaagtgaacgagtccagtgtgacgacctgtgtgttccggcgctgggaggagacggattcaaaccgggtcgatgcgggactccaagtagcgaaccgaagagagtacggaggagtgcccgacttcccagagacacttttggtaggagaaggtggctggggaacggagtttggttcggaaacaggggactataagcggtccgtctacagaaaagattgggatggtatcctgacagtgagaggaatccacagctattcagaaagagagtaccaggccacagggtttgccgttcagctctggctggagggggaacgtaaggagatgctccttttgaaagaagtgacggaggaagggggagtttgagatgattcgattgacagaaggggagtgggctattttagaggtcctctggtcaggggaacgctttcccctgggagagattgtctcggccctgcgaccgaagatgaactggcggaggaacacggtgcacacttacctcacgcggatggaatccaagggattggtgaaaattcatcgggagacagaaccccatcagtacgccgcggctgtgagccgggaagcgtgtgcccagcaggagcggaaacagctgctggataaggtatacaatggcgcggcgggagagctcatcgcggcctttttgaaagagagccacatgacgcaggcggaacgggaccgtttgcggaagctgttggatgagatggaggtatgatatggaaaatatatggagctttttgcttcagaccttgtcggtctctctgatcgggctcttactgctggtggtgaagctgctgctgcggaacagactgtctccgcgctggcagtacgctgtatggggggtgctggcggtgcgattgatggtgcctgcgtctacctatggaaaggatatttttctgccgctccccctctgggtggaaacggtgaaactgacggtggagcaggggttgtcctcggcctatactgctttttatgaggcggtgcgtgtcgtggcgccggttccctggctttctggggggccggtcagcgtgacggattggctctttctcctgtatattcttggcgtctttgggatgctgggatgggaactgttcgcgtccctccggcttcgccggcgatttcaaaacggggaaccggtttctgcacaggagttccggcggctgcagcgaatgggggagcgggaagggaggacaatctgtgccgctgtattccttccgcagctgacgtcccctatggtctgtggtgttttccaccttgttttgggtctgccggcgaacaaacccgtggaggagacggcaattctccatgcgtttctctatccaactcgttggaatatcctgcaaagtgggttctggcgggtttgccgggcgctccactggtgtaatcctgtgatgtggttctttctcaggcaggtgaaccatgattgggtatccttctgcgatcatcaggtgttggagcggttacaggaggaggaacaggagggttatgacccggggaggttgactgggacgagtgccattttcgatggggaaaaggacctgaaagagcaggcggaggcagcggagcggcgttcgattgcgcccaagggaaggacgcttgtcgcagtttgtgtcacagtggtcttgctctgctcctctcttctggggacggtggagaaaacagtggaaattcgtccctggtgggagggcgatggatcgaggcaggagatggtggcgatttcccattgcaatccctgcacgacggcggcaggagcgctggacacatatgcgaagggaatgatgcaggaaaacccgttgtactgcgctatggcctcccccgaagcgcgccggaaacagctggaggatgggtttctccggggagaaggacagaaaacggcttcggaaaccgttttgctgtatccggcggtgtcttatgaccaggcagcggaggcgcccgtcaaggtacgtctggaagatggataccgatttgacaccgatcgagggtatcgtgtgcagaacctgaaggagaaggatggcggccagacaggacttctgatcctctacttgtatacagtgcccgagggaaaggaatttgtggagaaggatcgtttcgatgacatggaattgacggagagctatcttcccagcggacaactggtatgtcccgtccgtgtgtggcgggaggagaaccgctacgtggtggaagaaacgggggaacgagccatttacttatcctatgatataccaaatgggggggcggagtactgcgagcgaatggtgccggaactggaagcagagaaggcagttgggaaatatggaaccatgacggtacatcgctggtctgtctatcaggtggacaacgaggagaaggccgagacctctgtttgggactgggaacgcgggagcggtttctgtgaaatccccaaaccggacgcagcattttcggttattcgatggccttggaaagtatcctatcagtgtgtggatggctggcaggaccgggagaacttacagatggtaggtttgcatgtgatgcctctgatcgaagaaggagagcaaccggacttttcggaactggatgcgtatttggacatttcaaatctgaatgcgtccgggagtgacaaccgtggcgtttcctggaaccattgcagagtggatgagacctgggatggtgaagtgaccgtggagggagtttgtgagacggacacgcagggtttggccgttcggttgatttggaattttgaggagaaagagagcttcacaatcagaggaggtgtaaacgatggaccgtaatagggtggcccgcgctgtgggtctgattgcttggggatatctcctgctgtgcttccatttgacagtgggtaccattgttctggtaccaaattggctttgctatatttttttcttaaaggcaatggggggactggaaccagttgtccccgctgtgaagctgctgtttcctctgggggtgcttctgggagtctgggaggggctgctgtgggggatgtccgctgtggggatacaggattttaccctgctgtacggccttcagctggttgcctccgtgctgatgatctactttcattttcagtttctgaccaatttggcggagattgcggcgcaggcaatgcttccccaacgcatcccccttctctgtctgcgcaccatccgtacgctgtttaccacagtcacggcgctcccgattgcctggacggaggtttatcctctggcggttgtacttggaattgtcggtgtggtgattggaatttgtacctgcgtggttttgtttggcctgcggaaagcattgaaaagaggcggcctgccgctgcagccggagatgggaaagtagaaaccgaggcgttctaaaaagaacgcctcggtttctgtttggaatttcttatgaggaggagaaaatcatttcaagaacgcttccagctctgccttggattttacccccacggagacatccacgggttctccatcccggaagagcaggagcgtgggaatggcggaaatttgatagcgctgtgccagttcaggggcttcgtctacgttgacttttccaaaggaaatttccggatgctcttccgccagttcttccaccacgggagagagcatggaacagggcccgcaccaggcagcccagaaatccagcagcacaggggcagaggaccgggtgacctgatcatcaaagttttcctggttgatggtggtgattgccatagtcagcactcctttttgcagatagtttgttttgttgtggatagcatacccgaaaatccatccttttactgtgatcaagacacataaaagcacaggatttcaaaaaacttttcagggtttgcgctggatttctgggatttccgtgcttcccatggttattttagcaggccttattggaagaatagaggggggcgggcaatgcgcaagccgggtatttgggggttagggttccgcagacaggggatcatccgtgtcgcggatgtgatagatgatgcagggacgaccaccggtattgtagtccatgtcgctggtaataatacgctgttcaaccagatagttcatatagcgccgcacggtgacaacggacagcccgacatggctggcaatgtcatcacaggtatgtcccttctgggcggtgtcacggaggtagccttcaatgagggaaagggtctggctctgcagccctttgggcatggcagaggagctgccggctcccgtggaggagatatggagcagggcggaatccagtttggtctgggtgaattttccgctgtggatggcattgcggcgctggcagaaggttttcagggccagctgaaaccgctcatatccaaagggtttaattagataatctgttacaccgagacgcatgaaggcttcgatggtggtggcgtcgtctgcggaagttaccatgataacgtctgcgtccacgccttccgcgcgaagcgcccggagcaggtccagtccgctcatctggggcatgtaaacatccaaaataatcaaatccacagggttgctgcgcagccagaacagagcgggatgagcagcggaaaaagtctgaaccacacaaaagcggttgtccatttcaacatagcggcggttcaaatgggtgatgacagaatcgtcttcaatgatgacagtacggtacagcatagtgatctcctgtttctttatgtgtggtcagtcagcgtgataataaatgaagtgccaacccccaggtcggattctacccggatggttccattgtaggtctctatgatatctcggaccaaggcgagccccgttccacggccatcccctttggtggagaagccccgctcaaagatatgctgcttgacttcctccgtcatgccgggcccggtgtcgtctacgctcagaaggagaccgtgggccccctcccggatgctgacggtgacttcactggggacatctgcgggggcgccccgcatggcatcaaaggaattctcgatgaggttgcccagaacggtgatgagaccagtgactggcaaatactgcccatttccatgcaaggtgctggcagggtccagggtgaacaggatatccagttccgccgcgcgataggcttttccaatcagcagagcggccacggaggggtcctgtatccggtcactgatgtagccgatggactgcgcgcgggtttcggtgattcggagcacatacgcctcggcgtgctggatgtcgcccagctgcagcagcccaaggattacgtggagcttgttggtaaactcatgggtgtaggctcgcagtgcctcgacgatgtgctgtaccccggtcaggtcctgggcgagcttggttacctctgtgcggttgcggaaaatcgccacagccccctcaatttttccgttgtgccaaaggggaatccgatcggaaaggacggagacatgggtgatggattccagactgatattgtattccggcaggccggtccgcattacccggggaatactggagcggggataaaccgccttcagtggctgccccagcgcggcggactgatcaatctgcaaaatttctgatgctgcccggttgagataggtgacacacttgttttcatcaatggccagcaggccttcatccaaggcgtccaggatatccatacgctgaagaaacagcttgcgaaaggcgtcgggctcataaccgagcaattcctccttgatatttcgggacaggcgcagactcaggaggctgccggcgatcagcgcgaccacacaggcaagcaagtgaaacagcagcatacgcaggaccatcatttgaatggagcgcatatagatgcccaccataacaaagccggtcagttctccttcggaggaatagattgccgcataggcacagcggtcagtcccggagggggcctccccattgtagagcatggtgtcgttgcccgcagtgaaccacgccatcacactctcgctcagcggggttaagagcgtagggtcatctgcgccggaggccaggtcatagaacgccacgggagcgccgcttttatcatataccgcgaagacatcaatgctgggaacattgcggacggtgcgccggatgtactcagtggcctgggtatggtggatgtcctccatcaagacaggggtgtttgcggccacctgcgcggcgctggagagggtctggtcccgggaacggctttcctggattaagttgagcagaaagctgacaccaagggaaagtcccagggcaatcacgatacccagtaggagcattttccggatttgaacatagatcttaggactggtgttttttttcttgtgcatgggcagcatgaacctctgaacaataaaatttcctgtttatcatatcacatccgtcaagcggcatcaaacccgtttggaggggaaagggatggaaaccgtcattttgcgcggtttgcgttttttacttttttaagattgcctttcttctttggaagactaaaataaggtgcgatctgaaaaacgaaagaggtggtacatgttggatgaaattcaagcggcgctcaatgagcagcttcaaaacaagacggcatttgagatccctctgtttggcgggattccggtgccggcgtctgcggtggtcacctgggtgattatcctattgctcacgctgcttgccatttggttgacccacgacctaaaagaacggccgggcaggcggcaggcggcggcagagatgtttgttgggttcatcaacaatttctgtcaggaaatcttgggggaaaaatattggcgtacctttgcgccttatcttggtaccatcggcctgtatcttttgtttgcgaacctatccgggctgtttggggtggcaccgcccaccaaagatttgaatgtgacagcgggcttggcgatcatgagcctggtgctgatctacggttcccagttccgctatcacgggctgggcggtggactgaagaaatttggccagccgtccgtgatcatcacgccgctgaacgtgatggaggttggcatccggccgctcgccctgtgtatgcggctgttcggcaacattttagggggctttatcattatggagctgattaagacggtggctcctgctgtggttcccgttccgtttagcctatacttcgatatctttgacggggtattgcaggcggttgtgttcgtgttcctgacaacactgttcctttcggaatctttggagtaagcagagaaaacatcctgagaaaaacattttattgaggaggaatttaacatgggtattgcagcacttggcgcggggatcgcggttctgactggtcttggcgcgggaattggcatcggcattgccacaggaaagtcttcagaggccattgcacgtcagccggagcaggccgggcggatcagccggaatatgcttcttggctgcgcaatggcagaaggtaccgcgatctttggactgctgattggcattctgctcatcttcatgaactgatcgggggcgtgaccgttggttctgaatctgaactgggagatcatctgggtttttgttaatctgttgattttgttcctgctgatgaaaaagttcctgtttggccccatcaccaagctactggacgagcgggccaaaggtgtcgcggacactttggatcaggcggagacgcagctggcggaagcggagcggcagaaggcggagtatacccagcagctggcaagtgcccggggagaggcggcccatattgtggaagaagcgcggaaacgggcggacttggcgtacagccgacgcatggatgaggcggcccaggatgtccagcgccttaatgagcaggcggcccgtcagagagcagcggaccgggaggccatgctggcctcggcacaaaagcaggtggctgacttggtgctgctgaccacggccaaggtgtcacagcgtacgctggacgcggacgccgaccgtgccatgctggacgccctcctggaggaggtcggtgacgagtgatgagcacacctgcattccgctatgcagcggcgctgtaccgcacgggctgccctgtggagcgcctgtgtgaaacagcggattacctgacggacagcccgcctttgtgggaggcattgtgcagccctgtggtggaagtgcgggagaaaactgcggtgctggcccgcctgccctcttttacagaggatgtgcggctgcagcatttttacgcgctgctggcggagaagggccggttcccgctgcttcctgacattgtggaggagtaccagcgtctggaaagaaagcaaaagggcgaaggattgtgccgtctccggtgtgcccgggacccgggggaccaggcgttgggtgccctggcccggcgtttgtgcaagaagtatgggtatcagtccctcaccttcgccattgaacttgatccagcggtattgggtggtttcgtgctggagattgacggggtaacttacgataagagtgtgcaggggcagctgcatgccttggcacaaaatctccgggaggggggaaaacattgaagcattcagaggaaattatatccattctccaggaggagattgcccagtatgacaaccgaacccgccgcagcgaaagcggtacgatcctggagattggcgatggcattgctacggtttatgggctggaccgtgtggtctatggagaactggtggaatttgaaacgggtgcgcggggcattgccctgaacctggaacgcgacagcgtaggcgttgtgctgctgggcagcgaggcgggcctgcatgagggttcctgggtcaagcgcacaggacgtccggcggatgtccctgttggggaggaactcattggccggacggtcaacgcattgggggagcccatcgacggcttggggcccatcgcttcggtggagacccgtcccattgagcatgaggcctccggcgttgtcacccgggagccggtgaaccagcccctgcaaaccggcattctggccattgacgccatggtgcccattggccgtgggcagcgagaactcatcattggagaccgccagacgggaaagactgccattgccgtggataccattttgaaccagaaggggcaggatgtcatctgcatctatgtggccatcggccaaaaggcctctaccgtggccaagctgcgggggacgctggagaaatttggtgcgctggagtacagtatcatcgtgtctgccaccgcggcggattctgccccgcagcagtatattgcgccctatgtgggagctgccatcggggagtattttatggagaagggacgggatgtcctcattgtatatgatgatctctccaagcacgcggtggcatatcggaccctgtccttgctgctgcgccgctcccctggacgggaggcctatccaggggacgtgttctatctccattcccgcctgttggagcgggcctgccgcctgaccgaggcatacggcgggggctccatgacagctctgccgatcattgagaccctggcgggagatgtggcggcttatattccaaccaatgttatctccattacggacggtcagatctatctggagaatgacctgttttttgccggtcagcggcctgcggtcaatgtggggctgtcggtctcccgtgtgggcggttctgcccagacaaaagcagtgaagaagacggcgggaacgctgcggattgacttggcccggttccgtgagctggaggtatttacccagtttagctcggacctggatcaggagacccgccaggcgctggaccatggcaagtgcctcatggagattctcaagcagccgctgcatcatcctatggcggtgtggagacaggcggtgatcctgtatattgccacaagcaatctgctgtctgacgtgcccttgaaccgagtcaatcggtttgtccaggaatttgccgacagccttcaggcggagcacggcggcctggtggaggaaatccagtccacgggcacactgcccggggcggtgacggagcaaattcgcggggcactggaagcgtacaaaaagcaggtgagcgtatcatggcaggaataaaggagatccgcacccgcattgacagcgtacagcagaccctcaagattaccaatgccatgtacctgatctcctcctctaagctgcgaaaagcccggcagcaattcaatgcagtacagcctttttttcaaaaggtgacggagaccatttcggacatcctgcaccactccccggcgatggaacatgtctattttgacaagcgtccccatgtatcggaacataccgtgggctacattgtgatcacaggggacaaaggactggcaggggcgtacaaccacaatgtgctgcgcctgacagaggagcggcttgcccaaaccctgcggcccatgctgtttttgattggtcaggtgggacgcagttatttttcagagcggggcgtgccggtggatggagaattcatgtacacggcccaggacccgacattttcccgtgcggaagagatcagtgacacgttcatccagttgttccgccagggaaagttggatgaggtctatgtggtgtacacggacatggtgacacccatgcggctggaacccaaggtgcagaagctgctgcctctggatatggatgccttttcctggacgccgcggccggaagaggaggctggataccggcagatggtaacctatgtccccaatgagcaccaggtactgagtcacattgtcccgggatatgtcacgggggtactgtttggtgcattggtggattccttttgtgcagagcagaatgcccgcatgatggcgatggacgcctcaagcagcaacgcgcgtgatatgctcaaggagctttccctgcggtataaccgtgcccggcaggcggccattacccaggagattacggagatcgtcggcggtgcacagcagcaaatggaagcgcagccttcccaccccaggaaagcgccggttcgaaccgtccgtttcctggcggacggcagccgcgcatagaaagggaggaatggacaatggaacggaagggaacagtggcccaggttcttgggccggtggtcgatgtggagttttcggagggaagcctgccggaaatcaatgaggcgctcaccgtcgaactggacgggaaagcacaggtcatggaagtcgcccagcacattggcggggacacggtccgctgcattatgctctctcccagtgaagggcttggccggggcgttggcgtgaccgcgacagggcatacgattcaaacaccggtgggagaagggacgctgggccggatgtttaatgtgttgggagaacccattgatgggaaaggggcggtggatggatcggagcggtggtctatccaccgagacgcaccgtcttttgcccagcagaaccccaccacggaactgttggaaaccggcatcaaggtcatagaccttcttgctccctatgccagaggcgggaagattggtctgtttggcggcgcgggcgttgggaaaacggtgctgatccaagagctgatccgaaacattgccacagagcatggcggatattccatttttaccggtgtgggagagcgcacccgggaggggaatgacctgtggcgggagatgagtgactccggcgttctgagcaaaaccgccctcgtttttggacagatgaacgagccgccaggggcacggatgcgggttgcactgaccggtctgaccatggcggaatattttcgggaccggcagaagcagaatgtcctgctcttcattgataatattttccgctatgtacaggctggatcggaggtatctgccctgatgggacggatgccctccgcagtggggtatcagcccaccctggcccaggaggtgggggcgctgcaggagcggattacctccacgcagaacggcgccattacttcggtacaggcggtctatgttccggcggacgatctgacggacccggcgccggcgaccacctttgcccacttggacgcaaccacggtcctctctcgtaagatcgcggagcagggaatttatcctgcggtggacccgctggagtccacctcccgcattctggagccggatgtggtgggagagcggcattacgcggtggcccgtggcgcgcaggaactgctgcagcgttaccgtgagctgcaggatatcattgccattctgggcatggaggagctgagtgctgaggaccggaaaacggtggaccgcgcgcgccggatgcagcagtatttctctcagcccttttttgtggcggagacctttacaggtctggaagggcggtatgtccccttggaggagacgatcaaaggatttgaagcccttctgggcggggaactggatcggtatcccgagtcggcgtttgccatggtgggcacggtggatgagatccgcgagaaggcaagggcccagggagcggtgtgatggagaagacatttcaactggagattatgaccccggagaagcaatttttcaaaggccaagcggaggggctgatcatgccggcgctggacggagagtatggagtgcagccgggccatgagcccattgtgaccgcgctggagcccggcacagtacggtactgtgtaaaggggcagtgggatgacgtgattgtcggccagggatttgccgaggtgatgccggactatgccattcttctggtgtccacggcggaacgcccaggggagattgacaaagccagggcggagcgggccaaagcccatgcggaggaatgcctgcgtcagaagcaaagtgtgcaggagtatcaccgttccaaagcggccctggccagggcaatggcacggctgaaagcggcggccaaataactggattaggattcgagaagaaacgcggtgtttcctcatgggagaggaacaccgcgtttctgtataccttgctggatcaaaagggcagccatggaaagggaatgggaaaaacttgcggaaatagagacaggctgggagggaatagagtagagcacaggaggtgctgcccatgatttcagcatggatattactgctgctcaataccctctgctttcccctccggttgggaaacgccgggtcatttccccgccccttgaaggcggaggaggagcgagaatacttagaacggtttgccaatggagacttggaagcccggaacaaattggtggaacataatcttcgcctggtttcccacattctcaaaaaatattatgtacaggccggagatcaggacgatttgatttccattggaaccattggtttgattaaagggatttccacgtttaagccggacaaaaaggtgcggctggccacctatgccagccgctgtgtggagaatgagattctcatgcattttcgcagccagagaaagtaccagggggatgtctccctgtccgattccatcgactccgaccgggagggaaacgcgctgtcactgatggatgttatcagtgtggaggacgatatgctggagaacctggatgcccgggattcctgtgccaaagttcgacgctgcgttgaacactgcttgacagaacgggaagccaaagtgatttccctgcgttacggtttggacggcgaggggccgcgcacccagcgagagatcgcgtcttcctgtggcatcagtcgttcctatgtatcccgccttgaaaagaaagctttgggaaaactccgggaggcaatggagaaaggataacagggaaccggcccgggacctgtaaaatacaggtcccgggccggttggagcggtcaggtcaggggtgcagtgcgatttcatgacgtttggggccggtggaaaccattttaataggagtctgaatttcctgggagataaagtctacataggctttggcgttggcaggcagcgcctggtaatctgtgattccgcgaatgtcagatttccatccgggcaatgtggtgaagatgggtttggcacgggataacagagcgggaacgggaaacgatttggtaacttgaccatccacttcataggcggtacagaccgggatttcatccagatagctcaaaacatccagacaagtcaaagccacttccgtagcgccctgcaccatacagccgtacctggtggccaccgtgtcaaaccaacccacccggcggggccgtcctgtggtagcgccgaactccccttggtctcctccccggcggcgaagttctgccccggcttctcccagaagctcactcacgaaaggctctgtttgcgcaccgacacaggaggagtaggccttggtgacacagatgacatcgtgaatcgcggtgggtggaaccggggcgcccacacagccaaacccggctaacgtatgggaagacgtggtcatgggaaccatgcccaagtcagggtccttcattgcccctaattgtccttccaggaggatggacttgccgttctgcagggcctgatgcaggtaggtcacggtatctcccacgtagggggaaatgatctcacgcagctcaagcagctcacggaatagggcttccgcgttgatgggaggtttatgatacagggtttggaacaagatattttttacctcaacagctcgctctacatgctcccgtagacgaggaggatcaaacaggtcgcagacctggataccaattttggcatatttgtctgagtagaagggggcaattccgcttttggtggacccgaaagcgtgtcctcccagacgctcctcctcataggtgtcttgaaggatgtgatagggcagcagcagttgggcccggtcagagatcattaaattgggggtgggaacgcctgcctcagcaagatgacggagttcacttgtaatcttttgcatgtctaaggccacgccatttccaatgacattggtaatatgggcgtaaaaaacgcctgagggcagggtgtgcagcgcaaaacggccgtagtcgttgataatggtgtgccccgcgttggcgcccccttgaaaacgaaccacaatatccgatgcttccgccattaaatccgtaatttttcctttgccttcgtcaccccagttggcgccgacaatcgcttttaccacagagatccctccttgcaatgattcatacgatacacgtgcaccgcacgatgagacttggtcccgcataagaaatacaactcattataatactcggtatttcaagatgcaagagtagagtcgaaaaatttcatttttattttggggaattcaaaattctgaagaactccctctttacattcacgatttaccttgctaaaataaaaaagcagttgagaataaaaggagaagagtttcatgaagcaaacgccaaaagaggaccatgacttgctgtatgagagccttctgcaactgaacaatgtggaggagtgccggcggtttatggaggacctgtgcacggtaacagagctgaaagccatgcggcagcgcattgaggttgcgatgtacctccgggagggaatgatttatcaggacattctcaagcatacgggagccagcagcgccaccatcagccgggtgaaccgctgcctgcaatatggcgcggatggctaccagacggttttgccgcggctggaccccatttgggaggagaagaaaaagccgtgagccattggaatgagacctatgacgccttagctggctgctatgacgatatgacagaggatgtgaactacccaggttgggcggattttttggaaaagctcttttcccggggaaagcacccagtacatacggtattggacctggcctgtggcacaggaaccatgtcttttttgctggccgcccggggatatgaactgatcggggtggacttctctccggagatgttggcgattgccgcagagaaaacattggaaggggaaggcgaaccgcctatttttctctgccaaccaatggaaaagctggacctctatgggacggtggatgcctgtgtttgtctgctggacagtgtaaaccatataacccagccgggaaaattgcgcagggcatttgagcgggtccggctttttttagagcccggtggacttttcgtctttgacgttcacacgcctgaacacttggcggggttggacggtggtatttttttggatgaaacggaagacgcttattgtgtatggcgcacggattaccacccccggcgtcagatttgtacctatggcatggacatcttccgccgggaaggggaggcctggcatcgggagacggagatgcatgaagagcgggcctattccgtggaggaattgacgaactatttgcagcaggcgggctttgtggagatccgccaatatggcaacttaaaacttcggagaccggaggcaggggaggaacggatctttttcacggcccgaaagccgaaggaaacaaaaaagtaggagagacatcgcatggattatattgttagaatgattgcaaaggatgcgcccatcaaggcgatggcgattcaggggagggaaatggtccagcgggccagagagatccaccatacatctccggttgccacagcggccctggggcgcacgctgatggcggcctccatgatgggacagcagattaaagagaaggacggctctgtgacgatacggatcaatggcggcggtcccttgggaagcattctggccgtctcggacagcgacggaaatgtcagagggtatgtgcagaatgggcaaattgacgttcccctcaaaggaccggcaaaattggacgtgggatgggcggttggcacggcgggctccctgacggtcattaaggatctgcggatgaaagagccctatgtaggaaccattcctctggtttctggagagattgcagaggacatcacggcatattttgccgaaagtgagcaaattcccacggcctgcgccttgggcgtcttggtagagaaggacctgtctgtcgctgcggcgggcggttacttgattcagttgctgcctggtgccagcgatgccgacattgataagattgaggcgggtattgcacaggtgggccaggtgacccatcatctgagccaaggtgtcagcccggaagagctgcttcggatggtactttgctcgtttgatttggagaccttagagagcgttccggtgtcgtatcggtgctactgcagccgggaacggatgcgcagcgcactggcaagcatgggcaaggaagaactccgggccttgattgccgaacagggacgggcggagatgacctgccagttttgcgacgcagtccatgtctttgaaaaagaggagttggaggcattggctgattccctgtgaggggctcagtgtctgccttgtttcctgggattgcctgcgttgtaaaaaaataaaaagatttgaaaaaagctattgacaaatagggtggtcttcgatataataaactacgctgcttgagggttgcgagagcaaacaagggtagcttcaccgggagcatagctcagctgggagagcacatgccttacaagcatggggtcacaggttcgagccctgttgttcccaccacccacatggcgcggtagttcagttggttagaacgccggcctgtcacgccggaggtcgagggttcaagtcccttccgcgtcgccagaggggtacgaacttgtacccccctatatgcccaggtagctcagttggtagagcagcggactgaaaatccgcgtgtcgctggttcgattccggccctgggcaccacgttgtggctgtgccacaacgtatttgcgagtgtagctcatctggtagagcgccaccttgccaaggtggaggtagcgagttcgagcctcgtcactcgctccagatggcgccatagccaagtggtaaggcagaggtctgcaaaacctttacccccagttcaaatctgggtggcgcctccatgagaaagccttgtcgaaagacaaggcttttttccgtattgtcatgacctgtcagaaacagaggtacggacgatgatttattttgttgaagacgatgccagcattcgagagctggttctctataccttaaacaatgcgggctttcaggcagagggctttgaacgtccttccgccttttggaaggcagtggggcagatgcgcccaaccctcattcttctggacatcatgctgccggaagaagatggactgtccattttgcgaaagctacgggcggacccggacacccgagccacgccggtgatgatgctcacggcaaaggggacagagtatgatactgtattggcgttggatgctggcgcagacgactatgtacaaaagccctttcgcatgatggagctgctctccaggattcgtgcattgattcggcggtcagaggggtatggtacaccggcaggagcagtggaatatcaggcagagcatttggaagtgtcgcccgcccggcacctggtccgcgtggatggaaaagatgtgacactgacgttgaaggaatttgaactgctctgcctcctgctggaaaataaggggattgtattgtcccgggaccggattttggataaagtctggggggatgccatgggaagagagagcaggacagtggatgttcatatccggacgctccgacagaaattggggcctgcaggcggctgtattgagacggtccggggaattggttataagttaaagggagcggattgaaaggacgacttatattggtatggttggtttcagtgatgctgcttggtttttacacaacacgccgtcggagaaatccgacggcgtgttgtgtttgggggaattcaagtgtggctgacctggtctaagatgccggtcaggtaggccaaaaccacaccatagttggagatgggaatcccttgggcgttggcctgggcgattcgatggatgacgtggcggcggttgaacatacaggcgccgcagtggatgatcagatcatagggagagaggtcttggggaaagtcgtttccccggaggaaggtgaaggagagtccttgccccacccgctgccggagcagacggggaattttttcgcggccaatgtcctcggttgtaggggcatgggcgcaggcttccgcaatgaggaccgtggagttctcagtcaaagatgcaatggctttggccccatgtaggaaggtctgaatgtctcctttgtaaccagcaaagagaatggagaaggaggtcagcaggctctccgcgggttttgccttccagacggaagggaaaacctgggaatcggttataatcaactttggggggatgcgcagggcctccaaggttgcttccaagcagtctgccgtgcagctcataacggaacatcgcttgtccaaaagttcccgcatggtttggacctgcggaaggatcaaacgtcctttgggggcttgaagatcctgaggcatgaccagcagaaccagatcaccgggctgcgccaaagagccggtgatggtaagctcccaaaaatcatctggaagggcttgcgcgatggcctggcgaagctgcggaatctgttcccctgtttttgcgctgaccggaaaaacgggcaggccacccagctgctgcgacaggtatgcttgcacagcagggacattttccattctgtcgcattgatttaggaccggcaagatggggacttttttctcctggagccattgaaaccaggaaagctcctctttcatcgggcccgtcaggacgaggattgccaagtccatggtatccacagcctgcctggtcttttccacccgaagggttcccaggggacccgtgtcgtctaaaccggcagtatcaataaacaccacaggacccagacgctctaactcgaaagtttgataaaccaagtcggtggttgtcccctccacaggagagaccaaggacttggcctgtcctgtgattgcattaagaagggaagatttcccggcgtttcgattgccgaacaaaccgatgtgcggccggttggcccggggtgtgtcctgaagtcccatgttaaacccctcccaaatccaaggtaagccctgtcagctgggcgatttcttcacagtgggccagaccggagacatgacgctggtcaatgggacggaacgctttggcctgggcatccggcaaaaggtcacagaagaggagattggcgccacaggcaatggcgttttggttgcctgttttgtcagccaggcctgctttggggtgaattcccggctgctgtgcggtgattttaatgtctggaagcatcagtcgaaggattgccatttccttgttgttcagcaggaagtcacccggtccgccttccaaggccagaggcgtgttggcggcgggaagatagggaatgttgggggcccagctgatctccagttctttcatcagcaagatatcgtcggccagttcatctaaggtctgcccgggccagtctacgatattgccggaggccagtttcatgcctgcttccttgatccaatgggcacatcgcatccgctttgcgtagctggtagaggggttgaggcgctggaagctgtctgggtgagacatttcaaacttcaggacatattcctccacgcccgcgtcgtgcagttcctgatattggcttgcctccaactctccggcccccaaggcgatggagtagccctgttgcctcaagccagagaccaactgcagcagatgatcgaaaccgtagttgcggtcttctcccgccaggaggaacatgcgtcccagcccgtctaactttgcctgctgggaaagagagagaatttctgcagggggaatgcgatagcggggaatggggttccccgctcgcatcccacaataaagacattggtttttgcatatattggtataggccagcatggcggttaccaagagggtgttgccaaagtggtcttggcaagttttccgggcagcgggggcaacctgtgcccaaaataccgcttcgggaagagacaagatgtccaaaacatcttgttttgtttggatgttcataataagcttcctttttggaattcctgcggaggaccgttactggcccaagtaatagaagtcgtcacctggcagggcaccgcccaccgactggggattttgatcgaaaagaacctggaaatagccctgcacggagctcttcatctcttctcccgtaatgcagacgatattgcagtagggaatggccttctccgccacagcggcctctacaatatcatactgggccaccagctgggcggcctccgagacattttcattgacatattgggtggaggcggcatattctttcaagaaagcggccacagcctccgggtgctctttggcaaattcggtgcggaccaccagcccggcggtgttgagctgactgccgttgtccaaggcatcccattccttagttaaatccaggcggattgtaagatcgtcaaatttagactgtgcgacagtgacaaagggctgtggcagcatggcgatgacgtggtcttccgcagccatctgcgccacgatttcagagggctcgctcttccattcaatcgtcacatccgcggcggggtccaggccgttttcctctaaaagatagttcagcgcatattccggggtggagccctttccggtggcgtaaatggtctgccccttcaggctgttccaatctgtgacggtttggccgcctttctccaccagatagatcacccccagagtatttacggccagcagctgcacggcgccatcggagttgttataaaggacggagcccaagttgacagggacggccagaatgtccagttccccctggagcattttgggggtgagttcatctgcggaaccagccatggaaaattcataatgattggtggttttccctgcatcgttgtctgacaggagcttgaccattcccatggaggtgggccctttcagaccgcctaagcgaacggtaacgggttcctctggggtggttgtggtgctgtcgtcttctgcgggggtgggcgtgcttccgcatccggcacacagtgcggcaaccaagcagagcgaaagcaaaagcgcaagaagtttcttcataacaatacctcgatttctcgccgatggcgttaatgtttttattgtagcgcgcagacaaagaaaaacacgttgcagatgcaaccgggagaggacattttttgataaaatcgggtaaacaggcaaaaggaaatccctctcccatcttataaaagataggagagggataagacatcaaactaaattatgccttcttccacaggccgtggaggttgcagtactcataggcggccacgaacttgtcgccgggagccatggcgaaggtgacggtgggctcctgaccgggcttcaaagctttgcgctgatttccctgctcggtctgcaggctgatccactggatgtagtgtttttcctccatggggtgggtaacagaaccaacggagacagtgacctggttaccgtccaccgttaccacagggacatgtttttccgtggcggcgtctgtggtgtttgccaccatttccttcatctcttccccgcagcagacaactttaggaccgttgtcctgaacgtaggcaacgatgttgccgcagtgggaacatttgtagaatttcatatccatgatcataatctcctttacaagataaattaaaatagtggttgtgcttgctttcctgtctatggtatgatgatactacaaaattgcgaattatcacagtgattttgtcacccaagaaggaaaaatttgaaatacaccgcattttctgccgacggagggccttccaatgaatcgagaaatttccttttatcagtatttaaccccggaagaacaggatcttttggaccgctccatgcagcaggtaccatgtcgaaagagccaggtggtccaccggcatggggacagctgcgtggggctgatttttgtgcggaagggccggctggcgttttccatcctgtcggaagaggggagagagattaccgtattccgcattgaaaaaggagaatcttgtattctttcagcggcctgcgtgcttcagagcttggagtttgaaagtcatatcaccgcagaggtgaattctgagattgcaatcctgcccgcaccgacgctctcacagctgatgaacagcaacccggatgtggaacggctggtctataagcaggcggtgattcagtattccggggtgctgcggaccatgcagcagattatatttctcagcctggaaaagcgattggcgacctttttgttggaggagagccagcggagacagtctccctccttttccgcgacccatgagcagatcgcccggtatatcggttcctcccgggaggtggtgacccggatgctcaaccagtttgccggccggggcattgtttccctggggcgggggacggttactgttttggacccggaggcattggaagacgtgttgatgtaaagaaaccgaggaaaaactgctgaccggataaaaataagaaaaaacacaggtgcatggagccgccgtgcacctgtgttttgctctttttcattaaaaataaagctcgtcgctctcgccgggggctcccagcaaatctacaaaatagggggcaaccacatagacattggtggcgactttcataatgtggccatcctcagtatagatcacgccggacacaaaatccaataagcggcgggcgacatcccgctccgttttggccaggttcagcaccacaaacttcatatcccggagaaggtcagcgatcttggatgcatccttgtactcctggggagccaccaagacgatctgcatatctgcaacgctgtggatgggctgaactccctcggatgcccagtcctgtccctcgtcctcgtaggcatagctttcttcgtaatcctcgtacaggtcctcttcttccggctttcggcgcaacgcgctaaagaatgacatgtgcgtacctcctctgtattgatatgctctctcttggtcgaaatccccaatgtgacaagaacacaactcttgcttctatcaagcgtttttaccatgatactacaaaagatgatgaatttcaaggcttttgtggaatattttgtgaacgtttgtaattctttttcaatatattgaaaccgttctgcaactttttccggccttcgacaaaattcgtcaagggacgggccaaaagagaccacaatatatagaggggaaacaagcggacacagggctcaggcatcagggagcgtcccgatatttctccaaaagacgaagcagctcttcctcatctttgtcatccaaaccgtgggcgttggccagggattccacgtggtgggtaaactcgtgggccagcgtggtgtaaagctcttcccgccaggtttcctctgaccaactctcattgcgggcggaggccaggaaagaaccataatataagttaatatatcggcccaggtaactgtcctgaacgtattcccccatgaagtagacctcgccctcgggaaacatggggtccggcttggcctcttcttggagaagaatgcctccgttcagttgctcaaagaacacaggtggaaaagtctcggccatctcatccaacagatcggccacttggtcaaaggtatattccatcgcaagctcctcctctcgagtatcctccattttacaatagtttttggaacactgcaagaaaaagcctctggcccagaaaaagctgagccagaggacagaggcgttagcggttgtattcggcgtactgcagcatgtcacgcaggaggtacaaaaggagcagtgccaccggaatattgatgattccagccaccagaagtccgccgctgacaccgccgggcaagttcagaagcaccatcaaaaacactgcaatgaggatgccgggcagggtcaagagaattagaatcaagaaatagaggaacatgatcagagccttgctggcgccgctccaaaaccgttccagcagaaggttgccgctttgaaacaggagagcatagctcatccgagcgaagagacagaccagaatagcaccaggccccatgcctaaaatcaggcccacagggacaaagaccacaatggcttccgccagcgcggaggggacgagttcccgcagacagtgcagaagcttggagaaggaggactctggcaccaggtaaataaagggtttgtagagttctcgattgattctgctctgtcctgcggtgaagagttgtaggtacaccgcaaaggcgaacacagggaggatgccgctctctcgcatgaaaaaggaaaagccaatgagcaccacggcaaagatcaggctggcagggggcaacagcatccagctgccccgccggttctcaattttgtgtttataatagaaggccgaggcaccccatcccttcttcaagccggttgctccaatacggactttgcctgggacagactccatggtgccttcctttttagcgacaatggcggattgggccagctcagcggtacggaggacatcttcgtaccaatcccggtcgaagtgtgtcaaaaggaagagaaggaggaaaaaccaggccaggcagagaagaagcccaggccaccaggtacccagcccaaggcaggcggagaaaacccagcccagccaaccgcccactggaaagagctgtaccggcagactgaccgaagcgtcaattactccggccaaccgttggtcgggggaggtccagaatccccagaagagccatccagccaccaaaagcaggcagagaatgatcaggccctttaagagtttttgggctccctcatggctgctggtaaaggtgtaaatggtcatggcggtgacttgtcccagaaagaccgctgcggtgtagcatagaaagagcgcgaccatggacgccatggtgatgccatagagattatgaagccatccatattggtagaagagaaagatgcccagcaagagtgctgtgctgatttgccgcaggaggccgtagaatagcgtgcgggtccggtgaatgggggaggggaagagaaggttcacgtcggagagggaaaaaatcgttccccctttcgagaagccgttccagacagtgagaaggaagataaagaggaacagggcggtcgccatggccaccacttcacgaaggtcccggtagctctctggagggtatgtgctgccgctgccctgcacagcgaaaaccaagagggccagcaaaaaaacaacatagatcagccgggcaggtttccgcagcaggtctcgaatcccgtttttcagccgggtcagcgtcagataagtcagggcgctcatgacggttttcctccctctgtaatggcaaagaagaggtcctccagactgcgggccttcaattcctctggcctgttgtattgggtggcggcaaaacgcccattcaccatgatgtgtgtgacatcccagtaatcctccacactgtcaatcatgtgggtggagatgaggagggcggcgccttgggccttttgctcccggaaaagcagctttaattccttgatggcgtgggggtccagccccaccatgggctcgtcaaaaatgatcagctttgggcgatgaaccagcccacagcagatggacagcttctgctgcattcctttggagaggtcacggcccagcttatcccgtttgtctgccagttcaaagcgttccaagagtctctcgccatacccgtcgtcctctatgcggtaggcccgccggataaactccaggtgctctgagacggtgagcatgtcatacaccgctggtgtttcagggatataggccagcagacgtttggcctcggtggttttgtttccgtggccaccgatggtaatgtcaccctggaaccggagaagcccggcaatgcacttgatgatggtggattttccagcgccgttgggccccagaagaatggcaatctggccgctgtcaacctggaaactgatatcgtcgttggccagattttttccgtagtattttgtcacgtgattgagcgttagcatagagaatctcctttttgatggtaagtatgcgctgaagaggttacttgctggaaagcattccgcctcggatattggtccggcgaatgagcagccacccgatgagggagaacaaaagaacgacgaccagaaggagcaggattgcaccccacggcgagtgaaagaaggtgtcgcccagagtgagaaacagggtgcgaacagggggaaaaacttcttctgcttttgccagcaaggggggaaagccgatcagagaggccgggatcgccaaggccgcgacaatacagccgaccttgttcagccgccaaaatagaaaggtgaagaagaggccgagggagtaacaggccagcatacaggcagcggaaaagagaatagaggcggtgtgctgaaggaaggtcaggggaagcccctgcttgagatagatcatactaaacagatcagagaactccaactgaaattgggtatggtcagcggcaaactgggccagggacagcagcagttctcccgccagagagaggcagacagcgggcagcaaagcggagagaaaaagactgagaaaggttgtccggcgagagacccccatctgtacgcacaggcgaatggcctggcggggaaggatcagtccaaagaccaagaagaagatggcacaggcaaaaccatatccgttgtatgtgtagccggagcggtccccgctccccaggttgagggataacacgagaaatcctatgccaatgagaagggcattgatggcccaaaagacaaggcagcttaccaggtattctcggagctggtagcgaatggcgggtttaagattcatagacatggtttgcatcctttctctctgtcgtgccgtcctctgcttcctgcagactgatgaagtaatcctgtaagcgcatagagcttcgttccaggccggcaggcaggggttcggtggattcctcctgcaaggtaaccgtcttcaggccgcccagagaatggctggtcaggatctgctttccttcggtgtactgctccaccagcccggcaggaccggagagggtgtaggcggaggtaagcagttcttctgtcggcgcgttgcgcagaatgcgcccttcccgcaggatgatggtgtggtcgatgaggttctccacctcagaaattaggtgggtggacagaagaatggtacaggactgtgccatgaatttttccaccagaagacggtagaagagctcccgatgctgggcatccaggcccaaaaccggctcgtcaaagataacatacggcgtgttgacgctgagccctaagatcaggcgaaaaatggaggagtatccagtggaaagtgccgggatttttttcttgagcgacaggccaaactgtttggccagtccatgggcgcggcgcagatcgaaatcggggtaaaaataggtcatggtgtgcagtgcccgtttgatcttcatgtcttcggggaaaaagttctgctctcccaccatgaaaactttgtgtaaggcggcatcgttgtttcgcacgggctgtccatccacggtcactgtgccttggtcagggagctgacggtcggtcaggatactgagcaaggtgctttttccagcaccgttgttgcccaaaaggccgtagatatgaccgggttccagcgtgagggagacttgatccagggcacgtgtgctcccaaactgttttgtaatgtctttgcattcaatggacatcttgaaatcctctccttatcaagtcggtgagctgtgcgagggtcaagcccagacctttggcctctcggaccattttttccacgtagtcgtgataaaaggcctcggaacgctgttttcgcaggttttcctgggcgccttcggcgacaaacataccaattcctctctttttgtataaaagaccggcattcaccagttgattgatccctttcagcgcggtggcgggattgatcttataggtggcagcgtattctgtgatggagggaacttggctcccctctggataggcgccagagagaatcccgtcctccagctgctccgccaactggagaaaaatcggtttttcaccttggaattgcaaggagacccctcctttccttgagtggttagttagttgactgattaaccataagccgaatatagcagaccgggcgcggcttgtcaagaggggatgtgttcttttccagttttttgcagataaatttatgaaaagtgggagaagcaaccgttgacaagagaaataatatacggtagagttttgaccatcggcaatgccgaagttggaaaagaaagaaggaatcctatatgaagtggctgaaacgaactgccgcagcgggcatgacagcggttatgctgttctcctgccttccggcggccggtgcggtgcaaccgggagaggaactgacccggggagagaccgcgtcgatcctgctggaagcggcaacggattacaacgcggatgtgacctatggagacattctcaaggggtatcccggcggagacctaaacgaggatggcgctgttacccgggcccaggcgctggtgatgctccagcgggcctttggcggtctgcctgagcccaagggagacaacgcccgcagcggctatcccgcggcaaactttacggacatccccgcctgggcgcaggcggagctggaagatgtgctggcatccggcattgtggcgggaaccagtgcaaccaccttttctcccgaccgaaagattacaaaagagcagctggatctcttcctccagcggacctatgccctggagggcagcaacctgaaggatgacttctacgctacggtcaacaaagaggctctggataacagcgtcatccggccgggttatctgggggccagtgctttctatgacttgggcgcaaaggtggacgaggagattgccgggatcattcaggaactggttgacggcggcgccaaaacagaaggggagaagaagatcgtcaacttctaccggaacattctcaataccgaggcacgaaatgcggagggaattgcccccattcagccctacttggatgccattgatcaggcgaaaaccatagaggagctgatggcggttcagaaccgtgtctatgaggagacaggcggaaccctttttatgggctttggcctaaacattgacgtgaaggataacacggcatatacacttctctttgacggaatcacgccttccctggggcagggaggatacagcactgccacgccggagcagaaggcggcctatcagacctatgtccgcaccatgctgactttggtggggcagagtgaggcggctgcgtccgcggcggcggataccatttggcgggtagacgccaaaattgcggcggcgtccttgagcaaccaggaactggcggatgtagacaaaacctataatatttacaccatggagcagctgcaggccatgttcccccgggtggatttggaggcgctttttgcgctgaccggactgacacagaccaaccacattcaggtcatggaccctggaaagctccaggcatgggcggagatctttgatgagagcaaaaccccggacggattggagattctgaagacgtatgcccgtctgtatttggccgcaggttttggtccggcgctgaatgaggaattcacagaagcgggcaacgcatttaatgaggcttacatgggctcttccggtgccctttccctggaggacagtgctgcgcagtatgtccagcaggtgatgagcgactatctcggccaggcctatgtagaccgctatttctccccagaggccaaggcggatgtggagaaaatggttcaggacatcctggcggtttaccgggaccggattgaaacgctggattggatgagcgagaccaccaaggaaaaggccattgaaaagctggacaccatccagattaacattgggtacccggatgactgggacgataccctgaaagatgtggagatcctgtcggcggagcagggaggtagcttctgtgacaacctcattgccatccaaaaaggaaccaacaagctgctggcagagctccagaagaccggggtggatgaaaatatctggccaatgacgacctacacggtcaacgccgggtatctctttaccgccaactccatcaccttccccgcgggcattctgcaggaacctttctatgacgtggatgcttcctatgaggaaaacctggggaaggtaggctatgtcattgcccacgaaattactcatgcctttgacaacaacggggcgaaatacgatgaaaacggcaatgccgtggactggtggacacaggaggattatgcggccttccagacgttgtgtgagaaagtggtcaagctctacgatgggaaggagtccgcaccgggaatcacctgcaatggtgccctgaccctgtctgagaacattgccgatcttggctccgtggcttgcctgaccgagattgaaagtaagcgagagaatcctgactatgccgcgctgtatactgcgatggcagagatttggtgcagcagctatccccgggagactcgactctatctggctcaggcagacgttcacgcgccggataagctgcgcggcagtctggtcctgcaaaacttctcggagttttacgaggcctttgacatcacagaagaggatgccatgtggctgccgccggaagagcgcgtggttatctggtgagggggcggggttgcatggatcagaatctttgctgcctccaggagaaattcatcaaagacctctttgtttccgagggcctgggtgctgtcattgacgaggcgtcctatgggtatgccaggtgctccatggaaattgagccccggcactgcaatgctttgggaatccccatgggagggaccatttttaccttggcggattttgcatttgccgtggcttccaatcaaaagggaagagatgtggtgacccaggcgtctcaaatcacatttctgaaatccgcaaagggaaagcatctgacggcagtggcacagcaggtgaaagatgggaagcgaatttgtttctatgaggtgaaagtcaccgatgagctgggcaccgaagtggcctttgtgacagtgaatggctatgttgtccatgacaacggccggggagagacctaaaaggacaaagaaaagcccccttcttggacaggatattttcctggacaagaagggggctttggtatggaggaagaagaaaggacaggcgattaagagagcaacccgaaggcggccagggtttctcggagttccttgcagggctttttgtccattgcccagagagggcggcggaggcttccgctgtcaaggcccagttccgccatagcagccttgatgggaatgggatttacctgggaaaacagggctttcatcagggggagataggagagctgaagctctcgggcttcctcgatttctccccggaaatagctgtgcgtcagctctgccatgggctctggaaccagattggctgtgacggagatcagcccctttgcgcccagagccaacatggggacggtctggtcgtcattgcccgaccacacattcagctcatctccgcagaaagccatggtttctgccagaagagagaaatttccagaggcttctttggtgccgttgatccggggatgctggcttaaaatacggtaggtctctgcggtaaaggacagtccggtacgggagggcacgttgtagaggatgacgggcaggtctgttttgtctgccagatattcatagtggtggatcaggccggtttgcgtggttttattataatagggggtgaccagaagaagggcgtctgcgccggattcctgggcatgctgacagagatagagcgcggcggcggtgtcgttgctgccggagccggcaaccactttgcaccggcctgctacgtgggacacgcagtaatccaccagatggacatgttcctgcacagtgagggtggaactttcccctgtggtgccgcagacacacagcgcgtccacgccggattccagctgacggtccatctgccgggcaaaggcggcatagtcgatggaaccagaggcctgaaagggggtaatcaaagcggtacaggtgccagtgaacacaggtgttttcataaagactcctttccagataacaaaaacgtaaaaaagcacggaccagattgatttctgaagaaatgctttcgtaacagaatatcaatctggtccgtgctttgagagatgaattctctcagcggggaagaatgtagccttccgcgcagagcagttccgccagcagaacgccgccgccggccgcgccgcggagggtattgtgggacaagccgacaaatttatagtcgtactgggtatccggacggagacggcccaagctgaccgccatgccgccctcaaggtcccggtccagcttggcctggggccggtcgttttcctcaaaataatgaaggaactgtttgggggcgctggggagagccagttcttgggcacggccctggaagtttttccatacagttttaatttcctccaccgagggcttttcacggaaggagacaaacacagcggcggtatggccatccgatacaggcacccgtaggcactgggcggtgatggaaggggcggcggcggggacaatctgcccatgttccacggtgccccagacctttaagggctcctgttccgacttttcctcctctccaccgatgtagggaatgacgttgtcaaccatctcaggccaggttgtaaaggtttttcccgctccagagatggcttgataggtacagaccagtacctgtgttatgccgaagcggcgcaggggatgtagcgcgggggcgtaggattgaatggaacagttggacttcaccgcaatgaaaccgcgccgggttcccagccgggatttttgggcctggattacctggagatgctctggattgacctctggaatgaccatggggacatcgggggtccaacggtgggcactgttgttggaaataaccgggcattccaacttggcataggattcttccagggcacgaatttcttcctttttcatgtcaacggcacagaaaatgaagtcgacggaggacgcaatggtttctcggtctgccagtgcatccaggaccaccagggacttggcttcctcagggatcggggtggtcatggcccagcggggaccgacagcctcttcataagattttccagcggaacgggcactggccgccacgacagtcagctgaaaccagggatggttttccagcagggtcacaaaacgctggcccaccatcccagtggcaccgacgacaccgacagtatactttttcatgagaaggacctcctgatcttgttgaaactacctgaaaacagcccgttctgctgggaagtgagaaacagcagttgaaaagctgatggtatttgtactataataaactgtattttgtctcttagaagaacagagtgtttttgagaaagagacagatgtttgcttagtaaagatagcacagattatttttgctgtcaacgcccaaagtccttcccggggaaaaaatgtcgtggaaccgtgaaaatcgggtctttggaaacagtctcaccatgggtttccggtccatactatgccgggcgaggcggttttgtcaccgagacggctgacggcagaaggttcagttgatgtaatggagatggatggctattaaaacacacgatttttactatgaattaccccctgaactcattgcacaaacgccgatccaacgtcgggacgcctcccggctgctgacgttggacaagaggacgggggagatcggacaccatcatttttatgatttgcctcaatttcttcggccaggggactgtttggtcctcaacgattcccgggtgctgccggcccgtttgctgggcagacgggagcccacagggggagcctgcgaggtggtgcttctcattgaccggggagaaaatgtctgggagtgtctggtccggcctggaaaaaaactgcgggagggggcgaagctgtctttcggggatggcgccctgaccgcagaggtgaccgctgtgttggaagggggaaaccggctgatccgctttacctatgagggtatttttttggaattactggagcggctggggaagatgccgttgccgccctatatcaaagaagaactccaggatgccgaacggtatcagacggtctattctcgggaggttggctctgcggcagcccctacggcgggcctgcattttaccaaagatctgctggattccattgaaaaaatgggggtaaaaatctgctatgtgacgctccacgtggggttgggaacctttcgcccagtaaaagcggaggagattacggaccatgctatgcacagcgagtattgtgtcatttctgcggagacagcggaaaccatcaaccaaaccaagcgggatggaggacgggtgatctgtgtgggaacgacgtcctgcaggaccattgagagctgggcagaagaggatggcacactgcgggagagcgcgggatggacgaatatttttatttaccctggctatcggttcaaggtactggatgggctgattaccaatttccatctgccggaatccaccctcattatgctggtttccgcattggctggacgggaacccattttagcggcctatgaggaagcggtccgggaacgctatcgctttttttcctttggagatgcgatgctgattgtgtgagagaacctgcggagaagggcctgcaaaatggcggtatttagcttgccgtttatgccctgggtcagggccttttcggtttctcatgctgcatgttctgagcttggatgaaaaggcctctttgtaagttttacagctgctttttattaaatgcgctgattgccgccactaaaaataccacggacaaaaccacggagatgataaagggaaccgtaaattccgttatggaaatctttcctgaaatcaggtcaacatttcgtgaggcaaggacaatcgggttcagggcggacaatggtctcaccatactgaaaatggaaaaaagggctacgatcccgccagtgaataggatgctggtgaaagtctgcttgaataggacacagccaagtatgagaatgctaaggtatagaaatccaatcatccacatgaaaaacgcagacggtacgatataggaaagagaagtatctggccaaagatgatcggtatatccataggcaccgacaaagctcacccagaaactgaccgtcatagacacagccgctacggtgtactttgtcaaaatcactgccggtcttgccagaccctttgttaccagcagaagcaaagtgcctttggaatactcactggacatacagcttccgaacaggataatcaatgcgctgaatccgaccccagaaatatttttataaaactgctgccatgcgtcaagggcgacaggttcctcggtggcttcgaatccagctcccagagcctctataatctctggtgtgaattttgccagaaatgcactggacaacccgaaaatcgcaaagatagtaaacaggataaaaaagcgatagtttttaagattttctacaaactccttttttataaacgcaatataccctttcattttatcacctccaaaaacaagctttcaagggacggttccatgagtgccaccttgaccggcgcaagatctgcctcggccaaagtggaaaaaatagtatgctgagcctttttcatctcccggctgtgtatgatcatttcccgccccttttcttctgatccaatcagaagcggttgcttcgccatagaagccttgaactgttgcaggtcggcttcgctggagaattcgatcagtaagctgtcatggctatgtagcgcctttatctctgaaagcgttccgccaacagcaatataaccatcattcaaaagtgccacatggtcgcaaatacgttccacatcggacaaaatatgcgtcgaaaacaaaaccgttgttgtcccacggattttgtagagaatatccaagatttcttttcttcccaccggatcaagggcactggtaggttcatcacaaatcagcagtttggggtcggccagcaacgcttgtgcaattccaagacgctgcttcatgccgcgggaatagccgccgatccgtttctcaacgccatccagaccgacaagggaaagtagcctttgtcctttttgagaaatgattttttttgacaacccgacaatttccccgcacagtgttaaatactgtatggcggtcatgtagttgtaaaattccggcacatctggtaaatagccaatatactgattggttttggtctgtccaaagcgaactggctcattacacacgcggatttctccctcatcaggctgcaaaagtcctaataccattttcattgttgttgtttttccggcgccgttctgtccaataaagccaaagacacttccctctggaacagacagattcagattttttataattttctgctctccgaaacttttagacagattgcatatagaaagtacattcatttttcctcaccccgcccaaaaacaaaatagataataggaccgaacataacaacaaccagagagagtacaagccacatggccctgttcccaaaacgataatgtggatgccagaggatatgccggacagcggccacagcaaggattacatcaagcacaaaaatgggaatcagaagcggaaacatttcctgcaacaaagacatactaattacctccttagtcgtaactcgtatctgtatttacgggacaacggtgtttttttgcttgttactcccatataggatatattaccgcaatggaaataaaaaagcaatattactccttgaatttttgtttccagaatggtaatatttttgtaaaaggaggttgcatatgggaagcaagaacttgaatgagaaaattatggaatgtatttccaatccggccaagagccgtttgatgatcgaaatcatgcggcgggggaaagtgaccgcaaagtatctggctgaaaagtgcgtggatatcccccaaacgacgctttatcgctatttgaaacgaatgaccgatgatgggctattgaaaattgtgggcgaaacaccaatacgaggaacagttgaaaagacttatgcattgacctttgacccgtctgatccaccgtcggttctcggacaaaattctggggctatgtatatgcagatgttctttcaatattttttgacgtttgcaaagattttccaagattattgtgacacaccaggtattgacataaaaaaggatcggtctggtcttagcctttcccatgtttatttaacggatgaagagctggaaaaagtagcagcagatatggcccaaatcttatatccgctgcaagagaataaaccaaagccggaacgtaaattgagaacagttgggttgattatctccccggaacataaaacaggcgaaacggggacggactggtagcaaagtgccaacgcatttaacatcacaaagcgtgttgatgctttattttcatattgactttcagaaaaaagtttgctattataaataagtaaatgcggtgtaggggaagagcccttgcaccgctcattttttccaaaaggccatgttcattttgtaaaacaaggaggattctgcgttgtttacgctgttgaaaaccgaaggccgcgcccgacgcgggcaattgacctgtgcccatggcaccgcgcaaacgcccgtgtttatgaacgtgggaacgcaaggggcaattaaaggcgcggtgtctgctcaggatctgcgggaaattggctgtcagattgagctctccaatacgtatcatctccatttgcgcccaggggatgaactggtgaaggagatgggggggcttcaccgctttatgcgttgggacggcccgattctcacagacagtggggggttccaagtcttttctctgtccgggaggcggaagattcaggaggaaggggtcacctttgcctcccacattgatgggcgccgtatctttatggggccggaggagagtatacagattcaatggaacctgggttcggacattgccatggcgtttgatgagtgtgtggagaatcctgcgccctatgcgtatgtgaaacagtcctgtgaacgaacctttcgttggctggagcgatgcaaaacggagcatgcgcgtctcaagcagctggcagatggggtcaacccgcagcagatgctgtttggcatcaatcagggagggatcctcccggacctgcgcgtctggcacatgcagcagattgcctctttagactgcgatggatatgccattggaggcttggcggtgggggagccggcggagaccatgtatgaaatcatcgaggccgtagaaccctatatgcctgcggagaaaccacggtatttgatgggggtgggaaccccggtgaatattctggaaggcgtggcccggggcgttgacatgtttgactgcgtgcttccagccagaaacgcacggcatggaaagctgtacacttggaacggagccatgaacatcaaaaatgagaagtacaagcgggatgaacaacccattgacccggcatgccgctgtcctgtctgccggtctttttccagggcttacctccgccacctgtttgcagcaggggagatgctggccatgcggctggccgttcttcataatttgtatttttacaatgcactgatggacaggattcgcctggcgctggaggaaggtacttttgaagctttctatcgggaatacagagaaaaattaggcgcacgaatgtaatatagaaaaagtaacagggaaacaaaaaaatacttgtcaaatggagaaaactcttctataataaagagaaagtttatttttacagcggagggaatcaccttggaaattttgattatcgtcctcattgttttctatatcgttattttctatttcttgaaaatgcgccctgagaagcagcggaagaaagagatggaggcgatgaagcgatctctggcacctggtgacgcagtcaccatgattgacggcattgttggaaatatctgtgccgtgaaagaaaagacgattgtcattgagaccggcgcagaccgtgttcgtctggagtatgcgaactgggccattatgaacaagggcgtggcggttgaccaggcccagcagtaaaagaatcacagcatagaacgctccctccccgcatagaatccatcacagattctcttcggggagggatttttatggttaaaaacggggaagaaaccgccaaaaaagaggggaagacgacaggaaatgtcttacctgttttactgggaacggggacaggattggttttgcttctgctgctgactctgctggcggcgggcctgatttggagcggtgttttacctgtctccattgcgggaatgagtctgaccattgcggcggggctttgcgccttggtgggaggccgagttgcggtgaacaggggaagtgggggatccctgcccatgggaagcgcagcaggaggccttctttgcctcatcttgggattggtctgcctgggaaccactggaaccgaggggtttcatgggcagtttgtgggaatcctactgatgacattggctggaggctgtttggctgggctaatggggaagaagaagcggaagaaaaagaagcgataaaaaatgatgaagattgcaaaaaaagcggagcgggctttggaccggaaaaaagaaacggaacaaaaaaatcgagacacagtactgttgattctttccgttggattcttggtcgggggcgtattggggtgcctgctggagggaaaactgtccacagagcattatatcggtcagtttttccagcaggcagcacaaatgtccattgcgccgtctctgtggcgtgaagtttggatcgtattccgctggcccgtggcggtgatcctgttgagccagttgccactggccggtgtgacaatcccagtggtgttttttctccgaggctttttcctctcctatggcattgtggctttgatggagggaatggggctctctggtgttctgtgtgctggtgtggtgtttgggccaacctgtctgttggctgtgccggtactatttgtgctgggaaccacaggtctgctgcggaaggcggaaagtcagccgaagggcattccgtttttccgccgtatggtagccagcctgctggttttggcactctgcgtgtttttggatcaggcagtggttcctaagctcctggggattctgctgaaagcattgaccatggtctctggctaaatgtgcggagctctgtctgaaaagatgtgtattcctttccagttcctcttgtattttggaaaagagaagtatataataaatctattccttatgatggtgtgctcccaaaagggagcatgctttttaagaaaataacttcgcataatgtagattttgcgaagttaaagacgtgagagaaaggaacgcaaatctatggcaaagtattggcaggagtcacctcccattttacaggagtttttgaattaccatgcgtctatcctctcccattccgccaaaacagtggatgagtattttttggatctacgcagcttctttcgttatctaaaagtacggcggaaccctgcattggcccaaacgccgttttcggaaatttcaattttagatgtggacttggaatttgtctctcagacgcagctgtcagaaatctatggttttttaacctttctctccggcggcgctccagctggaaaagcggaatcttctacaagagcgagaaaatgcgcgtccattcgatccttctatcactatctctgcgtccatgcccatcaaatggaacaggaccccacccagtctttgaataatccgaagctaaggaaaacactgccccgctatttatccctgtcagaaagcattcagttgctggaggccgtatccggccccaatgaggttcgggactactgtatccttactctgtttctcaactgtggcctgcgtgtaggagaactggtgggtttgaatgtacaggatattcgagaggacacggttcgagtgttaggaaaaggaaacaaggaacggcagctctacctcaatgaagcatgtttagatgccatacaagcctatttggtggttcgtccagagccgaaggaggagttccgccataaaaacgcattgtttgtctcccgcaataaaacacggcttaccacccgagccgtagagaatattgtacagaaagcggtgcggcaggcggggttggaccccaaatattcaccgcataaactgcgccacacagcagctacactgatgctgaaccacggtgtggacattcggacccttcaggacgttttaggccatgagaatttggggacaacacagatttacacccatatatcagatgccaatatgaagcaggctgtggaagccaatcccctgtcccgcgtgaagaagcgagaggagtaacttattccagaatgtgatccaagccctgggcaaaaatagttcgaacgtggtcatctgccagggcataatataccatcttcccttctcgacggggctttaccagccgggcctgctttagaatccggagctggtgcgagatggcggacatggtcatgccgagcagccgcgcaatatcccctacgccccgctcttctgtaaagagggtgtagagaattttgattcgggtgctatccccaaaaattttatagagctctgccaagtcatccagaagttccgcattgggcgacaactgctccggcaacgggacggaggtgagatcatggtggtgcacagtggaaccctcctctaccattgattgaatgattgctcaatgatggatagtatatacccaatggaaaaaaagtcaagaatgagagagaaatccgtatgttttccggggaacatacggatttcttttctcatgcctgcagtttttcctggagctcggataagctgagaactggaatgcctaaggattctgccttggtcaatttgctgccggcattgtcccccgccagtaagaaagcagtttttttggagacgctgctggttacctttcccccgtggctctggatcagctgcgtggcttcttcccggctcatatctggcagtgttccagagatgacaacggtctgcccggaaagggacaggtcctcctggggaagcgttacaatatcctgctccatattgacaccggcgtcctttaacttttgcagaaccttttggttgtgcgcttctcggaagtatgcatagacgcactgggcagagattgggccaatgtcgtccacagccatcaaatcttcttcctgcgcgtgagagagtgcgtcaaaggagccaaagtgattcatgaggacctgggcggcggatttccccacattggagattccaaggcctgtcagaaggcgatctggtgagtttcgtttggctttttcaatatttcccaagagtttgtcggtgtttttctccttgccaatgatcccctgttcaatcagctcctcccggtgctgagagagggtgaagatatctgccacatcggtaagatatcctttctcaatgagatcgtgaatatagaccacaccaaaccctttgatatccatggcactgcggccgacaaagtgaccaatcagccgttccagctgggcagggcagttaaggttaacacatttgatgtctgcggtggcttcccggacagcgggtttcccacatacagggcaaaccatgggaatttggaacggacgagccgcagcgggctgtttatccgggactacccccacgcatttggggatcacttcgccggatttttcaatgagcaaggtggaacccaggcggatgtccaggctggagataaaatcctggttgtggagcgtacatcgggaaactgtggtaccgcacaggcgaacaggatcaaacacagcggtaggcgtgatttttccggttctgccgacggacagttcaatttgccgcagcctggtttctttccgttctggagggtatttataggcgacttgataccccgcatttttggcggtgtctttcagctgcgcccgtaaagcgagttcgttgaccttgaccacggcaccgtcaatatcataaggtaaggtaccccgcatatccccaatggcttcaatggcccgccagacttcttctgaggttttgcagacaaagcggtgggcaatgacggtaacaccgcagtcctccagaaactcgtaagcctcctggtgggtggataggtcctttccctggatatcctgaatattgaacacaaaaaaggagagatgccgttctttggtaatagaggcgtccagctggcgcagggtgccggcggcacagttgcggggattggcaaatggctttttccccaataactcctgcttctcgttgacggcttcaaaggcggcattggtcatatagacctctccccgcagctccaaataggcaatgggatgccggagggtgacggcgacatcgtcaatgactttggcgttggcggtgacatcctcaccgaaatttctgccatccccccgggtgatggccgtgaccaattttccgtcttcatagcgcaatgccatggagagaccgtcaattttggtctcgaccaaaaaggtgatcccctcccctaacttctcccggcaatcgtccatgaaatggtcaacctcttctcgggtaaaaagatcctgcatcgacagcatgggaacccggtgggcgaccaggacaccagccgtccgtttggcggttccccccaccttttgggtgggagaatccgggacgatcagttcgggatgggaggactcgagcatcttaagctcccgcatgagagcgtcgtattcctggtctgaaatggtgggggcatcttcattgtaatagaggttactgtggtgattcaacagggcgcgaagctcctctgctcgtttggatgcgtccatggtccaaggtctcctttgcaacagtataccgatattatttattatttccgcaaaagcgcgtccgcagccagtagaatgcctaattttccagattcataggtcaggccgccctgcaaatagactgtgtaaggagggcgcatgggggcatcagcggacagttcaatggaagcgccctgaatgaaagcaccggcggccatgatgaccgggcaatcgtaaccgggcatatcccagggaacgggcgtaacataggagtctacaggtgcgccggactgaatgccatggcagaaccgttccactgcttccggggtttccaagtggatcatttggataatgtcgtggcggatctcctgagacataggatcagtacggtagcccagcaattccatgaccttggcggcaaacaccgcagttttggtggcctgtgccaccgtgtgcggggccaggaagagcccttgataaagcgcacggttgttccccaacgaggcaccacattcccggccaatcccgggtactgtcatccgcgtggcggcgcattctaccaaatcccggcgcccggctacatatcctcccataggagccagaccgccgcccggatttttaatgagtgaccccataatcaagtcggcgccgacttgtgtgggctcggtggtctccacaaattcgccgtagcagttgtctactaaaatgtagacatgggggttgtgggaccggatgacttggcagatttctccgatgcgtgccacagagagggaggcccgagtggcgtatccgcgggaacgttggataagaactgcttttactgcagggtcctggactgcctgggcaatcccaggcaagtcaggggtgttttccggggtcaaatccacctggcggtaggtgatcccgaattctttgagagaaccgttgccatctccagtgatcccaatgacgccttgcaaggtatcataaggggcaccaatggcggagaccagcacatcccccgggcgcagaaccccgtatagagcagacgagattgcatgggttccgttgacaaagttgatacgaaccatggcgtcctctgcgccaaaaagatcggcgtagatggccccgagggtttcccggccaaggtcatcataaccgtagccagtggttccctggaacatagattccgccactttgtgtgtttggaaggcggagagaactttttgtgtattgtattccgcgatggcgtcaatgcgggcaaactgctctgacaatgcgtcctgtgcttgtgcacctaacgcacgaacgcggtcgcttatctgtaaaggcattttacattacatcctttgaaatttatagttttttctgggcgaacgctgtcataagacgcacggtggcagtgacgtcggacaggtctaccatctccacgggagagtggaggtaccgacagggaatggagatgccgccagtgcggacaccctcccgtgcaacatggatcgagccggcatctgttccgccggaaacgatgacatcacgctggaaagggattttactttccatagcaagtgtttcaaggagttttatgacatctggatgacaaattacggaactgtccataatcttcaccgcggctccgtcgcccaggatagagcttcccttttggggatcatcccaggtctctccgactgtgacatccacagcaatgccgtagtcaggatcaatggagtaggcagcgggcttgcttccgcggagccccaattcttcctgtacagtaaagacaaagtacaagtcgttggtgtacgcccggatatggctcaaagcatccagcatggcggcacaggaaattcgattgtccagatagggagagactaacttggtctctgtggtaaaggagggcatccgggaaacagcggtatcccctacctgaaccaggcggcgggcatgcgcttcgtttttggcgccaatgtctaagtacaggtcttggatcgtcatgtctttgagagagacaccaggacggagtgcgaccacgccgcacacgccgtttttgaaacggaatggtgtgtgcaggatactttccggatggacgccccccaattttccaaaggagagatagccctctttgtggatgtgcgtgacaatcaggccgatggaatccatatgcgcggcaaacatgaccttgggtccgggaccttttttatggacaatgagattgcccagggtgtcgatgtggcacgtatcggcgtatggttccgccagacgctttaaggtggtggcgatctgccgttcatctcctgatggcccatggcaagcgttgagcatttcaataacagaaagatagtccatatattttctccttattccattgtggctacggcctgtaaaaagcggcgggccagaatgaggatgttctggcagtcctccagggaagcgacactggagggggtgtgaagataccgcacagcggcggaaatggccgccacccgcaccccttccttggtacgctgtatggcagaggcgtcagttccaccggagagaaattctttggtttgccagggaatgtggccgcgttctgctaaggtgcggagaagctcaaatagttctcggtcataaacggtgcccccatccatatagggaaccacaggcccctttccaggcaggcataccttctggtgactctccatctccggcaggtcggcggcggtggttccctctaaaatcagggcaatgtcaggggtgacagaaaaggcggccccaaaagcccctctggttccaacttcttcttgcacggtaaatacaaaggtacagtccatgggaagaggttctttcaaaagctctaccataacagtgcagccgatgcggtcatcaatggctttagctttcagaaagccatggccaaattctaagatatctgtgtcgaaacacacgatatctccgggggagacatggcggagggcctcttccctgctgtcagccccgatgtcaatgtaaaactccgtcagcttagggatggatcttgcctcttccccgctggtcagatggtatgcttttaggccaatgaccccgggcagtttctgctttcccaccaggaccggttttccgagcagaacacggcggtcgattccaccgaccggacggaatttgaggtatccgtcctctgtaatggtgtggaccatcagcccaacttcgtccatgtgggcggccaacatcactttttttgtgccagggcttaccccttttttctcaataattaaattacccagggtgtctgtataggaccggtcagcgtagggggcggtgattgcgcggatgtaatcccgtacggcgtcttcacagctggacacaccggggagggcacagagctctttcaaggtctcagtcagcaagaaattcccctccttctcgtgccaggtcctggacgaaagcagccagcagggcggcggagtgctctaagtcatccaggtccagggtttctaccgggctgtgcatatatttcagcgggagggagaccactgctgtggcgataccctctcgggcaacctgtacccgccaggcgttggttccactgtgcccggtcatcacttcaggggaccagggaatgccccgcgcctctgcttttgtgatgagacggtctgtcatccaacgggtcatattggggccgatgccaatgactgttcccccgccagcgggaaaagtttcttccttgggagaatcgggggtacgggcgtgggtgacatccacggcgataaaacagtggggcgcaagagaaaaggcgccgaccacggccccgccgccgttggtttcctctcggctgctgcccataagatacagatcgacatccaaaggggtgtcccgaagcagttcagcggcccgcagaagagtgacaaagcccgcacggtcatccaatgctttgctgctgacgcggcgtcccagaagggcgcgaaaaggttctctgggcacaacaaaggttcccaccagagcttccccctctttctgggtcagtccggcgtcaatatacagacccgacaatggagtgctccggttggagtcgcctgccttttgaacatggggaggcaggacagccacaagaccaaactgggggggctgggagaggatgatgacttcccggttgggaagcatccgagggtctaccccaccaacagggcgaaagcggagaaagccgtctttggcgccggtgatcaccaggccaacctcatccaagtgggcgtccagcaccacccgtttggcgttttccgtgccgcaacgccgaatcccaatcacatttccgaaacgatctttcttcacttcatccatcaggggacgtagcagttccatcgcttggctggccacggcgtcctcccttccagaggggccggggcagctgcaaagtgcttctaagcttgcttgaatatccatgggaacctccctcacagcccattgacgatggccttgaaggtttggccgcgctgggcaaagtttttgaagtggtcaaaggaggcacaggctggagagagcagaaccacatccccatcttccgccatacgggaggctgtcagcacggcctgagagaaatcctcttccatgacaatggtaggctggcccttctgatacccttgtgaagagagtacagcctgacggattttatctgctgtatgacccgttagaatcaaggttttcacatggtcttgcaccgcctgacccagtacatcaaagggaatctttttgtcatagccgccggcaatgaggatgaccttttgggggaaggaacggagaccggcaatggtgcgggtcgggctggaggcaatggaatcgttgtaataccggacgccgtgcagagtacggaccaattcaatccggtgctccacgccggggaaggtctctgccgtgtgaaggatcacatcgtcggggaccaacccttgtacggcggcgatggcggccagatagttttccacattgtgttctccgggaatcaaaatccggtctgtggagaagagaggccgtttttttccattttgtgcgaccacaatggtgccgttgtcgacaaagacgccctcctccaaagaggtgcggcggctgaactgcaggacccttccaggcgcccggcagaccatggcgtgggtcaggtcattgtcccggttgaagatggccaagtcattttctccctgatgggagaagatgttctcctttgccagggcatattcttccatggacttatgaatatccaaatggttgggggacagattggtaaaaaccgcaatatccggactggcagagagcgtcatcagctggaaagaagagagctccaaaaccgcgatatcgtctggagatatgctgccggcttccgagaggagcggttttccaatatttcctcccagatggacggtatagccggcattcttcagcatttcggcgatgagggtggttgtggtggtctttccgtcgctgccagtgacagcgatgattttacagggacagacctgaaaaaaaacctccatttcagaggttagcgcacttcccttttccatggcggacagaaacggtggaatatcgggacgaattcccggagagcggaaaatgacatcctggtcgagaccatccagataggcatcccccagatgaagcactgcacccatggactccaactcgtcagccagggcaccgaatgctgtgcggggggctttgtcacaggcggtaacggaaatccccgcctgaagcaaggtcttgataagcggcgtattggaaaccccaatgccgatgacagcgacgcgttttccctgaagagaggtaagatagtcttgcagtgtaatggccatgtgcgtttcctcctaattgattgagagcagcttgctcagtctatggacttaaaacggtaaaagaatccgctgcgcggtgttctggcgttgcaaatgaaaaatagacacttcattatacgccgaagcggtaggaatttcaagaaatccttctgtgagaatcacaagaaaaggaagtatgggtttgcgctcccctctgagaagtatgtggagaattagcaaaaattaaagaaggttttttgtaaaattgacagccgtatcaggtgttctggaaagggcccgtttgtcagcttttctaaatgattcttaagtacaaatggagcgggtgtgcaaagtcatgacggaaggaaaaagaacgcttgaaaagtttcttcctttatggtattttatataataactataaaaaaattctgcggaaagggaggcccttttatgcacttacaagaatctggagaaatgtacttggagaccatcctgatcctttcaaagagcggcaaagatgtgcgctctgtggatgtgagcgaatatatgggcttttctaagcccagtgtcagccgtgccattggcctgctcaagtcaggcggttatgtgacaatggacaagggaggacacctggagctgacagaagaggggcgtgcagtggctgagaatatttatgaaaagcacaccttgctggcacaatttctaatgaccctgggcgtggatgaggccactgccacggaggatgcctgcaaaatggaacacgtgatcagcgatacctcgtttaaggcccttaaaaagcacgcaggaatggaatgatgatagaaaaaagctccggtctcggatttcgagaccggagttcctttttggcatactggtttcctatgagagagaaggcagttacaggtcataatacatggcgaactctgcgggggtgggctgacggtcaatttcttccagttctgcccgctttttttcgatccaaatctcaagcaggcggggaggaaatacaccgccttgggttaggtagtcgtgatctgcctccagtgcatccaaggcctcccccaaggacttcggcaggctgtcaatttgcgctttctcctggtctgagagagtataaaggttaaagtcatagggcccccaccctctttcatggggatcaatgcggttttgaatcccatccagtcccgccatcagaatggcagcgaaggcgtaataggggttgcaggtggcgtccgggttccttagctcgaaccgcttgtttttgggggctttggcgtaagcgggaatccgaacgacagcactgcgattggccatggcgtacccgatggtgacgggcgcttcaaagccggggaccagtctcttataggaattggtggagggattggtgatggcacacagggaggccgcatgctccagcataccgccgatgaaccaaagcgccgtttggctcagctgtgcgtagcctgtttcatcatagaagatgggcttaccttctttgaataagtgcatatgcacatgcattccgctgccggcctcccctgccactggcttgggcagaaaggtggcggtgcgtccttcttgagcggcggcatttttgataatgtacttcgcgaccatggtgttgtctgccatctgggtcatctctcccagttccacctcaatctccatttggccgcagccgcccacttccgggtgatggtatttgactttcacaccccactcctccattaggagacagatacggtttcgcaggtcctgtgtgacatccatgggaaggctggtgtgatatcccccttttctggggacctgatatccgttgttttctgtgctccatgcggcctgccgtgcggagatggagaagctggcatgttgaggctgggtggtgtaggatacctggtcgaagatataaaattcatattcaggccctacgatcatctcgtctgcgatccccaactcttgcatatagccaatggcccgtttggccacattccggggatattggtcaaagggccggttggccggacgatcaatgatcatcacgtctccgatcatggtgagggtgggaacctctgcaaagggatcaactgtggcagaatccaggtcgggcacgaaaaccatgtcgctgctctccaccggggcatagccgtaattggagccgtcgaatccaatcccgtactgcatagtctcctcgttgagccggccgacaggaatactgagatggcgccatcttccgtcaatgtcagtcattttgaaatcgacaatttgaatgtctttctcttggcaaagatctaaaatctcctgcagtgtctttcccatggaggggcctcctttgtgataaaataacccgagtggttacaggtgatattctcgcttggaactttttcaagataccgatttttggaacaaatgtcaagaaaagaaacgatgtttctgtggggtaccaaatgatatgttattaaaaataagataaaattagaaaaggccagagattggaacgatatcgtcccaatctctggccttttagaaggaggagaaattattgaatgaaggttacagggtagtcttgggcttccactgcgtttttcagaacatcatctgttacatcctcagaaagtgtcaccacggcagttcctgcctcatggctgaccttggcctgttccacggcatccagtgcttccagtgccttcttcacgcgggcttcacagtgggtgcacatcatgccttcgatcttcattgttttttccatggtacgttgctcctttacagtgattgaaatggatttgatctttttatccttgctcccgtcgtgcatgcggaaaagattcagacgcagagcattggtgacaacacagaaactggacaaactcatggcggctgctccgaacatggggttcagcgtcaaaccaaggggaataaaaacgccggcggccaaggggatgccgatggtattgtaaagaaaggcccagaacagattctggtgaatgttccgaagggtggcccggctgagccggatggcggcgggaacatcacgcaggcggcttttcatgaggacaacgtcagccgcgtcaatggccacgtcggtccccgcgccaatggcgatcccaatgtccgcccgggtgagcgcgggagcatcgttgataccgtcccccaccatagtgaccttcccctgctctttcagctgccggatgacacgctctttcccatcgggcaggacgccggcgattacgtgattgacgccagcctcttttccgatggcttgcgctgtgcgtgcattgtctcctgtcagcatcacgacttgaatccccatggactgtaattcttgaatggcctgggggctgtcctctttgatgacatccgccacggcgatgatgccggtcaggtgaccatcttgggcaaaaaataagggggtttttccagcttgtgccagggtctccccctgtatccgcatagattccgggacttgggactggcggctgataaaggtatagttcccaccctgaaggagcgtgccctgccaggtagcggtgaggccattgccgggaagcacctggaaatccgagacaggttcaggggacaggtttcgttcttctgcccggtggagaatggcccgggccaagggatgttcgctcttttgctccaaggcaaatgccaggcgcagaagttcctcttcttggacaccgggagctgggatcagatctgtgaccttgggctctcccgaggtgatggtgccggttttatccagaacgacaatctgcgtttttccggcgttttccaaggatatagcgttcttaaaaagaattccgtgcttggcgcccattccgttgcccaccataatggccacaggggtggcaaggcccagagcacaagggcaggagatcaccagcacagagattccgcgggccagagcaaaaccgatttcctgccccaaaagcagccagacaatggtggtaaaaacggcaatggtgatgactgccgggacaaagatgccagagactttatccgcaatcttggcaatgggcgccttggtggccgcagcatcactgaccatttgaatgatttgagaaagtgtggtgtcctcccccacccgagttgcctggcaggtcaaaaatcctgattggttgagcgtggcggcggagaccaaatcaccggttgttttatccacaggaatgctttccccggtaagggcagattcgttgactgcgctgctgccctctatgacgacaccatctacggggatgttctcccctggccggaccacaaagacgtcgtcctttttgacttgctcgatggggacagtgatctctgtgccgtcccgtagaagggtggcagttttgggggccagcttcatgagccccttgagtgcgtctgtggtccgtcctttggaacgggcttccagcatttttcccacagtgatcagcgtcagaatcatggccgcggattcaaaatagaactccatcatgtaatccgcaacagcggccatgtcgccagctgcctgcgcagcggtcatggcgaagagcgcataggtgctgtaaacaaaggcggcggtggcgcccaaggcaaccagtgtgtccatgttgggagcccgatgccaaaggctcttgtacccgctgatgaaaaacttctggttgatgaccatgaccactgcggttagcagcagctgggtcaagcccatggcgatgtggtttccgtgataaaaggcggggactggccatccccacatcatgtgtcccatggagaaatacatgaggatgaccaagaaaacaagggaccagatgagacgccgtttcagcacgggtgtgtcatggtctgcgagggcgtcttctgtctcagcagtatgatttgcgctggcagctgcgctgcccttctcggaggcaccgtatccagcgttttctaccgcgtggataatatcctggggagaagcagtgccttccacccccatggagttggttaaaaggctgacggaacaggccgtcacgccaggtactttggataccgctttttctacccgggcgctgcaggcggcgcagctcatgccggttacattgaattgttccatcgcgtcgacccctttctggtttgtgcggtcaaaattaggatttccctggaggggggcacttatttcatcagtttttgcagggtgagcaccagctcatcaatgacatcctctttgccatcccgaatgtctgtcactacacaggtgcggatgtgattggccagaaggtcccggttaaaggcgttcatggcggcggagactgccgctgactgtaccaagatgtccgtacaataggcgtttttttctaccattccccggatgccccgaatttgtccttcgatccggctgaggcgattgagaagctttttgacttcctcttccgtgcgttccttggtcttatggcagcagcaagttttatcttccatctgcagtacctccttgtaaatacccccaaggggtattttgataatataccccttgggggtatttgtcaacggttttttgctcctttccatgagaaaacagagcggcacgttctccgctctgttttttcctgatcctgtttgcaaaacccttgtgccagattaggaacttcttggctgagtcaatggaagggttacggtaaaggtaatccgttctttggcgctttgggcacggatgatgccgttgtgccgttctacgatctccttggcaatggcaagccccaagccagcgccgccggaagaactggaacgagaggaatccaaccgaaaaaactgttcaaagatttgatccaatttgtcctgaggaatggtacggccttggttttccacagagacgatgacggcgtccttctctttaagcatggtgacgccaataggggtgtttggattgctgtaattgacggcgttacgtaaaaggttatcgaaaacacgttctaatttttctggatcacaggctaagataacatcgggcgtgaattgaagggacagggaaaggcccttttcagccaagatgggctgaaactcgaaggtcacctgctccaatagccgggtgagatttacttcttccaggcgcagagagagctgcgttaggttaaagcgagtaatttcgaaaaattcattgatcagtgcctccagccgttccgctttttccaaggcgatcccggtgtatttggcgcgcatttccggggagatctgcggctcatcccgaagaagggagagatagccgatgacgctggtaagaggggtcttcagatcgtgggcgagatagacgatcagatcgttttttctctgctctgcctctttggcgtacatggcactgcgcagggcaccttcccggacgatgttcaactcatcctgaatactctccagaggaggcgaaagccggatcggagtgtctgcggggtgagccagttcttcggctgcttcaatgacttcatccaagtagtccaagggtttggagatggaacggtaagtgagaagaaagacacccagaagaaccacgccgcttccccagaacatggcggtgtcctccaaggctttgagaaggcggtacaggggctcatggggctgccaaatgaaaagacggcaaaacacccatcccaggaaaaacagcagtaccagccccccaatcatcccgaggacactgaatacataccggatcagaatttgttgggagatctggttatggcgtttccggcggggcggccataggagtcgacgcttactcaatggtataccccaccccccaaacggttttgatgaactttggtttccggctgggctccttcattttctcccgcaagcgggcgatgtgtgccatgaccgtattgtttccatccatgtatttttctttccagactgcttcaaacaactcttccgaggagacgactttcccacggtgctcacagagataccagagaatgttaaactcaatgggggtgagggtgaggtcttctccgttgagggtacactggtggctatcctgacagatgaacaggccgcggaagtcgtgttcattccgctcctgctctctggggtctgcggtgttatagcgtgtgtaccggcgcaactgggtctttaccctggccaccagttccaaggggctgaatggtttagtaatataatcatctgcacccagcgtgaggcccatgattttgtccatgtcttccaccttggcgctgagcatcagaatgggatacaaatgggactctcgaattttttggcagagggtaaatccatccatgtccggtagcatcacatccaagatggctaaactaagctctttttgggcgatgatctccaaggcttcggcagcggtgtatgctttcagaacgggaaagccttcgtttttcagatagacttccaccagatcggcaatttcccgttcatcgtctacaacaagaatagtttgctccatgataacaactctttctatatggggtttcaaagggaaaacggattttagacattgttattttatcataaaattcttaaggaatcgttccaaatatcatacaaatttatgacattttggaagcgtttctcacggaatgtaatttgattgcatccccaaaaagattcccattgacgaaccagatatttgcatgtataatattatggtaattttcaaaacgagtggaaacactcttcataaggagcggtatcgaagtggtcataacggggctgactcgaaatcagtttgccggtaactccggcacgtgggttcgaatcccacccgctccgccaaacagctctccagtgtggagggctgttttttatgaaaaggaactccaccggccgaagccggtggagttccttttaatggggaaaagctgttttggaatcgatggtaactgagcagacctttttcaaggtgaggcggtagacaagatagagaaggagagaaaccacggcgatcacacccaagcaggtgatcatgccggaagcctcactgggcgtgatgcccatgggctctccgttggagtacatgataagggtatagaacgcgtagatcaggatggttcccaccagaatggggactcggaagacccggctcacctgccctttcaccgagcggtataggtacgaccgcggcgcccctaaatggcgcagatcatcgtagacccgggcattggtcataccgatggtcatgcagcgggtgaaagagatgacgatgactgcggcgaagcagacaatggcgatgaaaataaagagcatgaggaaaactgccatggtttttaccagttccgtctcatccagaattttgaactgaggcatgtatttccagcttgtgcggaattctgtgctgtcgggtttgtcatagtcgatggaagaagtgccgctttcttccaaagattccgggtcgcagaaatacgatcctgtctcctcaatggcaatttggcgggccacagggtcccaagcgtcaaagacttccacttccggtccggagtggtccacgatgtcataaaaaagcgccttggcaaaggggaagctggcttctacatccgtgacattgaaaaggacatagtcctcctgccactggccggtcaagccggcagaaatggcctcataatccctgtcatccaatacgtagcaccccagcagcatggtgtatgacagaggttctgccggcgtaacgtcaagggtttttcccgtcaccatattggtcagatgggtgacatcaccaccgctcaggtaactgctgccgccgtcgtcatcgagaacattggcacaagtgccgggagcaaggtcgatcttttgaccagtgatcgcgttgtaggcacgctcaggcaggaaggtggcactttggagcagttctcggtactcctctgtataagtgactccgatggaggattcggtttcaatatgttccataccatccgtgcccaagatagagccggtagccgtcacccaggttgtgatgtccacgttgtgtttctgagccagctgtgccacgtcgttttgtccaatcatatcctgatcacagcggtaatggtacagataatcgtagggacggctggcaacactggttccagagctggagagcatcatcggagcatagaagctggcgaagtaagcacctgccagcaggacggtcatcaccagcatgttccgcactgtttgccgcccctgaaatttcatcatgctggtggaaatcaggtcccgatactgttttttcttgccgccccatccattgaccacggtgtggagcagaagaatgtacaggccgatcagtgcaggcaggtagaacagtgcatccaccacggagggggcataccagtggagaactttgacgaaaaagctgggcatgaagtaccccaggaagcctcccaatgcaatgaggaggacgccaacaggaccataccaccgtgggacagcgcggatgggttccgatttatgggattcctggacaatatcaatgatattggtgcgacgaatagagcgccagcccatcagaaacagcatgaggatgacgaagacggaaaaggccagtgcaaagaggtaggcttgcgcgtcaaaacgcagaaccatttcctcggtatccacaatcatggtacggaagatttgccagatgccccaggacagcggaacacccaacagggcaccagcggcgcaggagcccagagagagaagggccaattccttgctcagttccgttttcaactggtgccgggtggcacccagggccagaaaggtgccaatttcccgggacttttgacggaaaaacagaccggaggcatacgtggtaaaaaccgcgcagcccaaaacggccagaacaaagaccatcattacctgctttcgggagtcccctccctccggcagaatggtgaggacagtgggagagcgcatcatgcaggcgtaagctgtgataagaagaacggaaaaaaaggtacatccggccagcagagcgtactgccgccaatttttccgccggagatggcgataaacttctgaaaagtgtctcatgggtttcactcccttcccatctcacggatcgcatccagaagctgatcctgaaatgtggtacgggccagggtccccttttccaggacccgccagactacaccgtcctgcagaataatgacacggtcgcagaaggaggcggcgaaagagtcgtgggtcaccatgaagatggtggcttccagggattgttttgcctgttcaaaggaggagatcaccgcccggctggacttggagtctaaatttcccgtgggttcgtctgccaaaatgagcagagggttattgatgagggcacgggccacggcggtgcgctgcttttcaccgccggagatctctgccgggtatttctcccgaatggcggagatgccgaacacctggcacagctggtcagcgcgctgctccatggcgggaccagcagttccgccaatgatggcagggagaagaatgttttgctggacggttaagccatctaacagcaaaaaatcctgaaagacaaacccaagctgtttgtttcgaacagaggccagggcggtttcatccagcttggccagctggcgattgcccaaggtgatttctccgctgtctgcagggatgtagcaggagatgcagttgagcagtgtggtctttccggagccagacggtcccattacggccacaaactccccttttcccacctccagggagacacccttgagaacttcataggtagtttttcccacttggtaggatttgtgaagattgtgtacagtcagcattgacgattccttcctttctctgatggtgaagggagaaatgagctgttctccccttctttctgtctccaccataaccgatggagtttctgacagcaactgccccagtcatattcggcctgatggatgctaagtttggcaggcgcagaagacgggatgtcaagtttggcgggttttctgtcaaacttggggcggcttctgtcaagttctatttggcggaagccgccctgtgtggtacaatcaaagaggttagattgtaccacacgatggtgcattcgtaggatactcaagaggaagggagaaacgatctttgttctgcgttgggatttgcgatgacagtcaggaggctcgtttgcacctgagggcaaggttggaacgggttttagagccacatagagacatggaccgagtcctggaattttcctcgggagaagggctgctgcgctgggtggagaaccatcccggagagctgaatctgatttttttggatatggaaatggggcagctggacgggatggagaccgcccggcgtctgcgtcagatagaggaaagtctcccgttggtgtttgtcacaggctatacagagcatgtctttgagggatacacggtgggggctttgggctatcttctcaaacctgtgcgggaggatcagctgaaggaagttttgtcccgggccgctgcggcgctgctccgagaggaagaggaggtctatctctgccgccgcggcgatgtgacctatcgaattccccggaagaagattctatattttacatcggaccggcggcaggtaacctgtgtgacaacggaaaaacactatacattttatggaaagctggatcaggtggaagaagaactgaaggattcctttgtacgaattcatcagcggtatctggtgcggacacaggcggtacagcagatctcgggcagccaagtcttagtgggtgggcagacactgcccatcagccggtcctgtcaacaggctgcgatgattgccctcacccgggcctcgctggaggagtgactatggacggcctgacattgccccaacaagcattgatttgtctcacctatggcgtcacactggtatgcagcggattggctctctatggaacggcccggcgattcttaacggttcggtcgttaggatggggaaaggccatccttttcctgacgtttggtatctccacaggcatggtgatctgggttggagatcctaatctgctctatgtgttccctctcttcgtctttttttccatgctcagcacccaaggagactggatgggacggctggcagttaccatcattttcttctgtatcattatgtcggtctgtgccatcctggacacgtacattgccctttttgacctgtttaccattgataccagcgattttctatgccgcttgatgcgtccgttgttttttgccctcctctatcttctgatccggcggcggatgccggtgggggtgatctccctctcccgccggttatggaagctcattctgggcttgtccttcatgcccttgtgcgcgttgatggcagtggttttgctgacctatcgcaagtgggactcgatggtggccaactccatggccatgaaccaggggatggtggttctccccttcactggtgtgacggcgctgattcttttgtttgtcattttaaccctggccaaccatgaaaaactggagcaggaagtccatttggccggcttgcgggaggtctattaccaaggcatccagagagaacaggttcaagtgagaaccctccgtcatgacctgagaaatcacatgactgtgctccggggtctgctggagtcgggagaaacagaaaaagccatcggttatctggagcagatcaccgattcctcctcccttggaggaggaaagcccttcagtgacaatgagacagccaatgtggtcctgacggccaaggcaaaggagatgcgccagcgagggatacagggggagtttcagatttccctgcctcgaaaccttttgattgcagagatggatttgtgtgcccttttgggcaatgccctggacaatgccatggaggcggcggagaaaagtacagacaagacggtccgggttcgctgtcgggcggaaaaaggcctgtttatgctccaggtggacaatgcactggctggggatgaaaagccggatctctccaccacgaagaaagacaaaactgcccatggttttggccttttgggtatgcgggagattgcgaaacggtatggaggctctttcgaggtggtggcggccaatggccggtttgaactggtggtctgtctgcctttataaacaaatttgtattttttttgagaaatgactacccttttccatagaatttatgctataataatccgtcaaaacattgcaattcattggatcacatagagggaggaactgaatatggcagatcataagcgtcccgagtcgatggaacggattacaacccctgccctggcggaacaattcattgccgagcaggtggcagctgtccgggcacaggtgggagataaaaaggtcctgctggcactgtctggcggcgtggattcttctgtggtggcggccttgctgattaaggcggtgggaaagcagctcacttgcgtccatgtcaaccatggccttctgcggaagggagaacccgagcaggtggtggaagtattccggaatcagatggacgccaatttggtttatgtggatgcagtggaccgtttcctggacaagctggccggtgtagcagacccggagaccaagcggaagatcattggcgcggagtttattcgtgtgtttgaggaggaagcccggaaactggagggcattgagttcctggcccagggaaccatttaccctgacattctggaaagcggcccagtcaaggcccaccataacgtgggcggcctgccggaggaccttcagtttgcgttggtggaaccggtcaagttcctcttcaaagatgaagtccgcgtggtgggaaaagcgttgggtctgccggacagcatggtgttccgtcagcccttccccggtcccggcctgggcgttcgctgcctgggtgccattacccgtgaccggctggaggcggtgcgggaatccgacgcgattcttcgggaggagtttgccaagcatggactggagggcaaggtttggcagtattttaccgtggtgccggatttcaagtccaccggtgtgcgggacaatgccagaacctttgactggccggtgattctccgggcagtcaataccgtggatgccatgacggccacagtggaggatgtccccttccccctgctgcaggagattaccgcacggattacctcagaggtgaaaggggtaaaccgggttctctttgaccttaccccgaagcccagtggaaccattgagtgggaatgacgcttgagacggcgcaaacctatatgaatacagtttcttttgtccatccatgcatccatgagatctttgatactgggctggtgcgattctcgtccactcggtgcggacatgagaagtaagaaaagctgccctgctgaacgcaaatcagcagggcagtttttatcgtattcattaaaaatatagcaaagaataacctcaagatagatgatgtggacaatattcgaaaaactctattgacattatatccgaaaacggatatattatatatgaaatcggatattaaggaggccgtgatggtttacgaaaaagcaagaatgtatgcctatttgtctgcagaaattacgtctttgtatcatgaggcagccgtaaaaataggcatttctgatactgttttgaatatcctgtatgtgctttgcgaaaaagagggacaatgcctccaacgtgacatattcagattgacaggaatcagtcgtcaaacaatcaattcggcaatccgcaagttagaacgagatgggatcgcctatctgaagcagggagaaggccgaaacaccatggtttgtttgaccaaaaaagggagcaacttttccaccgaaaaaattctcccgttatttcaaatcgaagataagatatggaatgagtggacagccgaggagcaggagaagtatattctgttgacgcaaacataccgcgacgcattgaaaaaacatctgcgtgaagatttgtaatcgtgtctgctgccactcattaaggagcagctatgaacagagaaaataaacgaaaacagtttgaaaaaggatactataaaacacatgggtgtagtgacagctttacctgtaaggtatgcggcagactggttgtacctaccggagcaggcagtaaccaccgcaatcattgtccaaactgtcttagcagtttgcatttggatattgagcccggagatcgagaggcagactgcggagggattatggaacctgtgggcgtttgggtcagaaagaatggcgagtgggcgctcatccatcgttgcaggagatgtggccacctaagttcaaatcgtgtagcggcagatgacaatcccatgaagttaatgtctattgcgatgaaacctctctcccaaccaccctttccattggaaaagattgaggaaatgaccacccttatgggtggagatggacagctatcctacggataaaaccgaatagtattttacgcatagcaatccttgtcggggccaccgttgaccgcttcgacagggattgctctgtaatgatatattatctatatgatcctttccagtttcaatttgatgaaacgaagatctcctgaagaagatttttctattttcctttccagacttctatgataaaataaaattgaggtgatttgatgcaggtcaatatggaaggcgtggtagtgggaattgttgctttggtgatgattggagtatttcatcccattgtcatcaagtgtgaatattacttttcccacagaatctggccgttgtttttagcggctggaatcggttttttgctggctgccctgtttacagaggggatgctgtctatgattttagggctggctggtgtttcctgtctatggagtatccgggaactgcaggaacaggcgcagcgggtagagaagggatggtttcccaagaatccaaaccgaaaagagcctatggactgcaccaaataacaggagagaacgcttcctatgccgcaatgcaaaccaggtctgcagcgtacgcatgtgctgtgcgggcctggttttcggaataaaggggtgaaatacaaagaaaaatttgcagaatttttctgattttgcttgcaatttagcaaaaaatgtgatatcgttagctgtcgctaatttttggctggttcatcttatagatgggcttttttattggttgaatgttagtcttcgctaatagaaagcaggaggaggaagttccatggcagatcaaggaagcctttcggcgcgggatgttcatattcagtggtcttttgctctgccgggcctccaggtttgtcaatttgagggggggcaagaagcgtcctggttttcggaatctctgctgtctccttgcgcgtttcttttctgtcagactggcgggatgcaattttatctggatcatggtcaggtcattgacttgaatccgcacgatattttgcttctctctgcgggcgcttgtattcagcgcattcagtcggcagccccctgctcctgcggcattcgaatgactctggacggagaagaggctctttgcgccttgaccaagttctggccggtccctgggacccgtttgcaggcggaacaggtcgatgtctgcttacaggcccacggaggatggcttttgttccccagtgggctttggaacagcgcatttttttctcagctgacggatcttcccacggacaaacggggagagtactgtgtactcaaaggtgtggagcttctctatctcctgtgcggaaaggggctttctccgatggggcatcgtggccggcggtattgggaccgagaccagattgaagcgattcggcaggcgcacgattatatgctggcgaatttgggccagcctctgaccattgagggattagcccggcggtttcatatttcaggaacctttttgaaggaaggatttcggcagatgtatgggcagtctacccggaaatttcttcagatgcgtcggatggataaggcgtccgagctgctccgtaccaccaaccaaacggtgctgcagatcgcagtcgccgtaggatatgagagtgccagccaattttcacaaatttttaagcggcactatcagcttcctcccgcgcaatatcgcaggcaaattatcaaaagaaatgtctgaatccattcaattctgacggaatccgtgtgcttttctcttggaaacacgttacaatatgcgagttaaacaaagtgttttgctttgaggaggtgtcccattgaaaaaacatcgtttttgggcatggagtgctgtgttctgtatgatcatggtgatgctcactgggtacaaacataagtaacgcacgggaggttccaaatgaattattataagagtttagctttgtttgccggcggcgtgttgtttgggtctgcgggcattaagttgctgtccagcaaagacgcgaagaaggtttatacccacaccacggcggctgcgctgcggatgaaggactgtgtgatggggactgtcaccacagtacaggagaatgcggctgacatcctggccagtgcaaaggatatcaaccaggaaagagccgcccgggaagagattgtggaggatgccgcagaggagactcaggcagcaccggaggcctgagtacatctcaaagaacggcagatatgacgcagacagagggggcgggagccctctctgtttccctttggaggtcttactatgaaatttaagatcgttcacgagtcccgtggacgggtccgcattcaagtgatgcaaaaacggatgaccttggagcaagcggacctattggaagcctatctgaatcacagccccgccattcggcaggcggcggtacatgaacggacgtgctgcgcggtgattcagtattgcggagaacgatccgccctgctgacttttctgagccggttttcttacgacacaccagagattgccaaactggcgcctgcgcatagcggacgggctttgaaccgggcttatgaggaaaagctcgtcggcaaggtcgtctttaaggttatacggaaatgtttcctcccgcctcccctggcggcggcgtatacggttctcaaatccatcccctacctggtccgaggcgttcggtgcctgttgcagggaaaacttcgggttgaattgctggatggtttgtccattggaatttctatggctcgccgggatttctccacggcgggctctgtgatgttcctgttgagcctgggcgaactgctggaggaatggacccataaaaaatctgtggatgatttggcacggtgcatgtcactgaatgtggatcgtgtctggcttcatacacaggagggggaggtcttggttcctctcaaccagatccagcccggggatgccatctctgtgcggatgggcggcctgattccggtggatggcatgattgtccaaggggaggtcatggttaaccaggcctcgctcaccggcgaatccgttccggttcccaaggggccgaacacgatggtctacgccggcactgtggtggaagaaggcgagtgtatcatacaggtgtcccagcagaacggcagcagccggtatgacaaaattgtctctatgattgagcagtcggagaaactcaaatctgccgcggagaacaaagcttcccatttggcggatacactggtaccctatactttgctgggaagcggcttggcgtatctgctgacacgaaatgttacccgggcgctttccgttctcatggtggatttttcctgtgcgctgaaactggccatgccgttggcggtgctttctgctatgcgggaggccagcggaagacatgtgacggtaaaaggcggaaagtacctggaggcaatggcccatgcggacaccattgtctttgacaaaaccggtaccctgacccgagcctgccccacggtggtggaagtgattccctttggtgggaggagtgagacagacatgcttcgcctggcggcctgtttggaggaacacttcccccactccatggccaatgcggtggtacaggcagcccgggacagaggcctttcccacgaggagatgcattctcaagtggattatttggtggctcacggcattgccagtaccgtgggaccagagcgtgttatcattggcagcgcacattttgtgtttgaggatgagggctgcacagtgccgccggaggagcaggagaagtttgatgcactgccggatcagtatacccatttgtatttggccattgctggggtccttgctgcggtcatctgcatttcagaccctctgcggcctgaggcaaaagaagtgattgatacccttcgcgctttgggaattcggaaaacggtcatgctcactggcgacagtgaacgcactgcggccgcgattgcggcgcaggtgggggtagatgactatcgctctgaggttctgccagaggacaaagcaaactatgttgcggagcagcaggcccagggccgtgtggtggttatgctgggagatgggatcaacgactcccctgccctctctgcggccgatgtgggaattgccatcagtgatggtgcggccattgcccgggaaatcgcggatatcacgatctctgcggataacctggaggaactggttacgctgcgcagaatttccatggcgctgatgaagcgaatccagtccaattaccgttttgtgattggttttaacggaagcttgattggcctgggaaccgcaggcgttttggcaccggccacctctgccatgctgcacaatctttctactctgggcgtaagcctgcggagcatgaccaatttgttggaccacgattcataatttgtaaaaggtcaaaaaaggatggagcaaaatgtgcccagcaactgtataggcagtctgctgggcacatctgcggaaaaatggaacaacagaaaataatcgttgcaaatgtcggttttttatgataccatgacagacaaagaattagcttttgctaacaaatggcggggtttccttgcttggagagcaacggcggaatcctgctatgacgaataacacctccacacacgacacatttgccgcagtccccggaaacagatgtctccggggactgcggcgttttgggggaggttttattcctttgactcaaggctgctggctgggggctgctgtgcgtgttcttttttcttttgcatccttcttcgccagaacagaataaaaaggccggcggccagaacggtgaaggtcagaaggtatttgaccagagaattcccctcctctaccaagcaaaaggtgatggtttcctctgtggaggggaaaagaagatagctgccgtctttctcgctgtcctgccgctgccagttctcccccgtttggacccaaacggcgtaccgtccattggcctctggaagccggcagtgaacggtgtaggagacggcgtctaaaacggggtccttcactgtgacggtataagcggtgccctggtggctttctcctttggaatcggtccatgcagtttccttagtcgtatgggagacctttgcctgggcgctgaagctgccgtctaccaaaatatcaggcaggtcaccaccgtcggttaaggaggaagtgtacggggtgtagattgcctccaaggtctggctggcggtcaggtgggagtaatccaaatcaggccaggccgcggaataccctttcttggcgggaatttctggcagacgtgcaatccctttgccatattggaagggcaccacggcgacttcttttccatcggcccggaaagttaactccaactgagcaaaggtctctggtgcgccggcggcgcagagtgcaccaaacgttactggctcagcttgaccggcatagctgattccgtcaatggcccccagagcttcctgggtaaaggtattgcctgtgacagtgccctctggatcaacggatccagctacggtgcccacataggcgctcccctcttggagggtgatgagtgtgtgacagtttttcaaggtggagccataaccggcgatcccccccacatagtggtctcctgaaagcgtgcagcgagcccaactgtcccggatgcttccccaagacgcaccagcgatgcctcctacatagctgccatctgcgctgctgacagaaccgtagttctcacagtgggaaacttgccccaggtccattcggccgacaattccccctgcgtcatccttttttccggttacttctcccaaattgatacaggataggataacggccttggtttggtagcgaacgtccaaagaacggtcccccacttcgaccaaatcatcttcagggtcaaaatcgtattcaatggccatggagccggcaattccggctacgttgacatcgccttttaccacgccctcattccgagcgtcggacaggcagccggttcgttgactccgaccgtctacctgatcggagatgtcctcgatccggtccccttccccgctttttttcagggaggtttcctgtcggagcaggtctgtgatggattgcagctgctggctgacggcgctgagatcccctaagatcgtatccgaggattgggagagaagatcaccgagatcgtcagcactgccaagtaaatcagacagggcggcgtccagcgcgtctccccgggctgtcatatcgctgcctatgggggtgaactggatggaaggttcctccgccagggttttcaccatctcatggaatgcatcggcaccttctcccaatcgagagaaggcgttgttgaaggcgtctccggcgtctcggaaggcgtctaccaccccatccagataaatcccggcatcctctaacgtatccaaggcggataaaaggtgctttccagcggtttgcagttgatctgccccagactggaatgacgctgcggctttttcaagttcttgcagcgcggttttcaaggcctctgtggggtctccattggctgtaatcgtgtctttcagacggataaaggccttctgaatatttttcaggccgttggcggtgctggtgccggctgtggaaaggtcttcgaaggcctggaggaatgcgtcaatggaagatacatcaggcagagctgcccagccatcccggagatgttccatggcctcggaaaatgccacggtgccatcgcccaattgaccgatgcctttggccatttgttccaacgccaatttgatctcattggggtcacctaaggccgatttgagagcatcttggctggcgcggatgtgttccagtccctcgttcatgtgatcagcggcacgcaaggcctcctgtagcgccgtgcgcagcgattgcccagcgtcgctggccaggtcaccagcttgttctgcctgatcaagcccttcttctaaagcgtctactgcgtcggtcagttcctccggcagaggacgcagggtttccagaatcggctccagctgctgcagactccaggaaatccgggcggagagatcattcacggtgctgaggttcccgttggcccaatctttggccgcatccatcaactctccggcggcatcctgagctgtgcctgcgtgggaagaaagcatttgcagctgtgctgtggtggaggtgttggtgctgttcaggtcagagagaaggtgatcaacctggtcgcccaaggtacccagttcgctccaaagctgatttaagaggtcttcgccataccgcagaaagatttcaggctccagctgtcccgcaatcccgccgacatccttgcggcccagaatgacgccttggttggtgcagccgtttaggtaaccggactgccgtccggcgattccaccgacgttgtatcccacatgctcatagccaacaggacctgtgttcttacagctttgcaaaacaccggtggagaaacctgtgattccgccgatgtccgtgcaggcagggagattttccgtggagtttaagggcctgctatccaaatcttccaggtcggcctctccctccactgcgacggtattgatcttcccttgattgacacattgcagtatgctgcccaggttttgccccgcaatgccgcccacatagtgttctcctgtgacggagccggaaaaagtgctgttgatgatctttccactggattcgttgacgccgatgattcccccaatattggtttcaccctgaatacttcccgtgacagtgcagtttcgtacactgccgcagttgttgccaaccagcccacccagggaatcctggaggtctgtgggttctatggtcacttccagggacacattctgcaccactccgccggactgcaggtaacgaaacagtccccgcacgttgccgctgcctgttatggtaagcccggagatggtgtatccctgcccatcgaatgtgccgccaaaggtggggatggaagagaattccacatcagagagatcaaggtccgcagataaaacgactgttttcccccgggaccagctgtctaaagaacaacggcgggagagttccaccaaatcctctggggtacggatggtaatccggctgccggccgcccccacaggggcggccaaagagaggagcagggcaaagatcagcaggatagccagcctgttatggattcgtttcatggtcgttctcctcctctgatggcggcgcttcctggtaggacccggttcccataagcgcggaaacgtcgccgtggattaccccttggatgttggcgtccacgatgccggagattcgtccccgaacgcgtccgtttacgtagatggtgccgctggtccgatgttttgcctccggcatgttgacgcgaaaactggttttctccacaatggtgtctcccaacagcaagatctgaggtagcacaaacatgaccaggaacatagagatcaaggtgcctcggctcaggcactcgccgatgcccacaatggtaccttccgtggagagtttcccaataaggaaacctgcagaagctaagattgagccagaagtcaataccgtgggaaatgaaagctccaatgctttgacaatggctttcttaggcggcatggcggtttttagttccttgtaccagctggagatgacaatggcatagtcgatgttggcccccatttggatggaggtgacgatgaggtaacttaaaaagaaaattgggctttgcgtcagtcctgggaaggagaagttaaacaaaatgctgccctggatgatcagaatgagcagcacaggcaggcccaccgattggaaagtaaacagcaggaccaaaatcacaaaaaccaccgacaacacagagatcatcacattgtcccgggagaaagagactgacaagtcataatcgctggtggagtctcctactaaatagatctggtcgctgtcataatactgctctgcttcctggtgaatggtctgcaagaattggaaggtctcctccccttcctccggcagattcagctggaggagcatccttgtgtagtgcgttcccagcatttggtcgcgggcgtcggtgagctgctggtacatgtcgttgagctcttccgtggcgtcttcctccaaggagaagtatccggcttcctcctgatcgtaagcaaagagaaacaggtccattaagggaacggtatagtcgtcaattccaccgacaatttggccgtagttctcgttttgcgctgcataggcggtgtagaggagacagacaacctcataatccaaatcggtcatctccgcgaactgccggggggtcagggcatcggttaaggtgtagccgtccatggcttcgatattggacagccccatggcatagtcaatttgatcatattgttccaggcggttcagcagggctttctcgctgtcgtaatccccttttggcaccaggagggcggcgatattctgggtgccaaaggtctctcgaaccttttcttgggcaatttgactttcactctgccggctggttgtcagctgactatacccgtagacgtaaggacactgatttgacatccaaaatcccaggattaagcagacgacaaagatcgggatgctgacatagcgggcttttaccgcaaagcgcccccagcgttctatggaggggacaaaatttctgtgctgggttttctccattgccttggagaaaagaatcaaaaggcccggcatcagtgtaaagacggaaagaagactgaaacaaatggctttgatgaggatcagtcccatatcgaagccaatacgaaactgcataaacatcatggcggccaagccggaaatggttgtgagactgctggaaaaaatagcgggaatggcggcactgagtgccgtgatacaggcacttcggtcatccagtgtatgctgacgggcctctaaaaatcgatgaagcagaataatcgcgtagtcaatggccaatgccagctggagaaccactgtcacagagtcagagacaaaggaaatctcccccagcaaaaaattggttcccatgttcagcagagccgcggcgccgaaggtaagcaagaggacgggaacctctgcaaaggagtgggaggtcagccccaggaccaaaacaatgatgaccacgctcacagcaaagatcacctgcatttcctggtccagggtttctgcctgggaatctccaacggtgctgtcaatggaggcatcataaggcgccagcctctgcttgatctcctccatagcggacagactgatgggatcggtctcctctccgtcaaaggtaacggagaggagggcgtccgagcctttgaaatattctgcaatctcttctggggtgtcctgctctgtcccgttgccaaaggagacggaggttacgccgtcaatggacgcaagttcggctgccaggttcgctgccatatcgtaggtcacgttggacaacatgatccgggctgtgccgtaggtgatgaattcatcttccataatggtaagcccttggcgggtttcggtgttttccggcaagtattgtgtcaagtcattgcagaccttgacccatccctgggagaacagagagaagatcaaggcgcagaggtagaggaaaaagatgagatttcgtctgtccacgatggcagtggccagtttttcgaaaaaggatggtttgtcgggctgcttgtgcatggggccacctcctgcccttttggatggggaaagaaaacatgcggcgttatttccagttggaacaccgtgtctgaactacgtttgagagcaatattttgcaccatttgttcgagcctcttgccagcatacgacgggaagaaagatgtggcaaggcacagattccatcacgttgttaaatttttaacaaatctactaaatttgttagaatgacttctggcagatagcgggctgaattccctttccaggtgtgttataataaaatagtatcccgtccattttccgactccccggaggaaaaataagcatgaaataccctacctcggaaacgacaaagcaggaactgtccgccgccttgaaaacactcatgagccagaagccgctggagaagatctccattcgggagatcacagatctctgtggcctgcggcgggaaactttctattaccattttgccgatatctatgacctggtaaaatggatgtttgaggaggaggcgatcgtcttgctccgccaacatgagggggtgcagctgtggcaggaaggactgctccagttgttccactatatccaggataaccgggccttttgcctgtgtgccctgcggtccattgggcacagccatctgcgaaagttttttcaagcagacatctatggcattgtacaaaggaccgtggaacagctgtccagggaaatgggctgtcccgcggatgagttggtgacccaattctacgtcatcgcactggtggggaccgtggagagctggctgttgggagaactggatcggacgccggaggaactgattgcgtttgcggatgttatgttgaaggatcatattcgcggcgcagcccttcgaatacaggggaaatctgctctgctgtaaaaacaaggagagcctgctcagaactggcggcgctgtggcttgggaggctttttccatagaaatagagtgacatagggaggaagcggtttgtctgcccgaattatgattgtagatgacgaaccaggtattgttgatgtggtacagcgttattttgcgctgtcagggtatgaggtcattgcggcacagagtggagaggaagccttgaaaaagatatcctgccgtcccgatctcattctcttggatatcaatatgccgggtctaaatgggttggaggtctgtgcgcgcattcgcgcccatgtctcctgccctattttgtttttgaccgcccgcattgagcgcagtgataaaatcgtaggatttcaggccggcggagatgactacattgtaaagccctttgacatggaggtgctgggcgcccgggtggaggcccacctgcgccgggagcagcgaagaaccacatcggttacggtacgatttttcggggagctggcagtggactatacggggcgcaccgtgtccatccgcggagaagctgtgaaactgtccaagcgggagtttgacattgtggagttactttctatgcatcagggccaggtgtttgaccgggagcggatctatgagatcgtctggggtatggacggagacgggtccagcggaacggtgattgaacacatccgtaaggtccgggccaagctgtccgctaaaaccctgcacaattacatcgaaacggtctggggggtggggtatcgatggaatggctgagaaacctcagtttgcgaaaggcctatcttttgtttacggtgagttgttttcttgtggcatttttactgacttggggaaccacgaaggtctgcgtgagcctccgggaatcccttgccccctctggtgtggagattgtctatgatgaatctgggaaaggcacgattgtcagccgtgagattcccaccgaagaggcatggaacgcggccagaggggtggagtctcttcagtacattttaacagtggtgtattttggcggggcgtttttgctttcgggcacgttattctatcggttgaaattaaagcatcccattcagaagctgcaagccggcgcccaacgcattatggagcaggacctggattttgttctggaggccgaagggaaggatgaactggaaagcctttgcgccgcctttgaaaagatgcgaggccagctgcagagaagccatcaggaattgtggcggcagggagaggaacgcaggcgtttgaacgcggcgttttcccatgacttgcgaaaccctgtgaccgtcctcaagggttccattcgggtgatggagaaagtcctccagggggatcgcctggaacgggcggcgttggaagaccatttggcgcggatgtcccattacaccgaacggatcgcctcttatattgaaacgatgagccaggtacagaagctggaggacacgcctttgtcccctgtggagattacctttggagaattgggaaaagagatgcaggaagagggagagcttctcctgtgggagacagcctgtcccctctcctttcagtttttcggcagtgagcatgcagttgtctgggtagatcgagcggtggtttccaccattttggaaaattgtttgaccaacgccagccggtatgccaagcagaccattcaggtgacggtgtctgtgcaaggggaacggctgacactgtctgttcaggaggatggccccggcttctcccccaatatgctgcgaaatggaacggaaccttttgttcgaggggagaaaacagcatctgagcactttggcatggggctgtatgtctgccggctgctgagtgaaaagcacggcggaggcattgcactggaaaacacggagacaggcggaagggtttctgtatggatgaaaagcggaaaaccttgattcttttttgatatttttttgctacactctcccggtggaaagggagagtgtattttttctccccaaaatagaaaggagaacgcagaatgcggattgtagcgacggatctgaccaaacgctatggaacgggagaaaaccaggtgattgccctgcacaaggccaatctggaaatccaagcgcgggattttatctccattgtcgggccctccggttcaggaaagagcacgcttttacacctcatcagcggtttggattatcccacagagggtgttgtggaatatgatggtcagaatatccatcaaggaaaggacgcggtcctgtcagcatttcgccggcgaagaattgggtttatttttcaaaaatttcatttaattccggtcctaacagcgcgggagaacattatcatgcccctgttgctggatcatcgtcaggtagatgagggatatttcaagcagatcacgcagtttttggggttggagcatcgactgacacacctgcccagtgagctgtccggcggacagcagcagcgggttgccattgcccgggcgttgattgcaaagccagatgtgatttttgcagatgagcccacgggtaatctggactcgcaaagcgggcgggaagtcatggacctgttggcaagtgtccatcgagaatttggaaagaccatcgtggtgattacccacgacgaccgaatcgcccaaatggcggaacgaaagttttccattgtggacggcattctctcggaggtgagccgcagatgaagacctatcgagcactggcatacaaggaactgcttgcttccaaaatcacttctgttctgatcctgattgcggtcattctgtccacaatgatgaccaccgccattgggcaatcccttggtattctctctgccatgcgggatcagcaggccattgcgctgaatgggaaccgatatgcgacgtttgttcagatggatcaggcgcaggtggataagatacgagcggacccaagaatttcctatgctggggtctctgtctcggttggcacagttgagctcaatcgtatccttaccctgggactcaacgaatattggggagacagcttgtctgcctacccttccctgtcccaagtcgaggaggggcggctgccggagcggcccatggagattgccttaccggaagatgttctccagatgcttggcttttccggtgatgtgggggatacgatttctcttgccgcctccaaagctttgcgccatggagttcagacgagcgatttttcctataccggccagttcaccttgacgggaattctgcgcagcaactatttgggatattctgccggtgtggtgcagggaattgtgggcaaaggaaccgcagaggcccttcttcccccagactacctttattataatgtggatattcgaaccaaggaaaaggctgcctttcaagagaccatggatgaccttgtggaaacgctaaaggttccggaactggacacgctttacaatgtgacctatctcaacgccaaaggaatttcctttgatgaggaatcggcggatacggaggaggacggagacggcttttccctgttggctgtggccggccttctggtaggtggactgattctattggcggcggggctggtgatctataatattttgaacatatcggtttcccggcggacggagcaatatgggacactgcgggccattggcggggagaaacgtcagatgtatactgtggtttccctggaaattctgctgctgtgtgccgttggcatgccagtggggttggggttggggctcctctccgccactgggattttaactgccgccaccagtctgctttctcccgagctgtttctggcccaggacacagcgatgctgcagcagttgatccaggagaaccagggcggaaaaggtctgtttttgtttctcagcgtttttattaccttgtcctttgcgtttgtagcggccatccctgcggcacgtgccgcagcgcgggtttccccggtggtgtcaatggccggacctgtcgttgtgggaaagcgcaaaaatcgaagcaccagaaaaattcactgttttgagtcgtattatgccaggctcaatttgaaacggcaccgagggcgcactgtaattacggtgctctccttagtgatgagtattactgtgttccttgcgctgcaggggtttgtttctctcctaaacgcggcgggaacggaacaggagcacttgggagattactccgtggtcaatgagaccgtgggattcacaccggaagagttgaagaaattgcaggaggacagcaatgtggagaatgtggccgctatgcagttttctttatatcccttagacgagcaaaaccgccctgtgggcattgcactggaccgggcgatgcagccgggtgaaacctttcaagtggtagggctgaacaaactctacctgaaagaattctttggggatcgtctttcggaggcggatctgtccgccatagagaatgggacaggatgcattgtacgcaatcccattgcagtcagcgtaggagaaggagactctctcccgagcacgaggtacacagtgggcagtgctatcacggtggcggggaaagcactcacggttctcgagacaatggacgactatgacggttacttaagtgtggggaattctggatttaccaatggggttcaggtgattgtcattgatcagctgtaccccgttctgacagggcgggatacctatgcggagctgcttcctcttctgaccgagggggcggaccgcaaggcatttgaccaggtcctggaaaagttctgtcaggagattccaggcactatgtcagtgtcctatgagcaaacagatcagcaactggaggagagctttgcacagatccatctgttggcgtggggcctaatcctatttgtagggctcattggcgtgctgaacatcatcaatacagtctataccaatattcacacacggaaaaaggagattggcacccagagagccattggaatgagtctgaaaagcctttataaaaccttcctgtgggagggggcgtattatggcctcctggcggctgtcatcggcggaatggccggatcgttttgcgccatggtgatccaaggggcgcagacggggacagttacccttggaacgccgccgtggctcccacttttggaagcagcgggcgtctctgtggcggtctgcctgctggccacggggattcccctgcgccaaattgcacgtttgtctattgtagacgccatcgaaacggtcgaatgagaaaaaagaaacgatccgcagccgtcaaatgctgcggatcgttttcctttgtttacagtggtatcatccgcagggcagcggcatcccgcagggaaaagagaccgtccagaatccccaggctgaactggctaatgctgccatgggactggaactgttccgccgcgtattctcccgccaaccccattgcggcggcaccggacaatgcagcctccaatggagaagcgacagcgagaaaagctgccacgacagcgccctgcatacatcctgtgcccgtcacccgagccatcagggggtccccgttttccacaccgaaggcgcagaccccatcggtgatgaggtcagtttttccagataggagcaccacggtatgaaattgacgggctgcctgcttggccacggtcagagcttgcgccaaaggaccgtgttccccattgtcgatgcctctggcgtggtgttctaccccgcagatggctcgaatttcggactcatttcctttgatcaccgctggatgtgcccggagcagaaacccgtgggcaaaggaacggcgaagctggctgcagcccacgcctaccaagtctatcatgcaggggatgtgatgggtgcgggcggtctcccctgctgcggctatggcctccatccggctgtctgagatatttcccagatttaccataagggcttgggacgtggcggtgatttctgcaacctccccagggtgctcggccatgatgggagatgcccccagcgccagcagagcgttggcgcagtcatggatggaaatgtgattggtaatgcagtggatgagcggcgaatcagctttgatccgctgcagaagctggggaaactgcgtttgaaaggtcataggttctcgctcctaatgcacgctgaattttggtgagcatcccggttctccgcagggcggccaggaagacaaaggcaatggttcctccaatgagcgtgccagtgataaacaatggggtatagaaaaaccaagtcaggcccgatttatggaccaagaaggccatgatcgggtaactgatgatagaaccgatgatccctgtaccaatgacctcgccgagcacagcacagatcagttttcctttggaagcacgatagaataccccggagagaaacgcgccaaagacagcgcctgtgagcgccagaggcgggattcccataaaggacatacgaatgattccgatcagggtggcacagagcagagaataccaaggccccatgaacacggaacaggcaatgttgatgagatgcgccatgggacacatcccctcgatgcgaagaatgggagagatgactaccccaatggcgatcagcatggccagcatcgtcattcgaagaatttctgtcttacttttcatgatttcctctctttccgcccagcagtcatagcactggactatgacggtacggtggagagggcccggtgggtagactccgcccgtatcgtcggacggtcgaggctcaaaagcctcctctcaccttgaaacacaagttccctcgctgtggttggacacgcagagccccgggcgctcccccgcagctccgtctccatccggacgccaactgcgccagatagagaggtcccgtattggatggatgattttatcgttctgtgcagaactctacttttttaccctctaaaatcaggttggtggtacgaacagcacacatttttccacacattgagcaggtgtggcggtctgaaggcggtgtgctctcaaaataggatcgtgccttatcgggatcaaccgcgatttggaacatggcctcccaatccacccggtggcgggcctccgccatctgattgtccaggtctctggcgtgtgggacccctttggcaatgtcggcagcatgggcagcaatacgggaggcaatgatcccctccttgacatcagcggcatctggcagacgaagatgttcggccggggtgacgtaacataggaagtcagcgccattggccgcggcgatggcgccgccgatggctgaggtgatatggtcgtacccggggaaaatatctgtcaccaacgggcccagaacatagaacggagcctcatggcaaagcctcttttccaagcgcatgttggcggcaatctcatccatggccatatggcctggcccttcgatcatcacctgtacatctcgatcccaggcccgctgggccagtgcccctaactcaatcagttcggcgatctggcctgcatcggtgctgtcatccagacaacccggacgaagcgcatcccccagactgatggttacatcgtattcccgcaggatatccaaaaccgcatcatagtactcgtagaaaggattttcctgacctgtcatctccatccaggcgaacaacagagaaccaccccgggagacgatattcatcttccgcttgtccctcttaaaagcctccacggcccggcgattgattccagcgtggatggtcatgaaatccaccccttcttccgcgtgggcccggacaaccttgagaaagtcctgcgcggtgatatccagcaagtccttttccaggtagccgatggcatcatacatggggactgtgccgatcatggcgggggacaattcgatgagctgttggcgaaaggtgttggttttgccgtaattggacaggtccataatggcctctgctccaaatcgcagggccatacggaccttgtccatctcggcctcgtagttgttggcgtctccagagatccctaaatttacattgattttggtgcgcagccccttgccaataccctctgcacacagggatttgtggttaatattggcgggaatggcgatctgccccaaggcgacgcgctctcgaatgatctctggatcggtaaattccttctccgcgacggttttcatttccggggtgatgatgccctgtttcgccgcttccatctgggttgcatattctctcatcgttcacaccctttctttttcccaagaaaaatggctgtctgttcgttatgccgaacagacagccgtttatggtgtcataaacaagttccctccgtcggcattatccgaatcaggtgcgtggcttttgccacagggtcgaaaccgttgtttcctctcagccgccgttgcagctcccctctttttatcaatctaacacggcggagggccattgtcaagagcggataccgaagcgaagagaaggactgattttctgattcggtttgaaatcattggagaaagacttgcaaccagccgtaatccacgatacaataaaaaaacgacaaaaagggagtgaatctccatggaacaggaacataaacgccgggtacgctacaagggcacccatcccagaaagtaccaggaaaaatacaaagagctgaatccggagaagtaccagcgagatgtggagaagattcttcagcagggaaaaacgcccgctgggatgcatattccaatctgtgtggaagaaattctgcaattttttgatatccagcctggccagattgggctggatgccaccttgggatatggtggccacagccggcggatgctggaaaaactgggtgggcagggacatctgtacgccacagatgtggaccccattgaatctgaaaagacccggcttcgtctggcacagttggggtatggaccggaaatcctcacagtccggcggatgaactttgcggatctggaccaggtggcgcccggcgttgcctatgattttgtgctggcggatttgggggtttcctctatgcagattgacaatccggcccgtggttttacctttaagcaggagggaccgctggatttgcgcttagatcccacggcaggggtgcccgcggcccagcgtctgcgggagctcagccgggaggaattggccgctatgctggtggaaaacgcggacgaaccatacgcagagcaaattgcagccgctgttcgcgcgcgtctcaggaaagggggcgccatagagactacccgagagttggcagagaccgtggcgggggcgctctgtttccttccacctcgggagagaaaggaagcggagaaaaaggcctgtcagcggaccttccaggcgctgcgtatcgatgtcaacaatgagttcgaggtgttgtaccgctttttagagaagcttcccggggttcttaagccgggcggaaaagtggcggttttgacctttcactccggggaagaccgtctggtgaagaaatcctttcaggcattggctcgtcagggggtttactgtgcggtagcgaaggaagtgatccgcccctcagcccaggagtgtgtcaaaaacccgcgggcccgttctaccaaaatgcggtgggccattcgcggaggcctgaggatggagaaaacagaagggacaggagaggaaacacatagagtatgacgctgaaagatttagagattggcacctccggcgtgattatcgcggtggggggagagggttctcttcgacagcattttttggatatgggagttatccctggggcggaagttacattgatgaagtatgctcccatgggcgacccaatggagctgagaatccatggctatgaattgacgctgcgcctggcggacggtgaaaaagtagagatcgctcccctgggcgctgatagagcgcgggaggaggccccacgggaagcagaagcctttgcggagacccaggcgcaccccggcctgggagagggcggaaaataccatgtaaagggagaggaacacccgctgccgccgggaacccagctgacatttgccctggccggcaaccaaaactgcgggaaaaccacgctgtttaatcagctgaccggggccaatcagcatgtggggaactttcctggcgtcacagtggaccggaagagcggttcgatccgaggacacggagagactttggtgacggacttgcctggaatttattccctttccccctataccagcgaagagattgtatcccggcagttcattcttcacgagcatcccacgggaatcatcaacattgtggatgccaccaacatcgaacgaaacctctatctcaccatgcagctcatggagttggatgtccccatggttttggcgctgaatatgatggatgaggttcggggcaatggcggttccattcatattaacagaatggaggaactgctggggattcccgtggtccccatttcagcggccaagaacgagggtgtagaggaactggtcaatcacgcgctccatgttgcccaataccaggagcggcctgggcggacggatttctgcgacaaaaaggaccacaacggcgcggttcatcggtgcctccatggaattatgcatttggtagaggaccatgccaaggcagcgggaattcccctgcgttttgcagccagcaagctggtagagggtgatccgctggtgtttgatgcactgcggctgagccagaatgaacaggaaatgttagagcatatcatctctcagatggaggaggagcgagggctggaccgagctgcggccattgccgatatgcgcttctcctttctacagaaactctgtgatcagaccgtggtgcgtccacgggagagcaaagagcacgagcgcagccgccggattgacgcattcctcacaggaaaatacaccgccatccccgcctttgtaggaattatggcgttggtattctttttgactttcaatgtcatcggtgcctggtttcaggcattgttggagggcggaatcagctggctgactgtctgggtggatgaagcgttgaccgcttggggggtcaacgcagtcctgcactccctggtcatcgacgggatcttcaatggtgtgggcagtgtattgagctttgtgcccatcattgttaccttgtttttcttcctgtctctgttggaagacagcggttacatggcccgcgtggcttttgtgatggacaaacttttgcggaagattggcctttccggacggagcattgtgccgatgctgattggctttggttgtactgtgcccggtgtcatggccagccgaacccttccctctgagcgggaccgtaaaatgaccattctgctcacgccgtttatgagctgttcggccaagctccccatctatggattttttacagctgcgttcttcccagggcgtggggggcttatcatggtggcgctctactttttgggaatcttagtaggcattctgatggcgctgctctccaagcggaccatcttcaaaggagaggccgttccgtttgttatggaactgcccaattaccggatgcctggcattcagaatgtggcgcatcttctgtgggacaaagccaaggattttcttcagcgggcattcacggttattttcctcgcgaccattgtggtctggttccttcagacatttgatttccagttaaatgttgtggcggattcccagaacagcattttggcggtcatcgcgggggcgatttctcccctttttgtgcctcttggttttggagactggcgggtttcaacggcactgattgctggatttatggccaaggaaagtgtggtctccacgctgtcggttctgtttggcagtacggaacagctcctggtggcactgacgccgctggctgtggcttctctcttggtcttttgtctactgtacacgccttgtgtagcggccattgcttccattcgacgggagctcggcggaaaatgggcggtcggagtggtggttggacaatgtgtgattgcgtgggtctgcgcactcctggtgcgtggactgggactggccatggggataatcggatgaaccttacgagtgttttgattttggcccttgttttgctggcctcggtccttgcggtccgggttctttggacgcggagagggagctgccatggctgcggcggcttttgcggctcgtgctggaaaaataaaaccgatgatgtccaagacaacaagcgttcagtatagtctgagccataggaaacctcccctgtcaagaaaccttggcaggggaatcttttttgatgaaaacaaagagattatcttgtggtaagaaagttgttataaacggttgaaatgaccaacggaatatagtacaatcaggaacgctgtgaacacagcagagaaagaagaatgggagaaaaaacatgcaaagagaacgtttaggcagccgtctgggctttattttgctcagtgccggctgcgccattgggatcgggaatgtctggaaattcccttacatggtgggacaaaacggtggcggtgcattcgtgctgatctacctgtttttcttgctggtcctgggaattcctgtcatgaccattgagttttccttgggccgtgccagccaaaagagtcctgtccgtctctatcagcagctggagcctaagggaagcaaatggcactatcatggctacgttgcgttgagcggcaactacttgctgatgatgttttataccacggtaggcggatggatgatccagtacttcctctctacggcgtctggtaagttcaacggattgtccacccagcaagtggaggaggcgttcaaccagagtgtctgcggcaacccggttaccatggtaggctttatggctttggtggttgtgctgggtttctttatctgctcatttggcctgcaaagggggctggagcgtgtcaccaagtacatgatgattgccctgctggttatcatggtgattctggcgatcaacagctttaccatggacggggccaaggaagggttgtctttctatctgaaacccgacttccagaagatgcaggaaattggcgttggaaatgttgtggtggcagcgatgacccaggcgttttttaccctgagtctcggaattggcgccatggctatttttggcagttacattgggaaggaacgctctctgatgggagaatccatcaatgtggcgattttggatacctttgtggcgttggtttctggtctgatcatcttccccgcctgcttcacctatcaggtggaggtgggatcagggccgagcctgatctttgttacgctgcccaacgtgttcaataacatgccgatgggaaatctttggggcgcgttgttctttgtgtttatgacctttgccgcgttttcgacggtgctggcggtctttgaaaacatcctctcctgctgtatggacatgtttggatggagccggaaaaaggcctgcctgatcaactgcctgctgctgttggtcttgtccctgccctgtgcgctgggctttaatctcctggcggaggttcaccccttgggcgggagcaccacgttcctggacttggaggacttcttagtcagcaatattttgctgcctctgggctctctgatctttgtgatcttcgcggtgagcaagcggggctggggttggaagaagtttatggaggaagccaacgccggccgtggatggaaggtaaaaaattggatgcgcggctacataacctatgtacttcccatcattatcattgccctttttgtcatcggtcttgtgacatactttatgccgaagtaaaagctttataaaaaaacaccatacagggaatgggttccctgtatggtgtttttatttcgatatgattcttctgtttttgctacaaagtgttgcaattcttcttggagtatagtaaaataaatgccgattaatttgcagcattaaagcggcaaaagaaagaaggatgggagaagaaaaagcatgcaaagagaacgtttaggcagtcgtctgggctttattctgctcagtgccggctgtgccatcgggatcggaaatgtctggaagtttccttacatggtaggacaaaatggaggcggcgcgtttgtcctgctctatttgtttttcctgttggtcatgggaatccccgttatgaccattgaattttccctgggccgtgccagccgaaaaagccctgttcgcatctatcatgcgctggcccccaaggggagcaaatggtatattcatggctatatggccatgatcggaaactatctgctgatgatgttctacaccacggtagggggctggatgattcagtatttcctctccacagcccagggaaagttcaatgggatgtctgcggaggaagtggggcaggcctatgaacaaatctgcgcggaccctgtgggcatggtgggcttcatggctttggtggtcgtgctgggtttctttatctgttcctttagcctccaaaagggactggaacgtgtgaccaagtatatgatgattgcgttgctggtcattatggtggtgctcgctatcaacagctttaccatggagggtgccaaagaaggtctttccttctatttgaagcccgacttggagaaaatgaaagaagttggcgttggtaatgtgatcctgggggcgatgacccaggcgttctttaccctgagccttggcatgggcggcatggctattttcggcagttatatcggtaaggaacgctctctgatgggcgagtccatcaacgtggcaattttggacacctttgtggcgctggtctccggcctcatcatttttcccgcctgttttacctaccacgtggaggcgggttctggccccaaattgatttttgtcacgctgcctaacgtcttcaaccacatgccaatgggggaactttggggagcactcttctttgtctttatgacctttgccgcgctgtccaccgtgctggcggtctttgagaatattctctcctgctgcatggacctttttggatggagccgaaaaaaggcctgcctcatcaatgccattgcacttttgatcctttccttgccctgcgctttgggctttaatcttctctctgggattcatcctttggggggaagcagcaacttcctggatctggaggactttttggtgagtaatatcattctgccagtgggctccttgattttcctgctcttcgctgtgagtaaacggggctggggttgggaaaactttatggcagaagccaacgctggtcgaggattgaaagtgaagaactggatgcgtggatatatgacctatattctcccattccttttccttgggatattcctcattggacttgtcacgtatttccagtgagggacatgagagaatccatgtcgcagagtcgatctccgcggcatgggttctcttttttcaagcgccaaacttgacgaaccgaagaaatgtgactacaatcaaagaagaaagcttcggaggagggagacagatgaacagcagaattcgggaggcaatttgcctgaaaacacagccggtggcggtgattcaaaccgatcaccttccccccgatgcccaaggatgggaaaccgaacaccatggctgtattctcccccgtctggaggatgcggccgaaggaaagaccgtggtggtgtttcaagcgcacacgaatgcctgtccgggcagcagagctgggctggggtttgagaaattgtctattgacccgatggcggaacttctctcgaaaggaaaggagggacatggcggcatggcgtataaaaagacgcctgatttagccgtgtcgtatctccacagcctgccggagacggtgccgagcaagtatgtgatttttcagcccctggataagctctccgatgcggtggtgccgactgcggtgatttttttggtgaatgccgaccagctgtccgcattggttacactggccaactatgatcgcccgaaccaagataatgtaaaggtgttgtttggcgctggctgcgtgcaggctgttttatacagtatgtgtgacactggggcttgcatccttgggctaacagatccctctgcccggcttcctatcagcaaagacctgttgtctttttccatcccctatgctcgctttttggagatggaagacaatgtgccggagagttttctaacaggagagacatggcggcagattcaaaaacgtctgtgatgggacgggaagcagcagaagaacaggggctggaaccttgtctgtgataccggcataaaagaaaacaactgcaattagaaagaagacgatggtttgaaaaagacgcagcccatttcccagcacctttttcggggaagctgttaccttgtgggactgctgatcttggcgctgggaatcaccatgaatacaaaggcagggttgggggtctccccgattatctcggtctcatacagtgttgccaccatctggggtcacaattttggcaataccacactccttctgtattccgtgtttgtgttggccgagatgattctgcacagcctgctggcgtaccgaaggaaaaaagcgggggtgccttctgtccgaaaactttctaccgtgcttctcatggacgcgatgcagttccctctcagcttgatcttcacccggtttctcaatgtgtttggagcacagatcccagacttggcgtcagactgtgcgggaaccttttggggaactcttccaggacaggttctcttcctgctcatcgccattgtgctgacaggggttggggctgccctctctctggacatgcgtttgattccgaatccaggagacggcattgtacagaccctctctgatttttcaggcggaagcgtgggactgaccaaaaattgcttcgatatcggcaacgtgctgttgacctctgccattggtctcttgatggccggacagttggtggggatcggtctggggacgatcctgtccatgattggggtgggacgtgtgattgcggtgtttaatcacttttatttccataagacagcggtcctggctggcctgcagctgtcttgaagggaagcgcgacaaatgaaacatacgaaaaaacggacagagcggcagcggaaaaaatgggcactgatcgggctggctttctttttggtggcaaccgttctgatctgctggcaggtggggctgccgatggtgcgtctggcttctgatccagaaaacttccgccaatggctggaggagagaaaactgggcggtctgctgatctatggtgctatggtgtttttccaggtcctgtttgccgtcattcccggggagccgttggagattgccggcggctatgcctttggcgcggtttggggaaccctcgtctgtctggtggcggctacgctgggaagcctcttggtctttggattggtgcggcggttcgggacccgtctggtggaggtgttttttcccgcggaaaagctccgtgccgtccgatttttacagagctctcccaagcgtaccattctcttcctggtgatttttatgattccagggacgccaaaggatctcctgtgttattttgccgggttaaccgacatcaaatttcctgtatttctgctggtctgctccctgggccgactgccttcggtggtaacctccacggttggcggggatgcgctgggaacccaggactatctatttgccgtcgtagtttttctggttaccttcctgatcagcgtgggcggcctgttgtgttaccgtcagatttgtaagcgacacaacacacgaaaggaaggggcggaacggccgaaaaaggagggggaaaatctctggccataaaccgcttttctatgctataatgggttcaaatcagaatctgtggagctgcgctccgctgggttggaggtcccaatggatcatactttggaaaaaattttggcccgcgttcaaaaacccgggcgctacgtaggcggcgaatataacgccataaaaaaagaaaagaacgatgtggactgccgctttgccttttgctttccggacacctatgagattggaatgtccaacttaggcatgcggattctctatggcgtaatcaatgaaatggatggggtatggtgtgagcgcgtttttgccccctggggagacatggaggcagaaatgcgcaaggaggggttgcccctttacgccttagagagtggggaccccattgcagaatttgatatcattggattctctcttggctatgagatggcatataccaatgtgctcaatatgctggacttggcggggcttcctttgcggagtgaggaccgcaaggacctgcgtccgctggtggtggcgggcggcaccagtatgtacaacccggaacccttggccccctttgtggatattgtctctctgggagaaggggaagatgtcacggtggagatgattcagctctatcgaaaggccaagcaggagggctggtccaaggcacagttgcttcgggcggccgcccagattcccgggctttatattccctctctttacgagatttcttatagagaagatggcttaattgcctccattcttccccaggaaggagccccggaacgggtgaaaaagcggattgttaccgatatggaccggtcctactatccggtaaaaaccattgtgccctccacggagatcacacaagaccgtgtgatgctggagctttttcgagggtgcattcgaggatgccgtttttgtcaggctggatttgtctaccgcccggtgcgcagccgcagccaagcgcagctggccagacaaggcattgaggcctgtcaggactcaggataccaggatatgacactgatgagcctatcctccagcgattacccggatttgctccctttgtgtgacgcgctactggagtggtgtgagccccataaggtcaacctggcccttccctccctgcgggcggataatttttccatgaatcttatggaaaagctgcagcgtggcggacggaagagcggcttgacttttgcgccggaggccggttcccagcgcctgcgggatgccatcaataagaatgtgacggaggaggacctgctcaactcctgccggactgcgtttgccggaggctggagcggtgtcaagctctattttatgttgggtctgcccacggagaccgatgaagacgttttaggcattgcagacttagccaacaaggtttaccatgtctggcgaaacaacacccccaaccggtcacgtggggtgcggattaccgtttcgacctcttgttttgtgcccaaatctcataccccatttcagtgggaggcgcagaatacaagggaggaatatctgcgaaaggtaacactcctccgagagaatctgcggaacaaatccattacctacaactggcacgacccggagaccagtttcttggaggcggcgctttccaggggggaccgccgggtggcggatgtgattgagcaggcctggaggcatggcgccaagtttgactcctggagtgaatatttctcccttcaaacctggctggatgcctttgcggcctgcggcctctcccctgctttttatgccaaccgtatacgggacaaggaagagatcttaccttggcagaccatttcagacggcgtaaaggagagctatctttggaaggagcgggagactgcgtatgccggtcagattaccccggactgccgggtgaaatgttccggctgcggtgcaaaccggctgtgtgaggggggaatctgtcatgtctgagcagagaattctgtttgccaaatacggtacggccaagtacatctctcatctggacctcatgcacaccatggagcgggctttcctgcgggcaggtattgccattcggcatacgacagggtttcatccccatccttatgtgtccatcccgctcccgcttcccctgggattctccagccaatgtgaaattatggagttcgggctggtctccggcagcacgatggaagcactgcctgcacagatgaaccgggttctgcccgctggcattgagattttgcgctgttatgaagggggacgccccttccgggatttggcatttgtccgttacgaggtcacattggaactggatggggatttggcgcagcaaggggaagcggcttttcgttctttggtggaccgcccgtcctttgttgtaaaaaagagaagcaagaaagccaaaagtggttttacagaggtagatattattccgctcatagaaggggtagaacggatcgaggcgcagggggaccggttggctctgaccttactgctgaaagcccagaatccgggtttgaatccagaggttctgctccagggttttcgaggagaatttccagacctccccatcgtttattccgcatgtcaccggcgggaaattttggatgaggccaagcagctataccgatgacgtagaacaaaagcccccacccgcgctcaccgtgtgctgtgagaagcagatgggggcttaaactttgctgaacatcacatttccagacggaccacgccctcctgttctttgagcagaaccatggtggagatatcccctcgcatagcctgttctgattccaaatccaaccgcactgccaggatgtcagggcgcccggaggggaattctttgacctctcgaacgctccagccgatctcgtggatgaaatggatggcatttcccaacccgacatcccgccggacctccagatagagcgctgtactggtggggatttttaagtatttcgtgtccaccacattgaccaaaagaagaataaagatcaaaatgacatacatggccaaggcgcattcgtaaaacccgacgccgacagccagccccatgcaggcagtggcccaaagggttgccgccgtggtcagccctttgatctggttgcgccgggtgacgatgatggtgccggcccctaagaaaccgattccgctgatcacttgtgcactgagccgggcagggtctcccacgccataactggcatagatatactggctgaccagcatggtagaggcggccccgacgcacaacagcatgtgggtgcgcaggccagcggctctctgccggattccccgttcaaagccgatggttcctccgaacgccatggccaaaagcaagcggacgcagactgacagtacatttaagtctctgagacttcccatccagtccagctgtatcatgcgttttccctccattccggtccaatggctccgttaaaattttgtaataaaatgcccattttcatacagatagtattattttgccatggttttatcaggttgtcaaacctttctcgttgctttttctgatcagataggatatactatccatattcctccaaataaccatgattttagaaactgaaaggagtaccttatgtcagacagtcaggcgaaaagaacactgccccgcatgttgatcagtttgctgatcacccttgccattggcgcggtgtggttttatgtttccctgcccgccattaacctgcacaatacaggtttttacagcttcgtttttatccttctgttggtctacatcttagtctttatgattattttgggtgtggataccggacatcaagagattcatttgaaggattacctttcctttgccaaaaaccagtgcaaaattgtagtcctcattgtggttgtcatggccgctatttttgtggtgggccagctgatctcggcgccgattttccgcgccggctcctaccatgagctgttggatgtggggacaggcgattttgccacggagattgaaccggtctcttttgacgagattcccatgttggatgaggcgtccgccagtgtgctgggtgaccggaagctgggggaactgtccgacatggtcagccaatttgacgtatctgcggactatacccagatcaactatcagggacgtcccgtccgggtagctgccttggagtacggtgatttctttaagtggttcctcaacaccaaggaggggctgccggcctatattaccgtagacatggtgacccaggaggccgatgtggtccggctttccgacctgggtctggagggaatgcgatactctccctcagaatatttcaaccgggacctgaaccgtttccttcggttccattatcccacctatatgttcagttccgcacacctggagattgacgaggagggacagccctggtgggtttgcccccgggagacgcggaccattggtctgttcggcggtgctgacatcattggtgcggttttgctgaacgccagtacaggagagcatgcctattatgacgtcaaggacattcccacctgggtagaccgggtttacacggccagcctgattgtccagcagtacgattactatggcacctatgtcaacgggtttattaactcgctcattggccagaaggatgtcactgtgaccacggaaaactttaactacctggcaatggatgacgatgtgtacatgtacacaggcattacctccgccagcagtgaccagtcgaatatcggcttccttttgtcaaatcaacgaacaaaggagaccacgtattacccagccccgggtgccattgagagttctgcccagcgatccgcggagggcattgtgcaggacttgggttacacagctaccttcccattgctgctgaacatcggcgggcaacccacctactttatgtccctaaaagacagttcccagttggtgaaaatgtatgctatggtaaacgtgtctcagtaccagattgttgcccagggaaccactgtggccgcctgtgaaagcgattatatcgcacagctacagcagcgaaacatccctgttaccagtgacagcgcccaggatattctggagaaaaccaacgtggagggaaccatcgcggagatccgaaccgcagtgctggacggtgactcctggtattatgtccggctggatggcgcggataccttctatgctatggcggcctccaaggaccgtaatgtagtgatcctaaatgtgggagacgccgtcagtatccagatttccccggaggactccggcaatgccattgtcaatgccctttcaatttccacgggaaacgcggcaccggatcctgtgaaagaggagcccgataacgccacagatgcgggcggcacagagccaacgacgcctacagaggagtaacagtaagaaaaaagatggtagacatcattcgtgtctaccatctttttttgtactgaaagggaacaagaagtgtcccaacaagttacatatccatagcatgatttttcgagaatgcaatttgttcctgggcacgcaccagcgcagcgtattccccgttttgcgccatcagcgatggatgactcccctgctcgatgatttcttcccggtcaactacggcgatacgatccgcattgcggatggtggacagacggtgcgcaatgatgatggaggtgcggccttcgcacaggcggtcaaaagaggcttggattttagcttctgtcacactgtccaacgcgctggttgcttcatctaaaatgacaatgggtgggtttttgagaaacacccgggcaatactgatccgctgtttttgcccgccggagagcatgacccctcgttctcctacataggtttcatatccattgggcatggccagaatgtcctcatggatctctgcttggcgggcagcccagactacctcctcatctgtggcatcgggacggccgtaccggatattttccaggacactgtctgcaaacaggaaaacctcctgctggacaattccgatgttttggcggagggaatgctgtgtgattttccggacatcgtgtccatcaatgaggactgcgccctctgtcacatcgtaaaaccggggaatcagttgacatagggtggttttcccgccgccggatggtccaacaaaggcaaatttttccccggctggaatggtcagtgagatatcccgtagcacctgcgcctgattgttgtactgaaaagaaacatgatcgaagcggacctctccttggaccgagtccaaatcctgggcgtccggagcatcctgaatctccggttccagccgcatcagctccaggaaccggctgaatccagccgagccctgcatgaattgctccacaaagttgaccagctttttgaccggggtggtgaaggtcgtgacatataaggtgaacgcgaccagatcggcatagttgaccgcatcgcgcatgatgaaatatcccccagccccgatgacaagaaccggcatgatggataggctgaattccatgccgccctggaatgtggccatggtcttgtaatatgtgctcttggcctggacgaagcgtcggttcatcaccttgaatttttccttttccgtctcttcgttttggaatgccttggccgtccgcataccggagatgccggattcaatggcggcgttgatctctgctgtctgggccttcagcttcagattggcccggcgcattttccgccgctgataaatggtgaagagaagaaagaacgggacaatggcaaaagagagtacagccagcttccactcaatggtacacatgataccaaacgcacccaccaaagtgacagtggaaataaagaggtcttccggcccatggtgggccaattctgtgatttcaaacagatcattggtgacccgagacatgaggaccccggtgcggtttttatcaaaaaagctgaagctcaagctctccatgtgggaatacaggtcccgtcgaagatcggcctctacccggacgccaaagacgtgcccccaataggagacaacaaagtacagtaatccctttcccacataggcaacggcgaaaaaaccaatgagaaggaagaaaacgcggtactcctgctggggcagtaagtgattgagggcggaccgggagagatatggaaaggccagatcaatcagacagattaccagggcacaaaacatatccaaaaagaacaagtgtttatgggggccgtagtaggagagaaaaattttaagggggcggttcttttgataatatgcaacattgcgtgtcatggacgcacctccaggaaaaagtaagattattatatcgttccttgcggcaccttgcaaggtaacttgtggagaggtttcccttcaacctccgctttttattgacaattctgtgcggatattgtacaatttcaattgtccgaattctaacaaatggggggagttctttcggatggaaactttgaaccatcgtgcttatcaggtgactcagctggcctgcattgtcaatcagctgcaccgaatggccatgcggatgccgcccgatgcacttccctcgggcatgacaatttcccaattatccaccattgggtttttgtatttttctcagcagggagacgtttatcagaaagatatcgaatccttctttaagctccgtcgttccaccgtcagcagtcagttggacacattggagaaaaagggcctcatccagcgggtacctgtctcccatgatgccagacttaaaaagctggttcttacagaggagggactgcggatcagcggtcaggtacttctggtgttggaacagatgaatgatttcatgatccaggggctgagccaggaggagacggtagtgttaacaaatctcttgcgaaaaatagaacaaaatttaagccgcattggatgaaagcatccttgcggcacactttgcgctgtatgccatatccccggaggtatcccaatgaaaaaacgtatttttagtcttgttttggctttgagctgcatggcagtgctttccgcctgcggtgaagaggagactgcggaaaccgaggagtcatccacggcggtggaaatcgccaccgtggagcgcggctcaatttcttccgagagcaatgtctctggccaggtggtttccgatggacaggagtccgtctctgtggcgctgtccgtccgttgcaccgatgtctatgtggaggtcggcgatacggtgtcggctgggcaggcaatctgcaagctggatatctccgccaccatggccaactatgagacggcgtctatgagctatgacaatgccaaaaagagctatgcggaacagtcttccctgctctctcaacaagttgcccaggcggaaaagaatgtctctgatacccaggcgctctttgatatgggggcggcctcccaggcggagttggacagcgcaaagctgtccctggaaaatgccaaggccagtatgaactctgcgctggaccaattggaagtggggatgcagaattataaggcgaccatggaacagctcaaagcatccctggcgaatgtggacagcaacggcaatgtggcggcgcctatttccggcaccattctctccttatcggcggtggaaaatgggttcgtctcccccagtgcacctgtggcgaccattgattccaccacagatatggaggtaaaggtaggggtatcggagtctctgattgggaagcttcaggtgggcggaagagtctcggtctccattgacgcggcggacaaggaatttcaggggaccatttccgcccttgaaaagtctgcggatgccaccacccacctgtacggggtaacgatccaagtgccatcggcttattccagaggattgctgtccggcatgtttgctgatgtgactttttacactgatacgcagagtgatgtggtgattgtccccacagaggccattcagacaggaatggatggacaatatgtttacaccattgacagcgacaacatcgcccaccgcatcccggtagagaccggcctggtgggagacggtgagacggaaatcacctccggcctttcaggcggtgagaccttggtcaccgtgggccagttctatctttccgaaggtgcggcagtccgggtcgtggcccctgaggtggcatcatgaaaattgcgtctttttgcattaagcacaaggtcactaccattttggcttttgtcattattgctgtcttcggggtcgtcttctattccaatttgaagttggcgctgatgcccaatatggaatttcccgcagcctatgtcatgtgtacctatgcgggagcagggccagaggatgtggaggagctggtgacccgtccgttggagtcctgcgtgtctacgctgtctggcgtggacaccatttcctccacctcctctgaaaacgtcagcatggtgatgattacctatgaggatggaacggatgtggatgacgcggcgattaagctgcgggaaaagtttgacgcgctctccctgccggatggatgcagtgatcccgtgatttataatttcaatgtcaacgacatgatgcccgtggccatgattgccttgagcggtgaggacctgagccaactgcaaaacttggcggaggaaaccgtgggccctgcgttggagcgtctggacggggttgcttccgcagatatcatgggcggcattgacagccagattacggtggaggtcaataccactgctttgacgggatatgggcttaccctgtcggatgtctccaactacttggctgccgccaatgtactttatcccggcggtgatgtgcagaacggaaccaataccctgacggtaaccaccagcgggcagtatcagtcggtggaggatgtggccaacaccttgctgtttctgccccggggagggtctgtacgcttaggggaaattgccacagtctatttggagtcctccttggaagacagcgcggctaaattgggggatgagagctgtgtcattctctcggtgaacaaacgctctggtgccaatgaagtggagatttccaggcgcgttctggatacgctggaggagctgaagcaagacaacccctccatgaattacatggtgccctatgaggccagcgactatatcatgcaagtggccaacaacgccatccaaaacattgtgatgggtgtcgcgctctcggcactggtggttttgctcttcctccgccgggcgggggctactgttaccatctcgctctccatgccattttgcgtgctgacagtgttcctgctgatgaatgtttttggcacaacgctgaatatgatgagtttgggcggcattgcaatgtgcatcggcatggtggtggacaactccatcgtggtcttggagaatatctatcgctacgctggggatggacacagccgatatgatagctgcgttttggggacctctgaggtgattacttcgattaccgcgtccagtttaaccaccattgcggtattcctgcccattggcctgagtggaggtatgacaggaatgatgttcctggacttctctcttacggtggtctttttgatcctctcttccctgctcattgccctgaccctcgttcctttgatgtgctacttcctgttggatgaaaacgcggtccgccttcagaagcttcaaggggcacagaagaagtcccgctggacacagatcgtggggaagctctctgaaaaatataaatatttgctggcctattttctgcgccgccgtctggtggcctgcctggtctcggtggcgatggtggtccttttcctggtcagctgcctgagtaccaatatggttctgattccagagatggaccagggaatggtgagtgtcaccgtggagatgcccacgggaacagaactggaagataccatggcctatggagaccgcgtgatgggcatcattcaagagaactgccctgaactggataatatgtatatgaccattggcagcagcatgtccacaggagggtccagcgcagaatctgcctcgattacagccaatctggtgggacgaagtgaacgaagccgttccagtaaagaggtagcccaggatttgaaggaagccatgcgggatattgctggttgtgagattacagtcagtgacgccagcatgatgagcagcatgaccagttccaacgacattcaggtggacatcagcggatctgactatgacacactgacgcagattgccaatgatctgacggaacagatcgctgccttagaggacacggaagaggttaccaattccctggagaatacgattccggcggtgtcggtttctgtcaatcatgccgcagcagcgcagtatgggctgacttctgccaccatcggttccgcggttcgaagtgaattgaccggaaccacggccaccacagtgacgatggatggcaatgatttagaggtggtggtgcgtggcagtggcgcaagtatggagagtctggacgcgctgcgttccatgcccatttctgcgccgacaggcggaacggttcctctctcctctgtcgcggaggtttccgttgaactgagtccccaatccatcgcacggaccaatcaatcccgtcaggtacaggtaactggtaataccatcagtggggacacggcggcgatgaatgcgtccattcagtccctgctggatggctatgatatgccggatgggtatcaggctgagattaacagtgcctatacagacatgatggaaaatttccaaaccctgatgctggctatgttggtggctgtctgtctggtctactttattttggcggcacagtttgagtccttcgttatgccggtgatggtgatgatgatccttcccattgcgctgtctggtgcattgtttggtttgcccattacgggaatggatttgtctatgattgttttgctggcgctgattatgctggtgggaacggtggtcaactcctccattgtgctgatcgactacatcaacattcggcgggcccgtggacaggagaaggacgaggccatcatggaggcttgccctctgcgagttcgtcccattatgatgaccacattgaccacggtgctggcgctgatccccatggcgattggctctggagagggcaacgagatgcttcagcccatgggagtcgttatgatcagtggtatggtgatttccactgtggttaccttgctgttcactcctgtttattactctgtgctggacagtttgtcagagcggatgaaaaaaccgctccagatgcgcagagcacgtaagacagaaaacctgctggcccagattgcggcggcggaaaaagcggcatccgtgggagagccgaagccataagccctttttcagaaagagttctgcaagaaaaaagtcccgtccttccaacctttgttggggacgggacttttttacttacgttttataacctttaatagaatgtggcgacatcctgctctggcgcggtgcctggagtcagagaaagtacgtggagaacagggccttttttattgtaaacccggttgtgtttaattgcaactttggcagtcagctcaacccattgctggtcctgaaggttcttcgtgtcgtatccagtggccagaagtcctgcaaaagtaatatcttccacgcaacaggtcataatccgacggccgaaaataaaactgccggccggaagcttatcccggaccatggtgaatccaccgatctttagggtttttcctttgtacttgtccggctcctctgagatatcctgataccagatcgcatagtcctgaggcgtgatttcaaccacgggtgcgtccaaatcaaagggcagttcatcgggggtgtcatcgtagtacacttccccattgagatcctcataggcaatgttggtccgacggctgacggcccggatgattttatgaatctccaccttgtccacccgctggtctgcgcggttcaggacaaccatttcacagcttttcagcttgtctaccaccagaccacgcatattggcgttgtaggtcaagaaggtctgggcgtctgcaaacatgaattcctggtagacaatccatgcctctggcatgttttgatagagctgatccagcatccacatgccgttgtattccacgatgactcgctccacagcatgctttttctgcaaacgctctaagttaattggtgtcaattcagaggggtcctctataacctcaatgaagacgtttttcccagaaaacgtggtgggctcatactcctcctccccttcttcacagagaagaagaagcgtgctctctccgttgttaaagcggacatcttccagggtctcttgaatgaatttggttttacctgcgtccagaaaaccggtaaacaggtaaacagggatttcttccatcatatattttatcctcgtttgctcagtgcaggcagaacagatgctccagcgcgtgctctttcagttcagaaccaatgacgcacagacgaccggtaaagccggcgggaccgcggcgaatattttgctctccaggcacatagtcgaagtggatccaggtgccatcctggcagggcacgattcccttggcgcggagaaccacgccatagtttgcttcctcgcccaatgcatgcagcgcaccagagatttcctcctctgtgtatttgcggggagtttctgccccccagctgatgaagacctcatcggcatcatggtcatgcccgcaggaacaagaaccgtcgtgatgatggtgctcatggtcatggtgatgatgttcttcgtgcccgtgttcatgttcgtgggacgcttcatcgtggtggtgatggtgttcatggtcatgctcatggtggtgatgatggtgggattcgtcatgagcagcctgctctgcggccaagtgtgccaattcctctttcagggtatccttgttttccatggtttccaggatcgttttcccatccaactcttcccatggtgtggtgatgatgggggcattggcattgtgttcccgcagcagcgccacagtatccagaagttttttctcattcatcccgctggtgcggctgagcacaatggcagcggcgtgctcaatttggttgttgaaaaactcaccgaagtttttcatataaattttgcactttgtggcatcggcgacagtgacgaaagcattgagtacaatctcgtggttatccaggcgctggacggctccaatgacatcggacagcttgcccacgccagagggctcaatgagaatccggtccgggtgaaattggaacagaacctgttccagcgcctgaccaaaatcccctaccaagctgcagcagatacagccggaattcatctccgtgatctccacgccggcatcctgcagaaaaccgccgtcaatgccgatttcgccaaattcattttcaatgagaaccagcttctccccctggtaggcttcctgaatcagcttcttgatcagtgtggttttcccggcgccaagaaaaccagaaaaaatatcaatttttgtcatttggaattcctccttcgtattgtgtgatgatggataaattggttggtattattatggttgggcaaggcttaggaatcgtctgtccatcggctcccctgctggacctgatcgcggacgaatgcagtttggattgcatggaggaccagctttttattggcgctccaggaaggggccaacagagttcgtttatcaccatctccggtcaggcgatggatgaccatccttggcgggagaacggacaaacaatcttctaatatttggatgtattcctccaaagtgagaaccggtacctttccctcccggtattcctgcgccagatcggtgccctccaacacatggagcagctgaagtttaatgccgtctgccccgctgcgccccacgtatcgggcggtttccaccatatcctcccggcattctccggggaggccaaggataacatgtgtgattacttccaagccggctcttttgagtgcgcagactgcgtgatcatagaccggcagcgcgtacccgcgccggatgtaacgggcgctgtctggatgtatggtttgcagtcccagctccacccaaacgggtttgatttgattgaggcgctgcaaaagggccaggacctctggcccaaggcagtccgggcgcgtggcgatcgagagcgcaacaatctccggagaagcgattgcctggcgaaacagagcgtccaggtacgggaggggggcataggtattggtaaagctctgaaaataagcgatgtattgaccacctttatttttatgggcaacccgctgcttggcgtgggccagctgttctgccacatgagtacacgcaggagaagcgaattcccctgcgccaacctcactacagaaaatgcagccgcgggttcctaatgtgccatctcggttgggacaggtcatgccgccatccaaggccagcttataaacctttcccccgaaccgttcccgcatcgcctgaggaaaagaatggtaccacatcactctgctgaaatgcaatcctgcttgccgacgcagaacatggtgaaggttccgccgcacaggagcttttctgtttcgtcacgaatctccacttctaccacgcacagtgtggttccccggcttttcacccggccttccgcaatgagatggtcccgtttcgtattgcgaaagaattcaaagctgttgctgatggtgacatagcgcatcccgttgctccgggctgctcctcctgcggcacagtcggccatggtcaggaacattcccccatggaccgcgccgtaaagatttcgattccaagtggtaaggtcagcctccacgacagcatggtcccgttccatcttggtcagctgaattccattgtgcagcatgaaggaatttttttggttggtatcattgaccattgcctgaaaatccatggagccctcactttctcggtcgtttcgatcacttataaaagaataaaggttacgccattgttataacggtccagatcgtgatcccggcgcagttcttcacaccgggcaaaggcctggcgtgtggcttcctcaaagatggagaattgttcccctttgacaaaatcccgaatctctccctgacgtttcagccgtgtgagatattttcggctttctgtccggatttttccaccctttccagaagaaccatagccatggataatcttcagaactgtacagcccatggcgcggctgtggtgaatttcaaaggtgagacgtttgatggcctggtcagcaaagggcattcccagttccaggttgacttcccgaaggcgggaggaatatcttggccctttcataattatttgtcggtgaactttcggcactgttccaggaagaaatcaaagattttttgtccatctggttctccgttggtccctgtcatctgttcagggtgaaactgaacggtccaaatgggcaaactgccgtgctgcatggcttccacgacgccaaccgcgtcccaggctgtggcgtacaggccctggccaaactgccggttggcttggtggtgagaactgttgaccaggatttcctgtccgtagagatcacccagcatggtcatgatggacaggcgcactggatgggttcgatttttcccctccgaagtctgtgcgtgcacctccaaaagagctggggataaatcctgatagatgtttccccccagagcaatgttcaccacctgatgtccccgacaaatgcccaagataggcttattttcacagacacaccggttcaccaaagccaattctactttgtctctgggcagatcaatttcacgggaccccaaatcagactcaccaaattccgaaggatcgacatctcccccgccagccaaaattaaaccgtcgaagtccatctccggatcaggacagtgaaaagacaatgcctcaccgccggctttctccacggcggcttcatacaggccgctgctctcaggagagcgggaaatcaaaatgcgaggtttcaaaaggacatgcctcctttgattcattccagccagagactgtatatttttattatatcacaactctgccgtttttggaaaatctttttcatttagtacggcaaagacgcaccgaggattcggtgcgcctttgccacggaccagcgaatccttcgctgtcgcgtcagtttatcttagtacattgcgccgctcatatcacctgcaggcatcccagcacctgtggcggagggaggtgccaaacggtcaccgaccagtgcttccgtggtcagcagcatagcagagatggaagcggcattctccagggcggagcgggttaccttggtggggtccacaatgccgttggaaatcatgtcacaatagacttccttgtatgcgtcaaacccatatccgacctcaccgctgttctttaccttttccaggatcacggaggcatccaggccagcgttggtggcgatctgacggagaggtgcggtcagagcccgggcgatgatctgcacgccggtcttttcgtctccctccacgctgtcaaccaacttctcaatctcgggaatggcattcacgtaagcggttccgccgccagcaacaattccctcttccaccgcggcgcgggtagcgttcagagcgtcttcaatccggagcttcttctccttcatctcggtctcggtagcggcacccacccggatcacagcaacaccgccggccagacgggccagacgctcctgcagcttctcacggtcatactcggaagtggagcgttcaaactcgttgcggatcatctgggtgcgctccttgatggcttcgggagctccgccgccatcgacaatgatggtggtctccttgcctgccttcacctgacgagccgttcccaggtgctccatagaggtgttgtgaagctccagaccgtagtcgctggaaatcacggtggcgccggtcaggatggcgatgtcctggagcatttccttgcggcggtcgccgaaaccaggggcctttacgcacagcacattcagggtgccgcggagtttgttgaccagcagggtggaaagtgcttcgccctccacgtcttccgccataatcagcagcttcttgccggactggataacctgctccaggataggaatgatttcctggatgttactgatcttcttgtcggtaaggaggatcagaggatcgtccagaacggcttccatcttttccgtgtcggttaccatgtagggggacaggaaaccacggtcaatctgcatgccctcaaccacttcgctgtaagtttcagccgtcttggactcttctacggtaatgacaccgtcagaaccgaccttttccatagcctcggcgatcaaggtgccgatcttttcatcgccggaagagaccgtaccaacccgggcaatgtcctcactgccgttgacaggctgagaattcttctgaatggtctccacagcgaccttggttgccttggccattcccttgttcatcacaacgggattggcgcctgctaccagatttttcaggccttcgtggatgatggcctgggccaacagcgtggcggtggtggtaccgtcgccggccacatcgttggttttggtggaaacttcctttaccatctgggcgcccatgttttcaaagggatcttccagttcaatttcctttgcaatggtgacaccgtcattggtgaccaggggcgtgccataggctctccacaggaccacattgcggcccttcggaccgagcgttactttgacagtattggccagcttgtcaacaccgcgctccagtgcctgacgagcttcttccccataactaagcatctttgccataatatatgttctccttccgatctgcggtcaaaattagtcttccacaattgccacgacgtcgctctgcttgacgatggtcagctgttcgccgtcgattttcacttcggttcccatgtacttgctggtgatgactttgtcgccgggcttcaggatcatggtcacttcttttccgtcaaccagaccaccggggccaacagcgacgacaacagacaggtcaggcttctccttcgcggctgcggtcaggataatgccacccttggtggtttcttctgcttccagacgcttgatcactacgcggtcggccagaggtttcaatgtcatgttgggttcctccttcaaatgtatgttcaaatggtgttcacaaacttttagcttagcactctttttggttgagtgctaattcaagtattataatacccttcccttgccaattccgcaacattgaaatttctgaaaagaagagaaaattcatattcatttttgtgcattttttcagaatcctgagatttgaaagggattaagtagcgctcttctttttttcatggtactggaagagatcacattttatcataccattatataattttctttttttgtccgctgttcgcccaaaggtccgctcaaattcagtatgagaggagagaaggttgatgcgccacccagttggcagtccctgtactgccctgccaaaatctcggtacaatccctcggcttcccgtttttccatcagccgttctccatagggcggattgctgacgattcgtccataaggctcctttctggaaaaggctctggcatcggcgagagaaaaccggacaatctcctcgacctccgctttttccgcattttcccgggcaatctgtacagcggcggggtcaatatctcctccccaaatctcgtagtttccatgatactccaggtccatggcttcgcctgcaccgtctacccagacccgggagggaagccaggtccatttttgggcggaaaacctccggtttaatccaggcgcccggtttttggcgatcagagcggcctcaatggggatggtgccagagccgcaaaaaggatcacaaaaagggtctctacctcgatatccggagagcagaaccagcgcggcagccaaggtttcccgcagaggagccgctaccccgactgcccgatagcctcgcttgtaaaggccggggcctgtggtatccaaaagtaaggaaacggtgtttttcatgatggagaattgaatttgatataaggcaccgtcttctggaagcgtctgtctgtggtagcatgtgcccagtcgggttgccactgcctttttcacaatggactgacaggccggcacgctgtgcagggtggaattcaggctgaagcctttgacgggaaaagcaccgttggaagggatgaattcttcccagggaagggctttggttccctgaaaaaggtcttcaaaagaatgggctgggaaggtgcccagagaaatcaagacccgttctcctgtccgaagccggaggttcagccggggaatgtcctccatggtaccctggcagaagacccggccgttctcagcccgaacctgctgcatgttcatgcgccggagctcgtccgctgtcaagccctctaccccaagaagggttggaatgacaaaggtgaattgatccataactttgatcctctctatcctgacaacaatgcttaaaagtatacctgctttttttccgtttggcaaaccttttctgcgggggaattctttttcccttcttttcttgcatttggtcagacgatatgatatgctaaagaaaatggtaagcttgcgaatgactgtcccaaacaaaaaattttaattggaaagatgagatgatgtgtcccttatggacagtacctgtatagcaatcatcgtgattttagtcattttagtggggctctctgcatggtgttcctccacggagacggcctactcttcggtcaacaaggttcgcctgaaaaacaaagcggaggatggcaatccccgcgcccagaatgcattggacctgttggagaagtatgacaaagttctctcctgcattctgattggcaataatattgtcaatctgacggctgccacattgggaaccgttctctttacgaagttgttgggtccggtctatggtccggcggcctctactgttgtgctgacgatcattgttctgatttttggtgagatcacccccaagacgctggccaatgatcaagcagaaaccttctgtatgcgtgctgcccctgctttgcgagtttgccttgtgattttgacgccgttgcatctgtttttcagcttatttcaaaaggcagctatcaggctcttccgctcttcagaagaggaaggcattacagaggaggaactgattaccatggtggaagaggcagaaaacgaaggtgggttggagcaccatgaaagtgagctgattcgggcagccattgagtttaacgacatggaggtggaagatatcctcactccgcgggtggatattgtggcggcgccggataccattaccatggaggagtttgccgtcctgtttgcggaaaatggatattcccggattccggtctatcatggttctattgacaatatcattggtgtggtccatgagaaagatttcttctctgcccgttaccacaaccacacagatgtgatcagcttggtcagtaaggttttttataccacaggatcgaccaagatatcggaccttcttcgtctgcttcagctacggaaaacccacatggcagtggttgtggatgaatacggcggcaccatgggaatcgtgacgatggaggatattctggaggaattggtgggcgaaatttgggatgagcacgatgaggtgattgaggagtttaagccccaaggggacggcagctatctcatctcctgctctgccaatctggatgatctcttcgaccgcttttccctgcgggctgtagacattgattctgccacaatcagcggatgggtgatggaacagttgggacgtgttccagtggagggggaccattttgtctatgagacgctggatgtcacggtgacgcgagtagagcaccaacggattttagagatccgggtgtttgtcctgccgaagtcagaatcggaaacgtaatgtgaaatagactcaagaggaatcatttccccttgggtctgtttttttgtgcagatgcgtcgatggttccaatttgtgggtagataaacagagagagcttgaccatggtgagcagtattctctgttttggtttgacgagagaatttctctttatatgggtgctggttggagctgcgatcccctatggcattttgataatttccctggttctcttttccttccggtatgataggcaacatacacaggacaaatacagcaacggcaggcagcgtatcacagctgcctgccgttgctgtattttttgtgaaagataaaataacgtcataatttcccatctgttggcgaatactacaaccaccaaatcagaagaaggtgatgcccatgaatttcatcccctgtaccgatccctgcatctatcaaaaggatggatactgcacgctctcccgggcgggttctggaggaaacccttccgcgcacaaggggtgcgttcacttcctgccccatgctgcctcacaggagaaccgccagcgcctctcggatgtttttcaccgggatcagctgtaaccctgtcgggggcacaatggtctgccgtccatgccgctggggaaccaaacacttggtaaagcccaggcgccgtacttctgacaggcgctgactgagggcagagacagaacgaagctctcctgtgagtcccacctctcctacggcgactaggtccggtggcacaggcttgtcccgaaagctggaggccagcgccagcacggctgccagatcggcccccggctcatccagatacagtcccccgatgacattgagataggcgtcgcaggtattgactcccagccctccccgcttttccagaacggccatgagcagcatggcccggttataatcaaaaccattggtgcttcggcggggcgtgccaaaggacgtgggggtcaacagggcctgtacctctgccaatacagggcgggcaccctccataacgcaggtgacacaggtgccgggctcttcggttagccgtccttccagtaacatctgggaggggttcggcacctcccgcagccctgtgtcatccatctcaaatacaccaatctcattggtggcgccataacggtttttggcggcccggagaatgcggtaagacatatggcggtccccttcaaaatagaggacacagtccaccatgtgttccagaaccttgggacctgccaggtttccctctttattgacatggccaatgacaaaaacggtgattccacgccccttagccaactgcatcagggccatggtgcattccttcacctgggaaatgctgcccggagaggttgactgatctccggtatacatcgtctgaatcgagtccacaatcagaatatccggggctgtctcttccacggcggcggagacctgttccagatcattctcggcaaagagatataaccccatctcccccacgcccagccgctctgcccggagcttcagctggcgctctgattcctctccggagacatagagaactttggcaaactgacagagctgatggcagatctggagcatcagcgtggattttccaatccccggcgccccgccgatcaggacaagagaaccctggaccgcgccgccgcccaagacgcggtccaattccgccaagccagtggggaagcgaatttcctggtcaatgaccatttcagagacccgttttggctttcgtatgggccctgtagagagggccggtttcccgccgctctttcccttggccggggcgggctgctctacaatcgtgttccaggcaccacaggcggagcactgcccctgccatttcggagtctcatttccgcactgggtgcagtaaaaaatggttttggccttcatacaaaggattctccttcttgcgaacttccgctgctgaggtaacaggcggccatggtgatggccagtttcatttggtaggccggctcctggagcagacggtcttcttctgcgttggacaaaaagccacattccaccaaaacggcccggcaggagatatggttcatcaggtagaccgaggaggcaatatgctggggagcccgctttttctcgggagaaaggacctccagcatcgtctgctgtatcgcctgtgccagcggcaaggagagcgcctcgtccccataaaacacttgaatgccccggtggctggggctgggggaggaattctggtggatactgatgagggtggcgttctccacctgattaatcagagccacccgattatgaaggtcggagacttttttctcccgtaacgtactggcttccggatcgtggatggagacatcggtgcttcgggtcatcacagtagggacaccgtaaaagcccatcagctggtccagctccaaggcgatggccagattgatttggctctcggactttccggacacagagaccgcaccgccgtcttctcctccgtgcccggggtcgatgattaacgtctgttgggtcattcgggcaaaagtagggtcagctttctccagccaggtcccctgggccagcaccacgacggccagagccgtgagcaagaggccacaccatgtgatgcgctgtttcaatcggttcaaaagacatccctccccaggcaccttatgccgggaagctgcgggacatactttccctcttcggaagagattccctaaaattatagcaaagaatcctctgttccgcaatcctctgccgcattcggttcccatttcccactttggggcatagactggactgaacgcgaatccctttgattttgcgtcgtttttgtaaaaggaggtacttccattgtcctttctcaattccaacggaatgcaatcgggcggaaaccgcccatcctgtccttccgggcagggctctctgcctgcctgcggtcccttcgcggtcccctttgttgtcagccagggaactgccccgcagcggtactccaagacgaaggccttggaaaacggcacgctctttcctgatttggatctccccttccacttgaaggtcaacgccccccaactggcggataccaagctgaaccagctgcgggccctggactttgtgatccaagaactgggcctttatctggacacccatcccaacgacagcgaagccttcgcgctcttccaaaactatgtggagctggaaaaagctgcccgtgaaagctatgtagagcagcacggtcctttgacccagaatgacgctgcactgaacagcacctacacctggggcaatggcccctggccctggcagtatagcgaggaggaggcgtaagacatgtttgtatatcagaaaaagctgcagtatcctgtccggatcaagaacaccaaccctaaactggccgcacaaatcatctcccagtacggcgggcctgagtgcaataggctacgataacctatgctccgtttttgacaaaaaatttgtcaaaaataacatggtgtttttttctgtggacaagtttgaccggaactgttgtaaaaaggacaggtctggttgcgggtgccgcaatttagggctatggtaaaaccagacggagaaataataatttctacccattctcttaaggaaaccttcattttctcttaattctgccaaaagattcccctgctatactaaagatgccgggaaaaccgggatacaaaaccccagaaggagggaaacgcatgcatgttttaatcttcaccggacagtttggcatggggcacattgccgcagcccaggcagtgcaggaggagatcctccgccaggagcccaccgcatctgtgactgtgctggatattgtggaggactgctttccccagctgcacagactggtctacggctgttttgattttaccgtcaactactgctctggcgtctataatatgctcaatcgaatggcgggccgttaccgctgtaccccgatgaagcgaacgatggttcaaaaattggaccaactgctgtatgaaagccaggcggatctggtgatctcaaccctgccgctcagctcccaatatatctccgcctacaagcggaccaccgggagcaccctgcccctttatacttacattacggatctggacgcccacagtgagtggattgcccctggaacagactgctatttcgtaggggatgagtccacccggcttcaacttcttcgcaggggaatcccggccgagcgtgtagttgtcagtggaattcctgtgcggcaggcatttcagtttcagttccatgcatcctcctctcccaaggaagtgctggtgatgggcggtggattgggactgatcccccgggcggaagaactgctctccgcactggacgcggcctctgatctccacgtcacggtgattacagggcagaatgagagtctccgccgggaactgacgaagtcttatccctcctttgaggtcatcggatttacccagaaggtggcccagtatatggcgcgggccgatcttcttctgacaaaagcgggaggaatcaccacgtttgaggcaatccatacgggaacccctatgtgcttgctccgccccttcctcatgcaggaggaggccaatgccgcttatattgaacagcagggatttgggaaagtcctttgggacaaagggaaagaggcctcagaggtgctctctcttctgcgggacccggaggcattggaggatatgaagcagcgaatggcggtggcgctgcgaagtctggaccagacgacccctttggaccgttttgcagagacaaggcgggctgtatgttgattccgctttttttggtggggggactgaccgtcgggagttatgcctttctcccctccacctggcaaaagacgcggcaccggatggggcggagaaaccgctggcgggaagggacactgtatcttacgtttgatgacggaccacatccggaatatacccctattctgctggacctgctggcaagctaccatatcccagccacatttttcgtggtgacagagtttgcccggaaaaatcccgcgctgatccagagaatgcaggcggagggacatctcattgggtttcactctgcatctcaccgcagtgcctatctcatgacacccaaacagacccggtctgatttttcagacggattggaggcccttgcccagttgggtatctcgccgcaatatttccgtccaccttggggtgtggtgaactgggcctccctccgtcaaatccgagcgcgccatctgcggctggtcctctgggatgtgatggcccaagattggaagcggagcatgacgccggacgagattgcccggcgtctgcggcttcgcgcctatccaggcgcggtcatttgtctgcatgatggacggggaaatgccggcgcgccgggtcggaccattcaagcattgcaaaccctgttgccccagtggctggaacaggggtttcgctttcagacattagacctgtatgaataaattacattggaaaaaaggcattgcctgtggagggatgtttctggccctcttgggacttacattttatatccttctgtccgaccaggacccgggcaagctatggaccgcgctgggtcaggcggaatggtcctggctggctgtgggcgcggcctgcatgatgctctttttctgctgtgaagccaaaaacattcaaactggtttgggactgtttggctctccggcgccgtacgcctcctgccttctctacgccattacggggtttttcttcagttccgtgaccccttctgcttctggtggtcagccgatgcagctctatgccatgtatcgggacggacacgcaccagcacctggcgccctggcgctgctgaccgactttttctcctttcagttggctgcggttttttgggccagtgttggttttttcctgcaccatgcgcagctgatccgcctggggaacggcgtgtggctctgctttgcatttggcgcagtgctcaatctgctggtggtggtggctctgtgcggtgcggtgttctctccacgggcccttcccactctttggggatggctgatgcggccagcgcgccgcctttttccccagcgcgcagaaggctggagacgctggggagaaaagcagtggaaggatttgcggcaatgtaccaggtgttaccgtacccataaacggcagctgggtaagatgtttctcacctctcttgtacagttggcagcttaccacagtgttccgttctgggtttacttggcttttgggctgcagggacagtctttttgggcgatggttgggctgcagggcgttctgtttctctcggtgtcctccctgcccctgcctggcgcggttggtctcacagagggagggtttctcttgctatatcaaacaatcttcccgggagcccttctccccagcgccatgctgctgagccggacagtcagtttttacttctttctgctcctgagcggattgtttctcgcgtttcgttttctgcggctcgcctggcggcatccagcggcaaaaacaacctgatcataaatcaatgacccgctgtctttttccagagaagacagcgggtcattggtttattcgatatcgaattgcggccggcccagtccgaggagaacctgggtccctacgcctggttctgatgcaatggaaatggtatggcccagcagattggtgacccgccggcaaaggtagagcccaatgccagtggcttttttgtccatacggccgttgtttccagtaaaccctttttcaaacacccgtggcaaatcctccggtgcaattcctatgccggtatctgcaatcaccaggtttgtttctccttccagaaaaatggatattttcccgccttccggcgtgtattttaaggcgttggacagcagctgttccagcaggaagcagagccatttttcatcacttaaaacttcccattttgtctcctgaaacaccagctggatctttttcaaaatgaagagcttggcatattttctcactgtctgccgcaccaccgcatccagctgacatcgctgcagaaccaaatccttgtccgtgctgtccaggcggaggtactgaagtaccatatccacatattgtgcaattttctgtagttcaatttccatttccgtggctctgtcaggccctgcctgtaacagcaggtccattgccgcgatgggtgttttgatctggtggacccagagagtatagtaggaggtcaaatcttccagcatgctgtctgccgcagcttgtcgctgacggttttcccgcaccagccgttggatcaaatgttggtagtcctcctcaatcaatgtggtggtctccggcaggtcttccgctgtcacaaaaattgcttcctccatttttcgaaggatcttgtgcttcctccaaaaccgcacaaagctcagtacggcccagaaggaagttccgatacagcacaggcagagcaggtaagcaatggcctctcccggcagtccatagagccaaaagatcagcacccccgacagagcgcaaaatagtcccgccgccgcaaccagctttcgagatgccagccaagcgccaaaaagcggtgtgtcattcatgctacttcaccatgtatccaatgccttttttggtttggatgaattcccgcagcccaatacgttccagttttttccgtaatcttgtgatgtttacgtacaatgcgttttcatccacataggaatcacaagcccagagggctgccatcagtgtatcccgggacactacgttgggcttattttccaagagcacctgcatcatacgggtttcatttttggtgagctcaaccttctttccctcataggtcacggaacattccagactgctgaacagcgcaccgttgtgttccagcaaatgactctgcccttgatagtcatatgcccggcgaagggccgcctggacttttgccagcagcaccgagaggtcaaaaggctttgcaataaagtcgtctgcccccatgttgatggccataacgatgttaatgttttccgccgccgaggacaggaaaaggatcggaacttgggaaaccctgcgaatttcctgacaccagtggtacccattgaaaaacggcagcgtgatatccatgaggacaaggtggggctggaattccacaaattctcccagaatggaggagaagtcctgggtgcattttacggtgaagttccaggcggttaatttatcggcaatggtcttggcaatcacccgatcatcctctaccaggtagatccggtacatggcctgatgccccctttcttttctttatcataccgcacagccgtggaaagcgcaatgctttccacggctgtgccaatttttaagttcaagtcaaccacaaggcgagaatcccaatcacccaaaggtgcagagggtaaaacacataaaaaaagtacttgcttcccttggtattaggccctcgtgtgccatcataatgagaaaggacgggcaggaccgtaataaacagaaagtccgagttaaatgccaacatttgcagggtctcctgcgctgtggggtaagggacaaaaaccagaagaaacagcacagcggacagcgcaaaatagagtacattgcgcaggaccatccgttcccggcacaaataagtgatgagaagaaagggaagaatcaggataccgccttcggagaaaagactggctgccaagacaaggattacgccgaaaagacggagtgtccactcccctgcggaccggggacgcaccccccactgggtcgccggattgctgcctaccaaaatgttaagcatcaggacgcccagtgccaacgtgagaaagatattgttggacaggtgaagcccccgggacgcgccgatcgtattatagagagcgttgcccagcgccatgatcccggcccaaacaaacaagcgcgccatataccggacccggcttttggtatgcaggaacccctccactgccaagtaggcaaaccacacgcccacacagcgggtgagtacatgaaatatgcctgttactgtgggaggcaccaacccaggaatatagggcagatggtccaaaaccatgagaaacgccatgaagcatttccattgaaaggcggtgtattgctttttcgctgccatgaagatctctcatttctgtgtgattggatagaatgtttatcggacgattttatagtatgtccgggctgtcaggtgataaatgatgaaatatcccatgccgaatacgacaacggttcccaggcagcacagcgcgaacagagagacattggtaaggttcagtgcagacatgagtttggtgatcattttgaacgcagccagcaaatggatcaccgcaccgagaagcgggaggaaaaagacagcacggacttggcttcgaatggcgcttctgatttgctgctggctcatgcccaccttctccatgatggcaaaacgcgctttgtcctcgtacccttccgaaatctgcttatagtaaataatcaaaactgtggccatcaggaacagagcgcccaggaacgaaccgaggaagaggagaccaccatacatggaataaaattcactttcctgcgccggccggcagcttaccatgtagttcccttccgtctcaaaggtcatctgacggatggctttgtacagcgcttccacggactccttttccgcgccatcaaagtccagcgagaactcccaatagacattgctggataagctctcatcctgcagttgcagctggaacacttcttccaacgtgctggcatctggcaccacaagaatcatttcccggtctgagtaggcactgtgtttcccagtgggcgattctggcagccatgctgcaatggaaaaggactttccgaagagagtcacctcatgccatgtgccgtcgttttctgtggtgtaaatcgctgcttcattctcccctaaggagagaggcgttcctgtgatttgggtgtagctgtctgcggtcataacttcggtatacaccaggtcccccaggtggtcatcccgggttgtcgttgaaaggttggacccctccgcagtggtattcatcatacgcaggatatctacttcctgcgtttttgtcggccgcagaccatgctgctgggctaaggtaaggacggtttctctgcattcttcttttgatggtccttcggactccacccaggactgagagagggtaatatcatggggatacattgcgttgagaacgtctcctaccccaagatacatacacacgcaggtagagagcatcaccaagaccatggtggaaagaatacaaatattggacagacccacggcattttgcttcattcgatagagcatccccgagaccccaataaaatgcttggcctgatagtagtagtttttccgctttttcatggcctttaagaacgcgatggaacctgcggtaaacagacagtaggtcccgacgatgaccaggataacggctaagaagaacagcatcagcgcatccagcggggactctgtggtgatggcgatgtagtagccggcccccagggtgataaggcctactattgtcaggagaactttcgttttcggttccttttcccccacgttccctccccgcaggagctctaccggcttggaaaggctgacgtgcagaaggttgcgcattagggccaccagatagatccccgcaaacagggcggcggtaacagccacagaggtaaagttcaccgaaaaaccaaactgcacggtaaagaacaaaattttgtaaagcagcaggagcagcagcttggacagaagaatccccagcagaatgccgccaacgatggtgaccaggcaggtatacagcgtctcccataagagaaccactgcaatatgccgcttcgacatgcccaaaatgttgtaaaggccgatttctttatgccgccgtttgatcaaaaaactgttggtatacagcaaaaatatgatggaaaaaatcccgaccacaatagttcccaaatacataatggcagggattgtgtctcctccaggcatattccgaatttcttggtgccaagccagaaaggtaatattatagaacatagccacagtaatgatccctgtcagcaagtagggaaacacaaagcggcggttacggaccaaatttccggcggccatcttggggaaaaagagtttacccacggtcagcaccccccgtggccagggcggttaaggtgtccgcgatctgtgtgaacatcgcctcattggtgcgtccaccccggtagagctgatggaacacctctccatccttaatgaaaaggacccggctggcgcggctggccgctttggcggagtgggtcaccatgaggatggtctgcccttcccgattgatctgctcaaaaaggtccaagagctgatctgcggaccgggagtccagcgcacctgtgggttcatctgccagaagaagccggggatctgtgatgcaggcacgggccacagcaacccgctgcttttgcccgccggagacctcatagggatatttctccaaaatgtcctcgatggaaagcttttttgccagaggggccagccggcgggccatttcctcatggtgcatgccagacaggaccaaggggaggtaaatgttgtcccgcagagaaaaggtgtccaataagttaaaatcctggaaaacgaaccccagatttttccggcgaaactctgccaagtcacgctcccggatttttccaatatcctttccctccagaagaacctgacctccagtgggctgatccaaagaagccacaatgttcagcagtgtggtctttccagagcccgattctcccatgatggctaagtattcccccttctccacagaaaaggtcacattggtcagggcggggaccagatggccgcccagtcgggtagtataggtttttttcaatgcttttacttcaagtagtgtcattgcgatccctccggatttatatcaattcgcctatattatacccttaatacaatgagacagccatagtttctccttacattttaggctgaaaccttacaattttgaaaggtacacgccgcattctgttgggaagggaaaaactcggcatcgccataataaataagtcttttttccttgtcaattgatttatagaaaccttaattatctttttattttttgttcagaaagaatattttttcataagaatgaggcaagggaggaaaaggaccacggaagaactttttcttccgtggtccttttcaagtcttttattgctgtacctgataatttgaatagccggaagacggaatgagttctccttccgtcgtaatgaaaagtgcttccacatcgtccaactgctctaccaacgccattcctttctctatgcccaataggaagcacgttgtggacaaagcatcgccctgggctgaggtatctgacagaatggtgacagaggccaggccggtatctgccgggaatccggtgtaagggtccaagatatggtgatattttttcccttggtaggtgaaatatcgttcatcgatccctgaggtaacgatgctctttcctgtcgcagacaccacatccgccaaaacaccttcctcctcattggggtcctgaattcctattgtgaatgctgtcccttcctgcttgtctccaatgagcagaatgtttcgtcccaagttcaaaaccgcatgttctaccccctgtgcaaccaagagctccttcacttggtctgcaatataacccttggcgatggcccctaagttggccaccatccccttccgggccaaaaaggcatgtccctccttcaccagcagatcatcgctgtcaatcagcggcaggacctgttccaactccgcctgggagggatagtgcccctgttcgttgtgaatgttccaaagggaaaccagtggccctgtggtcacatcaaagtatccctctgaaagggctgcgtattcttttgacaggcggaggacctcttctgtttcgggggaaatctccacccattcttccccagctgccttggccaggcggtccagatcactgccggtctgttccacactgagcagagactccaggcggcgaatttcatcaaaagccaaatcaatggtgctggcatcggtccagtcatagagtgtgatctcaatgtaggtatccagcataaaattgctttttgacacatgcgggggttcctccggctggcctgctgtacaacctgccatggacaaaatcatcaaaaaagccaagaaaaaagaaagctttttcttcattgggaatctccatttccagtttattgggtctattatagcggatcttgttccatgacgcaaggggggggacaggcaagaattggcgtccaaatgcataccctttagaaccacgcgcaggaggtgtcctatgagaaagcatggacgagcaatgatagaaggcgcgggcctgctccttgtgggcctgctcctctttctctttccagaggagagcgtcgcagcggcgcgggaggggatttccctctgtgtggatgtgctgatcccgtctctgtttcctttttttgtgctctcctctcttttgatctccaccggcctggctgggctctgtgctcgtccgctggaatccttcatgcggcctttgtttggtgtcgggggtgccggtgcagccgcactcagccttggcttgattggtggctatcccgtgggagccagaaccgttgcacagctggtacagcggcgggagtgttcccagacggaggcccggcggctctcccttttttgcaataactgcggccctgctttttttattggtgccgctggagtgggcgtttttggggcgaaggaggcgggatttctcctgttgggcgcaaatttgacagcggccgtattgctgggtatcctgttccatgttttcggcaaggagactgcccaagaggaaacgaggaaaagggagcggcccgcccactctcctctgacaacagaatttccccagtgtgtccgcaatgctttttcctctaccctgggggtctgtgcctatgtgattctcttttcggttctgaccagattggcagattgttccggcctgttgccctttctggtcaacgtactttccagtttgcttcctggagaaaacgcccctgttttgtgccggagtttttgtgttggccttatggagctttccacaggtaccgcggccataagggatggggtatcttcccctttgtcgctgcctctggcggcgtttatcttgggatggggtggtctgtcagtacactgccagtctctgcccttttggcgggaggccggggtaccatccgggccctatctccgcgctaaatttctgcatggcctcctttccgctggtataacggctctggcgacgctgctttttcccctctcgctgcctgccatggcccccgtcacgcctttggcggcccccagcctgcttggacaggaagttctggccctttggggaatggctggtatctattttttcttcttcgaccagaaaagagtggaaaagtcaaaaagcacccgctataataaacgcataccgtaaaaaacagggagggaaatccccgatgttgtttgtaaaaaaaatcgagcccagttgttcctactgccaacggggaaaagccgttacacctgataccgtcctctgcaagaaaaagggcgtgatccctctggcaggagcctgttctgcgtttcgatatgacccgctgaaacgggtgccgccccggccggtcacaccggatttttgccatctggatgggaaggactttaccttataagagggcgacgaccttttgctatgaaacaaaccatgacagcttgctgccagtactgtaatgcataaaaataaggcatggcctattggcatgccttatttttatgcgaaaaacaggaagcactttatgccggtgggttgcaaacggaacaagccgtatagccttgccccttggcctgcgaaagcgtccgcgcgtggcagctctcccggagataccggcagccatatcgatggtatttggacccagtatctgtcacatatactgtggcggtctgcgtcccctgactggtggttgtgctgttcccgctggaagatgctgctgtgctggttttggattggggcttgctttcctcctttgctttgtccgctttggctttttgtgcggcctcctttagcccgtcctcccgacctttttgatagcctgcttggtagccttcttcgtgcccagcgtcatattgtgcggaaagtgccgaggcagaatccctttccgcgctttctttcccctgctggtacccttcctcccgaatggtcgccagttcctcttcgtttacaatttggcaggcggacaggctgaagatcagaacaagagtggcgagaaagattgagacaatacgcatagaatcacctcctttttagttatgttagcatatatttgtcgaaagataaatataaaaacaaaaagaggttttaatatgcgacatattatattaactaataagttgaaagggcccttgggaagactcccaagggccctttcctatcatcccctaaatatcctgacacgaagacattcaagggatgatacagtaagtacaagttttttgtacaaacggtcttgcgtgacgggcgttcccggcaaacattgtgccgggatgcccgtaaccacttgtttagacgagagtatctggatgcagtccaaagctcacagcgatggcagcgtctacccggtgcatcatggggccgtctacccggcccatgtgttcccgcaggcgttttttgtccagggtccgaatctgttccaacaggatcacggagtccttcggcaaaccgaactgccgggccgccaattcaatgtgcgtgggcagctttgccttcccggtttgggaggtgatggctgccgcgatgacagtcgggctgtggcggttgccggtgtcattctgcacgatgagcaccggacgaacgcccccttgttcactgcccaccactgggctcaggtcagcataaaagatatctccacgctttacgctattatccacaaaagctcacactccgccggaagtagaatcctgcgttacatggatatcttatcctatgtaacgcggttactatgattctcccacggacaggcggcctttataccccaagggggaaaaaagtcaccgcctctggccagaacggagtagatccatgctccgtctccttcccttgctctatcctatgcagacggttctttttcgggaaccgtgtcggttacagatagatgcggggaattcgtttggtaagaacgcaaagcagctcataagaaatggtgttcatgatttcggcgccggcctccacaggttggcttcctgtctgatcactgccgtagaggatggccacgtctccttctttgacatcgggcaggtccgtaacatccaccatacacatatccatgcagattctgcccgtcacagggacgttttttccatggagaagtacagtaatccggttggaaaagccccggcaatatccatccccatagccgatgggaatcactgccaagcgggagtcccgctggagtgtgtgggtgcgcccatagctcaccggggttccggcagggactgtccgaacggtggcgacacggcttttcagttccagtacggggaccaggtcgcaaagaccggggtccattgtacggtctggaaaatggccatagaggacaatgcccgggcggaccatatccagatatgtggccggatacaggagcgtagccgcgctgttggcacagtgacggatggcaaattcatagcccagttccttcaccttttgtatgatatccaggaaccggttaaactgcatcatggtgtattcctcactgccgtcggaatcggagaaatgggtaaagattccctcggcatgaagaccaggaagtctgaccgcttccgtaatctcctgggcagactgtgtcatgtgggcctcgtcacacaaaaagcccaaccgggtcatgccggtgtcacattggatatggactgtaatggttcctcccgcgctctgggcttcggcagaaagggctttggcataggacaggtcgtagcaggcctgggtgatgttatactgcatgagttctttcccatagaaggaaggggtacatcccaggatcaggatcggcgcttggattcccgcctcccgaagttcaatcgcctcgtccaagcaggcgacccccaaatagtccgcccccaactcttccagcttctttgccacagggacagcgccatggccataggcatctgccttaaccagccccataaacttggttccataaggagtcaactgacgcagcgcgtggtagttgtgggccaatttttccatggatacctcagcccaagtccgtttcttttgtgattccattgtaccacactatcctttctctgttgtggattttgttactataaaggcagaaaactcacatcgaaccactgtggttccatcgctgcggagttctccccgtagaagggttttctgtgctttatcaaaccataacacggtctccagcccctctcctgcgggcttttctggctctcggcagcagaggcggagggtctcggtctctcccaacatctcgcttcctgtctccgcgatataaccagattgcatggcggcgatgaacgctggcaaagcgtccaagggagatagtccatctgcgttgaggggaccggtttccagctgcacgccgtcaaacttcaggaaggtctggccattttccaccgttgctgtgatgccggcaacctcctccggtgcggtgatgaccaaggtcatgccgtctttctgggtgctggaaaacgagacggtatattcatatactcgctggccatagtccgccgtcacatccatggtaccggaacagccgtccatcgccaagaaatcggaccgcagctgaagggccagatcattttctgactcagttttgctgcatcctcccaagagtgcggccaaaagcagacaaacaatgggtgcgcaaaacaatttcatgcgcaaaggaagttcctccttgtggttttagtccaccgggaacgacatggccccctggatagcggccgggatgttctggagaaggtcacttggggtcattccatactctccaaaggaggctgctgccagatcccctgccgcgccatggagccaaaccgctgacgggactgcctttttgggcgggattccctgccccagcagggagagaatcattcccgccaacacatctccgctgccgcctttggccataccggggtttcctgtggtattttcaaaggtctccccatcgggaaaggcggtgatggttcggtgccccttcagcaccaacacgcagccgtgctgacgggcaaacgccaaagcagcggcctcacgatcagggccaatggccttcccctgcctcagccggagaaattccccatcgtgaggggtcaggaccgtcagacggccacgcctggtgtccagaacatctatatgttctgccaccgcgtttataccatcggcatccaaaaccagcggggtctgaagccgctccaccaaatgacaggtgcgcacatccgtctttcggcttctgcccaagcccggtccaatgagaaccccgttgcattggttcatattttccagaagaatctcaaatcgcgccacaggagccggcatagcctcctggcatttcactgccaacacgggccagatctctggaggaaccgacagagataccagaccagagcctgtgcgaactgcggcggcggcggtgagcgcagccgcgccggtcagccccacgctgcctgccaaaatatgcacctttccaaaggttcccttgtgtccgtcccgtttccgcacgggcaggcagtgatggacaaattctcgtgttacctggaccatggcggtgccctccccgaccaaaaatcattttttatgcaattctgccccctattataggattttcctccttgcatttcaaccttttttatggtaaacttgcgtcactgtgaaagacaaggaaggggaaaatagcagacccactgccatcagagaggaacggtcatcggctgaaagccgttccgggaaacggctgcttggttcgccctggagtttcggcggggaaatacgccggcggttggtccaccgttatcagacaatgaagtgcgtatgggtttctgtacgaatgttcgggtggtaccgcggaagaatgttgcctttcgtcccgtttttacgggaggaagggcttttttatttgggaggaagcagaatgaaggaacaactggaaaagatcaaacaagaggctttggccgccttggccgtcaccaaggaatcggtggatttggaggcacttcgggtcaaatacctgggcaaaaagggagaactcaccgctgtgctcaagcagatgggaaagctcagcgcggaagagcgccctgtcattggtcagctggccaatgaagtgcgggaaagactgaccgcggagattgacgcccagaaaaaaaagattgaggaaattaagctggaggcccgcctggaagcagaggcggtggatgtaaccatccctggtcaacggaccaagctgggacatcagcaccccatgtatattgccctggacgaaatcaaggacatttttgtagggatgggctttaccattctggatggcccggaagtggaattggcatactacaattttgaccgtctgaacgcagaggagggccatccttcccgagactggtcggataccttctatttcgatcaggacagtcgggtgatgctccgcagccagacctctcccatgcaggtccatgccatggagaccaagcctctccccatccgcatcttggcccctggccgggtataccggaaggatgaggtagatgccacccattcccctatgttccaccaggtggagggcatggtgattgataagaacattaccatggcggacctgaagggaaccttgaacgctgtgatggagcagctctatggagcaggcaccaaaacccggttccgtccccaccacttcccctttacagagccttcctgtgagatggatgtccagtgccataaatgcggcggtgtaggctgtcccacctgcaagggagagggctggattgaggtactgggtgccgggatgatccaccccaaggtcttggagatgtccggcattgatcccgaagtctattcaggctgggcattcggcatggggctggagcgcatggcaatgcgccggtttaagattgctgacctgcgcttgatttttgaaaacgacgtccgcttcctggagcagttttaagaaaggagagtgctacgatgttactgtcaagaaaatggctgaatgagtttgtccccgtggaggccaaagaccgggcttttgccgaggatatgaccctctccggctccaaggtggaggttacagaggtagaaggggaagaaatttccaacgtggtggttggccgcgtggtggagatcaagcgccatgaaaactccgatcacatgtggatttgtcaggtggatgtgggagaaggcactccccttcaaattgtcacaggggcacagaacgtttcccagggggacttggtcccggtggccaaagataacagcaccctgcccgggggaatccatataaaaaagggaacactccggggagtggagtccaatggcatgctctgctcctataaggaactgggcatgacggacaacgactggccgtacagtgtggtagacgggatttttctattggaatcggaccccgacctaaaggccaagggattgaagccaggcgatgatatccgcactgccattgggctggacgaccacgtggtggagtttgaaatcactcccaaccggccggattgtctgtccgtgattgggcttgccagggaggccgcggtgacctatggcaaggcgctgaccctgcacgaccctgtggtgaacggcggcggaccgggcaatctttctgatctgttggatgtggaaattcctgccacagatctctgtccccggtataccgcacgaatggtccgcaatgttaagattgggccttcccctaagtggatgcgggatcgcctccgggcctccggagtgcggcccatcaacaacattgtagacatcaccaactacgtcatgctggagtatggccagcccatgcatgcctttgactatcgttatgtcaaaggaggaaaaatcattgtccgacgggcggaagagggcgagaccctcaccaccctggatggcaatgtacgcaacctaaattcctctatgttggtcatcgccgacgaacaccgggcggtgggactggccgggatcatgggtggtgagaacagtgaaattgtagaggacacggtagacgtggtctttgaatctgccaatttcaatggaacctccatccgccggaccgcgctggccctgggcatgcggacggaggcctcggcaaaatttgagaagggattggatatcctcaatacccttcccgcagtcaaccgggcctgtgagcttgtggaacgtctgggcgcaggcgaggttttggacggggtcattgatcttctcaactatgttccccagcctaagcagctgcttcttcgtccagaaaaaatcaatgctctgctggggacagagatcgacacgccggaaatgattcggattctcactgccttgggctttggcgcggagggagagaccatcaccgttccgtcttggcgtggagacgtggagcattattccgatctggcggaggaagtggcacggttttatggctacaatcagattcccactacctctatgcgcggtgtcacaacccagggcggatacagcccggagcagctgctggagcggacgttgggcggcgtctgccggggaatggggtatgatgaaatcatcacctattctttcattagccccacttattatgataagattcgcctccccgaaaacgatcccttacgcaagtccatgaaaattatgaatcccctgggagaggacacctccattatgcggaccacagttctgccctccatgttggaaattctcacccggaactacaattaccgcaataaatctgcccatctttatgaactgggacgcacctattttgagcgggaggatgggatggccgacgaacccaaaatgctctctctggggatctatggcccggaagaaaccttcttcaccttaaaaggtgcggtggaaaccatcctggccagtatccgggcggaagaggttacctatgaggctgagcacagccacccgtcctatcacccaggccgctgtgccaaggtctatgtaaagggacaggaagtgggaattctgggacagatccatccgttggtggccgccaactatggtgtggacacagaactgtactatggggaattgaagttcgacgctctgtttgccagccggggctctgacccggagtacacgcctctgcctaagttccccgcagtcacgcgagacattgctgtccttgtggatgtgggagccacagtgggtgcgctggaggcctgcatccgcaccgcagcgaagggtcttttgaaagatgttaccctcttcgatatctatcaggggagtaacctgccgacagggaagaaatccgtggcctttaatttgatcctgcgggctgacgaccgaagcctgaccgcgcaggaggcggacgatgaggtaaaacttgttctggaaagcctggaaaaagcctttggcgctaccttacggtgaaaaaatttcctgtttttaacttttttcccctttactttctcccgtttgaggagtatgatgtatttgataaattatgattctcgtgattggggggataccaatggattctgaatttacccgaaaatttcaggtggtccaagaccgcaacgaagagatgagagcaacgctcatggctgtctacgacgctttgaaggagaagggatataatccgatcaatcagattgtcggatatattttgtcggaggatcccacctatatcacgaactataataacgcccgcacgttgattcgaaagctggatcgggatgaactgctgcaggagttggttcgtcaatatttgaccagctaacccgtgtgataggagagaacgtcccctgttgtcttaaggcaacaggggacgtttttgttggagatgtcgtagaaaaagaagatattttacaagccgcctgctcagcctttgtgttacaataaggacacaggcatctaaggaggggctttttctatgaaacaaacagttcggactgctgtctatgatgaatctctgcaaatagaggcataccgcctgcaaggaacccagcggccctttcccaaccattttcacgggtattatgtcatcggacttgttgagtctggcaccaggcggctttcctgcagacagcagacatatcttctccggccgggttcccttcttttgctcaatcctggggatagccacgcctgtacccagtgtgggccggagatgctagactacaaggcatgtaacctttcccctgagcggatggaaattttggcagaagacattttaggggagaaatcccgccccagattttcttctgttgtcattcaggacgaggatatcaccagtgctttccgtctgctccacaaaatgattctggagcagacgggaacctttgaaaaagaagcatactttctcctgttgctcacccagctgatgcggcggtatcaccatccccttccccctgccctgtccgattgccgtagggaggtggaaacggcctgtacttttatggaggaaaactttgcgcagcggctttccctgagccagatttgtcaccaaatcggcttgagcaaatctactctcttacgggcttttaccaagtccaaaggtgtcacgccttaccattacttggagaatattcgtgttgaagccgcgaaaaagttattggagcagggaatctctcccgcagaggccgcacttcaggcgggattttctgatcaaagtcattttacgaactatttcagccggttcattggtctttctcccggtgcctatcgggacatattccgggagcaggcgcacaaaggaggcacaaatctgtgaaatttgaccgcaccacccctgggcatctggccgccttacttacaatctttatttggggaacgacctttatctctacaaaaattttgctgaaggattttcagccgatcgaaattctattgttccgattccttttgggggcggcggcgttgttcttggtctgccccaggagaataaagggaacctccccgaaacaggagctgacgttggctgccgctggattgtgcggaatctgcttgtactatctgctggaaaacatcgcgcttacatataccatggcgtccaatgtgggggtcattctctccgttgcgccctttctgacggctatcctcacccactggtttttgcggggagaagaaaaactgcggctccatttctttttaggttttctggtggcgatcgtgggaatctgcctgatcagtttcaatggagcccagttggcctggaatcccaagggggattggctggccctgctggcggcttttgtttgggcctgctattctattttaaccaggaagatcagcgcctggggatatcccaccgttctgattacccgccgcgtttttctttatggcatcctgtttatgctccctaccctattcttctttgattttcggcttggattggagcggttgaccatccccaccaacctggtcaatcttctctttttgggcctgggcgcctccgccctctgttttgtcacttggaattttgcagtaaagattttaggcgctctaaaaaccagcgtctatatctatatggtcccggtgattaccgttattacctctgttttgattctccacgagaccattacaccgttgtctggggtgggcatcggctgtacctttgttggtctccttttgtcagagtacaaaggcaaggcgctctctcagccaaaacaaaatatgcaggtataaaaataacgtgtcccagaaatgcaggtctgggacacgttgttttccgacgagatcaagaggccagataagcccggtggaataccttctttcctttcttgatgaccagcccctctccagagagctgctctgcggtgaaagctgcagaaatctcttttaccttttctccggcaacttccacgcccccttgctgtaccaagcgacgggcttcccctttcgaaggaaccagaccgcagcgaagcatcaagtccaaaatgccgatggaaccgtcggtcagatcttcggcggacagggcggtagagggcatgttcgcagtatcccctcctttggcaaagagaccacgagccacttcctgggctttgttggcctcttcctccccgtggaccagcttggtcagctcataggccaaaatctccttggcggtattcagctgtgcgccctcccaagcgtccatcttgtcgatctcttccagcgggaggaaggtcagcattcgaatgcatttgagcacatctgcatcgcccacattgcgccaatactggtaaaattcatagggggaggttttttgggggtccagccagaccgcaccggaggcggtcttccccatcttcttgccctcggaattcatcagaagggtgatggtcattgcataggcgtcctttcccagcttccgccggatgagctccgttccccccagcatattggaccactggtcatcgccaccgaactgcatattgcatccatattcctggaagagatggtagaagtcataggactgcataatcatgtagttaaattccaggaaggacaggcccttctccatccgctgcttatagcactcagcccggagcatgttgttgacagagaaacaggcacccacgtcacggagaagatcaatgtaattgagcttcaggagccaatcggcattgttgaccataatggcctttccctctccgaaatcgataaaccgctccatctgctttttgaagcagtcacagttgtgctggatggtttccggggtcatcatggaacgcatatcggtgcgccccgaaggatctccgatatatccggtgccgccgcccaccaaaaccacgggacggttgcccgccatttgtagacgcttcatcaggcacagcgccataaagtgccccacatgcaggctgtccgccgtgggatcgaatccaatgtaaaacgtggcctttcctgtgttgaccagctctcggatttcctcttcatccgtcacttgggcgattaagccgcgagctttcagttcttcatagatctgcatgacaattctccttttctcaatgtaacaggggaagaaaaaacgtcccctgtcatggatcatgacagaggacgacaaatatcgtggtaccacctctatttacccctttctcacgaaagaggcctcagcgggtctgacggtttccggtcaaacctcctgcgcgataacgggcgctcccgacataccctacttctccccagaggataggaggttcaggcagctgctccaggaggtaactttaccggcggcgctctccccttttcaccaaccaggggttctctgtgcagcaggcacgcaggctacttcttcccttcatcacagtggcagagtgtttcattgctatggattctacaccattttctcctgtttgtcaacggccattcttgaaggcttctgcttcccgcagcagttcttctgccccctctaagatggcggtagacaggtgggtgccgccggtcagccgggccagttcttcttttcgtccctgtcggtccagcgtttccacattggtaaaggttcgaccttctttttcctcttttcgaacagcgtagtggctgtccgccatcgccgcgatttgggccaggtgcgtcacgcaaagaacctgacaacgttgagagagacggctcattttttccgccacttttccagcggcccgaccactgacgccggtgtctacctcgtcaaagataagggtcataatctgatcgttttccgctaaaacatttttcagcgccaacataatccggctcaattctcccccagaggccactttggcgatcggcttgaggttctcccccacattggcggacatgagaaagcggacctcgtccataccagtttcatccagccccagttttccaggtttttgagaaaactccacctgaaagcgaacctttggcatgtccagctggcgaagctcctcctcaatccgggctttcaggcgttccgctgtttctcgacgttgcgcggagagaatctctgcctgcgcacgggttttggccaactgctcctttctctttttcttcaactggagcagggtatcatctgccatttcaatttgttccagttcctgtctacttcgggagagataggacagcatctcctggacagaggcaccatacttctttttcaggcggtggagctgatccaagcggctctctaccgcgtccagttcactgggggaaaaatcgaggctgctgcgcagatcccgtaggcgttccgctgcgtcttccgccgtataacgaagatccgccacgattccagatacttgcgcgagttcactggaaaagtccatgacaggtgcgagactgctctccgcttctgccaagagactggccgccccatctcgatcctcatcaccaaagatcgccccataggcgccttccactgcggccaccagctggtctgcgctgcggaggatggtttttcgtgcctccagttcttcctcttctcccgggcggagttctgcccgttccagttcttcaatttgaaactgaaggatatccagccgacgtgctttctccgcctcatccatttgcagagaggcaatctcccggcgcagggtatccagtttttcgtatgcctcttggtaactggtaagggctgcgtgcagaccgccgaaattgtccagatactgcaaatgacaggcttcatccaacagctgctgaccgtcatgctgcccatggatatcaatcagttggctgcccagagcctttaactgaactacggtacagggaattccccccacccggcagagattctttccgtccgcctgaatctttcgggagataagcagttctccattggcatcgggaaagatgccattctcctgaaaccagggcagctcgggaagggactgaaacagcgcggtgaccagtgccgccttttccccggttcggatgagatcccggctggtccgctcacccagcacggcactgatggcatcaatgataatagacttaccagcgccggtttccccggtcaagacattgaatcccggccccaaagagagatcggcttggtcaatgagggcaatattttcaatatggagcaaagaaagcacggtccagcgcccctttccaatccttatggattcttttccaacatttttacaatctccagacaaagctcttccgcatcctgggtggtccgcatgatgaggatggcggtgtcatccccagctaaactgcctaccatattgggcaagtgcatcccatccaatgcagagcaagccgccgaggccagaccaggcatggttttcagcaccacaatattttgggcgctgtcaaaggaggtaacgctttcccgaaaaatattgttcaggcgtccagccacattcagggaggttttccgctcactgacggcatacttataggtgctgcgtcctgtgagctctttcaccaggtgaagctccttgatatcccgagagatggtggcttgggtggatttcatccccttttcccgcagtttttccagcagttggtcctgggtttcaatatcatactcctgaatgatggcaagaatctccgcctgccttctggctttcatgcccggctcctcctttccaacttatggttgatcatctcgtagaaacttttgtcggataattttaccaggcacaggcagcggcgggaacggctgacctccacggtatctccagagaagagcttaaaggcttttcccccatccacagagaggtatgcggttttccggctctgcttgggaaccacaatatcaatgagacggtttttgtccaaaaccatggccttggcctggagggtatgggcgctgatgggagtcataataatattctccgccgttggttccacgatgggtcctccggcagagagggagtaagcggtggaccctgtgggggttgccaagatgacgccgtcgccaaatacattggaaatcagaattttatctccatagacttgtaagtcgattacacgggcgacagctcctttcgtgataactgcgtcattgagtgcggtgcttcgaaagatcacccgcccctcccgaatgacccgcacgtccaggagcatccgattttccaggctgtactccccgctgatcagacgggtcagctgaagaagctctccttgttccaactccgccataaacccgacactgcccatgttcacccccacgatgggaacgccaaaactgctggcatccttagccgcgtggagaatggtcccgtcgccgccgaaacagaccagaaaatccgcgtccggcagctccgttttcatctctttgattttgattgcgggatcaatctccccaatgttggacttttccactgggaagggaaagcaatattctgtgtgaacacccgcggcactgagcagacgttcggtacttctggcagcctttaatcctttgtcacgaaaagggttgggacacaggataattttcacggttcatttccctccaatcgttggtgagacgcctccaccaaagctttcaagtccccagagtaagggggctgttctgtcaccgtcaggtgacctaaatattcaatgtttccttctggtccccggatgggagagaaggtgaggtctttgacataaaactgacaagccgcggcatgctgcaaaaattgctccaagacctccaggtggaccttcttatcccggaccacccccttttttccaaccttctccttccctgcttcaaactggggcttgatcaaacagaccagctgacccgtttccttcagcaggggccggagggcagggagaatgaggcgcagcgaaataaaggaaacgtcaacgcttccaaaatccagggggtctggaatatcttcgctggttaaataacggacattggtgcgttccatacagacaaccctggggtcttgccgaagattccaggccagctggccgtatcctacatccaccgcgtagacttttgacgcgccattttggagcatgcaatctgtgaatcctccggtagaggctcccgcgtcgatggccacagcgcctaccaaagagggtagatcaaaggtctccatggctttttctaattttaagccaccccggctcacataccgaagggcttgtcctcggatttccaggttggcctcttccgggaccgaagcaccagccttgtccatccgccggccttcccaaaatacctgaccggccatgatgattgcctgcgctttctgccggctctctgccaatcctcgttccgtgagtaaaacatccaaacgcttcttacctgccatatgtcatgacctcccgggatttccggtataacgattccacgtccaatccgcaaagagcccgcagttggggaatggttccgtgggggacaaagccctctccgcaggaacagaccgtagcccccttcagagagagcccctgggctgccgccgccgccaaaatcccctcgcctggcccacccaaggagacgcattcttctgccacgagcagacgtcctgtcttttgcagagaagctaaaattgggtctgtgggcagaggaataatctggttgagcttgatgacctccgcggaaacgccgtccttggccaggcgatctgcaaccgccaaaaccgttccagttagggtaccaaatgtgaccaaagtgatgtcgcggccggagcgaagactgcaggcctccccgtcactgtggttggcctggtattggttttccccgccccggggataacgaaccgccacaggtccagagatgtgatggaccgcccggtccagcatcgcggtaagttcgtccaggctggccggagaaaggactgtcatccctggaatggttttgaggaatcccggatcaaacaggccgtggtgggtctcaccatcgtcccccaccaggccggcacggtccacacaaaaaaccgcatggagatggtcaatggcgatatcgtgaattaacatatcgtaaccgcgctggaaaaaggttgagtagacggcaaaaaccggaatcagcccctgcttggccatgccggcggtcatcgtgaccgcatgttcctccgcaatgcccacgtcaaaaaaacgctgcggaaactctttggcaaaatccgtcagtccggttcctgccgtcatggctgctgtaacggcacaaattctggggtctttccgcgctaactccctcaaatcccggccaaagcgtgcagaaaagctttccccgctgctgccctgggacagcgcgccactctctttttggaagggaccaatcccgtggaaatcatcgggatttttctccgccggacgaaatccctttcccttcaccgttttcacatggagtaaaacaggcccctccacggtggatgcatagcggagaagatgggtcagcccctttacatcatgtccatccacagggcccatatactggaatcccatgttttcgaacatactacaggggagtaagctggccttaattccctccttgatccgatggatggcacggtgaagcgccctgcctgggggcgtggcgtgcatcactttccggtagatttccttggcccatagatactgcggcttcagacgctgcttggccaggtgctgggcgaccccccccatactggcgttgatggacatgccgttgtcgttgaggatcaccaccagcggctccccgctttgccctgccatggacagtccctcataggccagtccgcccgtcagtgaaccatctcccagcaacgcaacgacccggtagttctcccccagttgtgtccgggcaatcgccatccccaacgctgtggacaccgcggtggaagcgtgcccggcaatgcaggcgtcgtgcttggactctgatggcttggggaatccggcgatcccgccgaatgcccgcagcgtctccatacgtccgttgcggccagtcagcattttatgtacgtagcactggtgccccacatcgaaaaccaaccggtccttgctggtgtcataaacccggtggagggctactgtcagttccacagcacctaaattggatgccaggtgcccgccggtctgtgacacaacttgaatgacgcgttgacggagggcttggcacagttcttccgcctcttgatcactgatcccagccaaggaaccgtattcctttccttggttcaaatcaacccctcctttggacagcgttgcaattgggttcacttggttcgcctcgctaaaaagtgggccaattcgcagagaaactcacgcccggaaaagggcgctaagaaagcaacggcttcttgggtgagttcctggacccaagcttcgcaggcggcaatcccttttaatgccacaaaggtggatttttgattggcttggtccgagccaatgggtttgccaaactccccctcatcccccatcacatccaaaatgtcatctcgcacctggaacgccaggcccagcttccgcgcatacgcagccgccgcagcttcctcctccggcgtgctccctgcggcaatggcgcccaaacgggctgcggcttctatcatgcatcctgttttcagggattcaatggcgaggatttcctcttcttgcagggagtttccctcccccagaagatccaggacctgtcctcccaccattccattcgggccggcagcattggccagcgcggcaatgccccgctggacccgttccgccggcagagatgcctctgccaagacggcaaaggcagtggtcagcaaggcgtctccggccaagaccgcattggcctggccaaagaccttatggttggtgggtttaccccgacggaaatcatcgtcatccatacagggcaggtcatcatgaatcagggaatatgtatgcaccatctccaacccgcaggcaaagggcaatgcatcttcggctgttccgccgaagagcttgcaaatttccagcaccaaaaccggccgaatccgttttcccccagacaataagctgtaagacatggcgtccttcagaacgccgtaggccggccactttgccgcataggtgcgcagagcgtcctcaatttgcacctgatccacttgaagttgcgttgtgatctccatatgatttactcctctggcacaaagggaacctccgatagttccccattctcatcggtgcgcagctttctcactttttgttccgctctatccagcatgctcacacattgcttcatccgctttacgccctcctcatacagggagagggcatcctccaatgtgtgctcaccgttctccaactgtgatacaatttcctccaaacgagtcattgcctgttcaaaggtcatctttttttctgccatcggtgtttctcctttcccgttgcagtacagaaaaccgtgccatccgaaacccggatggagagggcgtctccaggggtcacctgatccaccgcagagaccactgtgccgtcctgcccttgtgcgatggaatatccacgattgagcacctgaaaggggctcaatgcgtccagagaggccgccagacgccctatgttctgtctggcctgctgtacctgccgttccatcccatgggccaaacgctgctgatgatagtccaacagcagccgtttttcctgaatagaacgcagaggggagtgtaaaaatggactgccctggacctggtggagctggtcccgccgttgttggattgcccggtccatggcgctctggagccgcgcctccaaatggtccaaagtttcccgcaggtctctttgatctggaaccgccagttctgcgccgttggagggggtcgcggcccgcaggtctgccacaaagtccgcgatggtcacatccggttcgtgtcccacggcggaaatcaccggaatttctgaccggtagatggcccgtgccacggcttcctcattgaaagcccataggtcctccattgtgccgccgccccggcctgtaataatcaggtccgccatgtgacagaggttgattagttccagcgcctgacaaatttccatcggcgcctcttccccttggactcgtaccggtaccaccaacacctcggccagtggccagcgggtccctaaaatccgaatcatatcccgcactgcggcgccagctggtgaagtcaccagagcaatggtatgggggaaggaggggatgggctgcttatgggcagaatcaaataaaccttcccggtacagccgatttttcagctgctcgaaggcgaacgccagttcccctactccatccggtaccatccggctgcaatagagttggtaaactccgtcccgaggaaagagggacacccggcctgtcaccaccactttcattccgttttccgggcgaaatcgcagggttccggcttcccgccggaacattacacagcggatactgctctcggcatccttcagagaaaaataatggtggccggagggatacactttataatttgaaatttcactgcggaccaatacctgggacagcagtcgatcccggtccagcagtcccttgatatattggttgagggcagtgacggagataggttcggtcataatccttccttactgtgtatgcgccaagtgaggatggctacccccatggcattgtctgtggaaaaccgcggttccgcaaacaccgctccgcatgcttttgtcattctctgccgcaacagctgattggaagctacccctcctgcgcagaggacgggaagccccggatagcgcaccagcgcttgctgtgtggcggtttccaccccttgaatgatggaggacaacacataccagcagacctctgccggcggcgtaccgccctccgccaatgcgttcattttgttctcgattccggagaaagaaaaggtgcagtccgaaacttttacacggaagtgcgtcttgtcccgggcctgaagagacagctcgtccaccgctttccccgcgggaaatggaagtcccaacttctttccggttcggtcgatcagctgaccggcggaaatatccgaggtcccgccgatgcaggtcgcctgcaccatagcgccatctggcaccacgtacagtaactctgtcgtgccgccggagagatgccagaccaaatgcggctgatccagtaaatccattctccccgcggaccacgccgcggcggcaatatgtccctgctgatgggagcaggcgtaaaaagggacttccagaacggatgccatggcctttccctgggactctcccgccaaaaagcagggcatataggacccttctacctcccggggccgggtacttgccccgatggccgtaaggacgcgaggcaaatctgccgctttcagatcttccaaaatggcgggcagacgtttcacatgctggaacagcgcctcactttgccgaaggccaagggccccctggggtacttccaacagctttccggtgttgtcccccccggttccatcaaaccaagcagcggatgtggtatagttgctggtatccaatcccagtacaccggccatattcaggcctcctttggatcagaagtggccttgggccgaccctgttcagggaattccgcccgtacaaaagcccccaagatcccgttgatgaatgagactactttttcgtcctcatattttttggcgatctccaccgcgtcgttgatggcggcggcggcgggaatctctggcatatagagaatttcgtacattgccacccgcataatggcggcagcggtcaggggaatccgggcaaagttccaattttttgaatactgtgcaatatattggtccaattcaggcccgtgctcggccacccctcggaccacttcccggatgtattgcatctgtttatcattgggataatcctgatacaaaggggactcctctccccaacgttgaaaatgaacccggtccatccgttcttccaaaaattcctctggagattggttagaaaatcccaaggaataagagcagtgaatggcaatttcacgtgcggctgatctggtcatgtttcgttcctccatggtgggcagttcccaccggttttaatacctcggtctctgtttctcattatatccatgaatatgcaaaaaggaaagccctctggttccgattttgtgaaaactttttatcccatcggcacaaagagacccacggcagaatctgccgtgggtctcgaaggggacggaatcatcaagcttccggtttttcgaaggtcacgccgcccacacggacattgacagcagccaccttgagcccgctggtgtcttccacgctggtgacaatggcctcctgtacctttctggccacctccggaatggttccaccatagcggatttgaatggatacattgatggtaatattatcagactcccaaagaatcgtaattcctttggagagctttttccggccaaggagctgttcactcatcgtcccgccggcaagacctgtcaccccttccacctccagggcggcggcgccagcaatcatttccaggacctcttcggagatatagacgtccccgtacggctcactgcgggagtagtattctctgctttcactcattattgttctcctccgttgtggaaaaggattggatcggaagaccctattttgcggtgccaagaatggcaggatagcatctactgtaaggtacagtatatcatatccctggacggggagcaagtccctctttccgatccatggaaaaatcaggcctgatgcttctgggcggccagcagggtatttttcatcagcatcgcccgggtcatggggcccacgccgccggggacaggggtaatggcggacacaatttctttcacggcaggatagtccacatccccgcagagttttcctgcctggttgcggttcattgccacatcaatgaccactgcgccgggcttaaccatatccgcagtgaccacgttgaccttgcccactgcagccaccagaatatcagcggtgcggcagatctccgccagattctgggtacgggagtggcaaatggtcactgtgccatgtttttgcagcagcagcagtgccatgggttttcctacaatgttggaccggccgatgaccacacactgtttcccctttggatcaatatggtatgcctttagaatctccataatgccatagggggtacagggcaaaaatccttccttccccaccagcaaagcacccatattcatcggatgaaagccatccacgtctttctctggagagatggccatgagaactgcctcttcgtcaattccctggggcagcggaagctggcagaggataccgtcgatttcctgccgctggttcagctgctcaatgagtgcaatgagctccccttgcgttgtctcctcaggcagtgcgtattcctcgctgaaaaagccgcattcctcgcagtcttttcgtttgctgtttacatatacacggctggcggggttgttgcccacaataatcaccgccaggccaggtcttctggccagggtttccgctgcttttttgacttcctgcttgcactgctccgccagtgcctttccatccagaatcgttgccattcgtcagttctcctctccagtgtgttccatacgtttttttcggttgacataaagtgcttccggacttgggtgggtccgcattttacagagcagcaggacaacagcaaccacacagctcaagagggccaccatttgagaggttcgtattccggttgagaaaaaatacaaactgtcggtacgaagcccctcaatccatccgcgtcccaggccgtaccaggctacatagagcaaaaagtacatgccgtcgaaggtccgaatccctttccgcagcagccaaaccaacaggcagaagcccaccaggttccacagggactcatatagaaatgtgggatggacctccatatattctcctcccacctcaattcccatgcgccaaggcaggtccgttgggccgccataagcctctacgttcataaagtttccccagcgtccggcaatttgcccgatcaaaaggccaaaggcacagacgtctgccaaggccggaaagggaatctttttataccgtgccaccaaccaggcaatgaagaccccggcaataatccccccatagatcgccaaaccaccgttacgggtggacagacaagccgcaaggctccaactgccatcggggttgcgatagaggtccggattgaaaaagatgtaatagagccgcgccccgatgattccaccgggagcggcaaagataatcatgtccagaatgtcatcgggtttaagaccaaactttttagcctgggcacagcaaaaggcgaccccgaagaaaaaacccagcgcaatgataatgccgtaccaatagacgtgaaaggttccaatggagaaggcgacccggttgagatgaagggttaaacccagtcccggaaaggtcacggtactcattttcctgcctcctcaggccagataacaatcagggacgtttgctctggtttgatccaaacccggagaaattcctctacatcctggcgtgtcaaagcatcatagatctctggaaatgtccaggggttctgttcagcaaaatacccctgcgcctgctctacgcagagcgtttcaaaggaattcagcccccggacgtaggcgccataggcagcctttttcagccgttggaaaaaggcctcttccatcccctcctctgcgatccgctttccttcctgcaggatggcatcccgtacgccttccgggtctttggtctcacctcccgccaccaaaaaggcacagcctggatagtccatatagcccaagtaaaaactgctgttgataaggcctttttcatacagtcggttgtacaagggactggaatttcccgccaatgcttcacaggccagttctcccaagaggcgctgccggagttgggccgcacctccttccgcaggctgccctttgattcccagctggagcaagggagcggacaccgccatggtccggctgttctcacgggcaaaaacctgacggggttccttctccccacagtctctgggaatgggaggcttggcctggctgggtaagatctctcgggccatgtcacagactttttgcggctctacattccctgccacacaaaggaccatgttggagggggtataaaatgcctcatggcactgatataaggtctctgcggtaatctcagcgatggattccacggaaccagccacagaatttcgcaccgggtgatactggtacagagcttccagcagcaaatgataggcctgccacccaggctgatcctcaatcatgcggatttcctgcccaatgatcccttgctctttgtccacactttccttggtaaaatagggaaccgaaacaaactccaacaaggtccgcagattgtcccaaaactgatccgcgcactcaaagtgatatccggtgatcgccgtactggtaaaagcattgggagaggctcccgtggaggagagtgtttgcagtgcgttccctccatccggcgtgtcaaacatcttgtgctccagataatgtgcaattcccattggcgtgtccagccattgcccatttttctgaaaccgggtatccatcccgccgtaccgggtggcaaagaacgcatagtactttccaaactccggcttaggaaacacaaaaacccgcagcccattttccagcgtctcctcgaaaacggtctctccgattcgcgcatagtctcgtttgaccatcacaatcagccctcctttccccgcagggtatagacgctgtccaactggacgcgctgtgccacctgcaccacgtcttcccgtgaaacggccttgactgcctctgccagctcttctggcgcgaaccgcgtgccggagaccgcgcggttcagccaatattcctccaagcgcccctgggcatccaaggtagtgcgcagacttcccaccacagaccggcgggcggcctccagctcatccggagagatttctcccttctggcatgctgacagctgcgctaaaatttcctccgccgctttttggaaattggaaaattccaccccagaatatacctggagcagtcccttgttctgtgccaaggaactattggcaaaataacacagggagagcttctcacggacatggaggaaaagcttggagttcgtcgtccccccgaaaatggcgttgaacagcaatcctttggcaactgtggagacgtcctgaaaccctccgcctgtccgaaatcccaggatcagctttccttggttgacatccaggttatcgtggaagcggcggacggggccctccggttccatttggacttttgtcttggggacagcatgacgctgtgtgttgggaaggccggcaaacgccttccgaaaggcccgttccacacggtcagcgtctgccgaaccgcagtaatagaaacaaacgggagcggtttccagtatctcacgataccggtcatagagggcttcccctgtaatggcctggacttgtgcctctgttcccagcttgtctaaaccatacgcttccccttggcacatttgcgtgcgcaggcgcgagagcgcatattgaagtttatcattgacctggctgcggatcttttggagcaaattttccttctcactctccacataagccggcaggaatccctccttccctccggcgggcgccaaaaccagttctccaagcagcgcggtggcctcctccaagatgtgggtcttttgagggacaaaggcatcgtctaaaaaactcccccaaaagccgatgcactgcacttctccctttttgcggagaatgggctcgattcccccgccgtagagatcatccagggcagcggacagcgattccatgtccgggtgacgctgggttccccggcgcaggactttcggtagcagggcattgagggaggcgtggtctgcagtcaatggttccagaaaggtaaccgacagcatagatgttttgaactttttagtctgcaccgcccggagaatcaccccgggggccaagacagattccgtcattgggagcatcatcttgccctcctttgtgctggtagttaaagatattctaccataatttatgagaaagtaaaggactgccaaagcttctaagaaaatcctgtccagataaaccggatttcatacaaatttctcttgacaaaacctgtcatctgcggtaggataattcctgttgtaaaggaaatcagctttacatgttctggaagggaggagccccatgaaaaatcaagcctatcggatggccatgctctatgacttttatggggatcttctcacgccgcggcaaaaagagttctatgatctgtactataacgatgatctttccctggcggaaatcgcggagaactatgacatcacccggcaaggggtgcgggatattattgttcgggcggagaaaaccctggaagacatcgaggaaaaaaccggcctgatccagcgttaccaccggacacgggccaccactgccgcgctccgcagcctgtgcagtcagcttcaagccctgaatcaggccagatttatggaccgggagctggatgacttgggcagacagctcagcgacgccattgacgatttggagagggagtgaggttccatggcatttgaaggtttgactgaaaaactctcctccgcatttaaaaaactgcggaacaaaggccgtctgacagaatcagacgtcaaggaagccatgcgggaaatccgtctggctctgttagaagccgatgtaagctacaaggttgtcaaagattttatcaaagcagtgacggaaaaagcggtgggcacagaggtgctggaaagcctaacccctgcgcaagccattgtgaaaattgtcaatcaggagttggtttcccttatgggaggcggcagtgcaaaaattaccattgcctcccagccaccaactgtggtgatgatggtgggtctgcagggcgctggtaagaccaccaacgccgcaaagctggccggcctgatgcggaagcagaatgggaaacgccctcttttagctgcctgtgatatctatcgtcccgccgcgatccagcagctggaggtggtaggaaagcaactggacattccagtatttcaaatggggcaggaaaatcccgttaccattgcggaggctgccattgcccatgcgaaaaagcacggaaacgatatggtgtttctggatactgccggtcggctgcatgtggacgaagccctgatggaggaactgcaagcgatcaagcaggccgtgcagcccagtgagatcctgctggtggttgacgcgatgatcggtcaggatgccgtcaatgcggctaaggcctttgacgacgcattggacattgatggtgtggttctcaccaaattagacggcgatgcccgtggcggcgccgccctgtccattaaggcggtgaccggcaagcccattaagtttgtgggcatgggggaaaagctggataatatcgaggtgttccacccagaccggatggcctctcgaatcctgggtatgggcgatgtgctgacgctgattgaaaaagcagagcagcagtttgacatgcagaaggcccaggaactggcagagaagctgaagaaaaaccgctttaccctgcaggactattacgatcagttggtccaggttaagggaatgggttcgatggatgaactgctgggcatgatgcctggcctcaatgccaaggctctggagggagccaccatcaacgaaaaggcgctttcccggacagaggctattattctctctatgacaccacaggagcgggaaaatcccgccattttgaacagcagccggaaaaagcggattgccgccggctgtggtttgcaggtggtggatgtgaaccgtctgctgaaagaatttggcatgatgcagcagatgaccaaacaaatgaccaagctctccggcaagcgccggaaaggaaaatttgggaaatttcctggcgggcttcccggtctccccttttaggtaacttggttggtatccgcatacgcggttccatagataagaacgcaatttatttggaggtgaaagaatatggttaagattagacttcgcagaatgggctccaagaagaaccccttctatcgtattgtggtggcagattcccggtatccccgcaacggccgctttatcgaggagattggcacctacgatcctctgcaggagccctctgccgttaaggtggatgccgagcgtgcgcaggcttggatcaaaaccggcgctcagcccactgagaccgtgaaggcgctgctgaaaaaggccaacgccatctgatttggagggcacatgaaggacttgctcacttatatcgcccaaaatctggtggaacacccccaggccgtggacgtacaggagacggaaacggacggtaatgttgtgcttgagctccgggtcgatcccagcgacatgggaaaggtaattggccggcagggccggattgccaaggaaatccgcacgctgatgcgctctgtggcccagcgccagggcaaaaaggtttccgtcgaaattatggactaaagaatggcggcgctttttgcgtccgccattttttcatggaaaaggagggcgttgccttgaaacaccgatatttggaagccggtaaaattgtcaatacccatgggattgcaggtgaagtaaaaattctgccctgggcagatgaccctgcgttcctgttggatttcgataccctttacattgacggccagcctgtgtctctgctgggggccagggtccataaaaactgtgtgctggccaagctggctgggatccatgacatcaatgaagccatgaaactgaagaataaggtggttttcatcgaccgtgaggatgcagaattggaagagggcgcgttttttctggccgacctaatggggctggaggtcagagatgccgacagcggagaggtgttggggcagattgcggatatcctcacccctcctgccagcaatgtctatgtggtaacaggggggaagcaggatcacatgattcccgctgtcccggagtttattgtcgagaccaatattgacgagggatatctcagggttcgcctcattgaagggatgtgaacgggatggattttctctatcacattcatattatgacgttattccccgatgtggttggtgacatgctctgtgaatccatcctggggcgtgcccaagagcggggcatcattcgtgtcgattgccaccaaattcgggactataccctcaacaagcaaaagcaagtggacaactatccctacggcggcggccatggggcagtgatgcaggccgatcctctctaccagtgttggaatcatatctgtcaggaggcaggagaacggcttcacaccatctacctctcccctgccggcacggtgtttcaacaggcggatgccaagcgccttcagcgggattaccaaagcctgattctcgtctgcggccactacgaaggcattgacgaacggtttattgaggaatgtgtggacgaagaaatttctttgggtgattttgttttgaccggcggcgaaatccccgccatggctgtggctgatgcggtctgccgtctggtgcctggggttttatcggatgccgcgtgctttaccgatgagagtcattgggacggcctattggaatatcctcagtattcccgcccagaggtctggcatgacagacgagttccgcccatccttctctccggtcaccatgccaacattgctaaatggcgtcgaaaacaggccctgatccgaacccgagaccgtcgtccggatctctatcaaaaactggacctcacttccaaggcagatcaaaagctgctgaaggaaattgcgttggaagaacaaaacagttaaaaatcacggctgcgtttgatcgcagccgtgattttttcgtgtctgaaacgcctcagatcttatttatttacaacgaaggtttcctctgtcaactcattgtacttgccgcgcttgacatagtgcgtgtgcagatactcatgagaggcatgacatccgggctcaccccactctttatagaagtccatcaaggacttgttctcgtgggacttacgaacaactttgcgctcatcctcgccataaatcgcttccattctcttctggcggacaatgttgatgtcctcctggggcctgggctgcccgccgccggtgatacagccgccgggacatcccattacctcaatgaagtggtatggagaggtcccctccttgatctgttccatcagcttgcgagctccggcaaaaccactggtaacagcaatttttacctcaaatccctctgcggcacgccattctggcttcacattttccagcttgatggtcgcctcccgaatctcctccaagcccacaatgggagagacatggaggttggggaacggaagctcccgtcccgtgataatctcatacacggtacgcagagccgcctccatcacaccgccggtgacaccgaagatgtcggccgcgccagtggagaacccgagaggatcatcgaacttttcttctggcagccccaggaagttgatgcccatggccttaatcatgtctcccagttctcgggtggtgagcaccgcatccacgttggggacaccgtcattctgcatttcaggacgggcacactccgtcttcttggccgtgcagggcataatggagaccacatacatatcctccggttttttgcccagcttcttggcgtagtagcttttcaccactgccccaaacatctggtgaggagacttgcaggtggagaggttctccaaatgttccggatagttgtgctcaataaactgaatccagccgggggaacaagaggtcatcatgggcagcgtagccacaccgccggagagaaccgcccggaaccgctccaggaattcggtcccctcctccagaatggtcaggtctgctccccagttggtgtcaaagacatcgtcaaatcccatccgatggagtgccgcagccagtttcccggtctcacaggttccagcggggagaccaaaacattccccaatgcccacacgcaccgcaggcgcaggctgtaccaccacgtgcttattggggtcattgatcgcccgaaggacacgatccttatggctggtctccttcagagcgcctaccgggcaaaccacgacgcactgaccgcaataggtacaggctgtgttgccaatgggaagcccaaaggcaggcgtaatcaccgtctggaaaccgcggttttccgcagtcaggatggaggtggtttgaatcttgttgcagacactgacgcagcggcggcacaagatacacttattggggtcccgggtgagggattcactgacatcaatgggacgcagatcgcgctccccctcatagggagactcctctacccccagttcccggcccagcgcctgaaattcacagtcctggtttctggcacaggtcaagcactttttgtcgtgattggagaggagcagctcatacatggttttccgggcttcctgtaccttggcgttgttggtctcaataaccataccgttccgggcctccaccatgcaggaggcctgcaaattctttgcaggagggttgatctgttccaccacacagatccggcaggcgccatattggtggatgccctccagataacacagtttcgggatatgaatgccgttgcgctccgccgcctgcaggatggtgctgccggcgggtgcggtacattctttcccgttgatcgtgagtttaatctctgccatgactcttacctcctgtcgcaacgcaggcagcggctggcttcggcacgggcatccagctcatgcatgccaaggtttcgttcacagaagctgccaactgctttttccgcctcgatctgtcttgtcaggaagcggttatggggaacaatatcaccttcaatgtgataatctgtaatctcttgatcaaagccctttgccaggacacctgtcccgcccaaatacttgtcaattccggaggccgccacttttgcctcgtggaccgcattgacaatatccttgggaccgcggtgggcgtctccgccgacaaaaacaccgggcattgaggttgcctgggtatagcggtccgccacaacccggtctccattgagctgaatggtccctttgatgaacttggtgtcaggggtctgggagatggcgggaatggcaatatcgaattcctccacataagtctctccgctggggaccgctttacggcggccggagctgtcaaactgccccagcttctgcttcataatgcaaatgctgttgagtttgccgccgattcccacaaagtcagtggggttgaccagagtgcgaatttttacgccctcttccagtgcgtctttaatctccactttgtctgcgggcatatcttcctctgtccgacgatagagcatcaccacttctctggcccccaggcgaaccgctgttcgggcggagtcgatggcggtgttgccgccgccgatgactgcaaccttctttcccgtgaagtccaggtcccgctggaggataacccgtttcaggaagtccaacccgtgatagaccccttccagatcctctccggggattcccagctgcagtgttttctgtgcgccgatggcaatgaaaatcgcatcatagttcttttgcagggaacggaacgacacatctacgccaatcttggtgttcaaaatgatgttgacgcctgtcttcttgatattttcaatctcccgctcaatgatattcaggggcaggcggtaatccggaatgccataggtcataataccgcccggccggttctctgcctcatacacgtccacatggtagcccagccgtgccaaataatatgcacaggtcaaaccagacggtccggcaccaatgattgccacattcttgttcagctgtgccacaggcttaaactcctcatcggaggggaagccctgggcataggcccagtcggtggcaaaccgtttcagctcacagatgttcatggcttcatccacactgccgcggcggcagcggctctcgcagggatgggtgcagacacggccgcagatgccggagaacgggttatcccgaagcataatccgggcggctcccatgtaatctccggtggcaattaggctcatataaccggggatgttgatgcccgcagggcaggtgttttcacaggggctggagacaagctctccgcagacccctgcggaacatcgcttctccacaatgtgctcctcgtactcctttcggaaatacttgatggtggacaggactggattgggtgcggtctgacctaagccgcacatggcggtgtctttgatgatagcccccaaatgttccaaggtttcgatgtcccccggctttccttctccagcagtaatccggttgaggatctccagcatccgtttggtgccaattcggcaggcggtgcattttccgcaggattcctcctgaataaagtccagatagaaccgggcggtatccaccatgcaggtgtcctcgtccatgacaatcaaaccgccggaccccacaatcgaacccagcgcggccaaggattcatagtccagaggcgtattgatattttccgcagtgatacagccgccggaaggaccgcccgtctgcgcggatttgaacttctttccgttgggaatccccccaccgatggaataaatcacctcagacagcggggtccccatgggcacttctaccagaccggtgttgacaatgttgccggaaagagcaaatacctttgtgccagggctcttctccgtcccgaactgacggaaccagtctgccccctgcagcataatggcgggcacggtggccaaggtttccacgttgttaatgatggtgggcttgccaaacaaaccgctctggaaggggaacggcggtttctgtcggggttcccctctctgcccttccacagacgccatcagcgcagtttcctcaccacagacgaaagcacctgcgccaatccgaatttcgatgtcaaagtcaaaaccagagccgaagatatctttccccagcaggccttcctcccgagccatctccagtgccgcctggagacgctccacggcaatgggatactccgcccggatatatacaacgccgtgggccgcgccaatggcatagccgccgatgagcattccctcaatgacactgtgggggtctccctcaaagacagagcggtccataaacgcgccggggtccccttcgtcagcgttacaaatgatgtacttttcttccccaggctcatggtaagcagcttcccatttgacgccagcggggaatcctgcgccgccacggccccggaggccggaccgcttcagctcttcaatgaccgccatccggtcacctttttccagaatccgggccagagccaaataaccatctttggagacatagctattgatgcagttgacatcaatcaatccgcaattccgcagcgcaatgcggacctggtcccggaaaaaggccacatcatggatattggagacccgtttcttctgaatgctgtcatagaaagtatattctgtgaccggttctcccccaataaagtgcttctgcacaacatctttgacccgctccggggtcatctccgtgtaataagtctcatcgggcaagacgtagaccacagggcccaccgcacaggtccccatgcagcctctttcgatcacggctactttgtcagaaagtcctgctttttccagctcttccaccatggcgtctcggacatttttacagccggaagacatacatcctgtaccgtagcacaccatgcacaggtgtgtatattgccccatcttttccagataggcctccttcatctgctgaaggtctgcaatgcttcgaatcatccctgtgcacctccctcggccagttcttccacaggctcctcatactgagccaaaattcctctgagctttgcaggtgtaacctgcttgtaaacctcatcatccaccatcatggcaggggccaagccgcaggcaccaatacatcgggcaatctcaaacgtaaactggccgtcctcggtggttccaccaacctctacatccaattcacgcttgatggcatccacaacttttttgccgcctctgacatagcaggcagttccctggcacatccgaatcgtgtgctttcctctcttttgcgtggagaagaaagagtagaaacttaccacgccgctgacctcggacacaggcaggtccatgccgtcggcgatgaactcctgcagctccatggggagatagccaaaaatctcctgggctgcgtggagcaccatgatcagagatccttccttttctttgtactgctcaatcaccttggcaaccgcgtcatacaacgctttttcatcggtgccgcaggtggcgcagacaatctctggtctttcgttcatagttttcctcctttttgccacggacacgatatgggcagtccgggggcagtttgacaagccatttgcggctaaaaaaaagaaacggtaggcgtatggaactttgacgcggtgctccttcccggctaccacgccgcccgacaaaaaagaattctttctggaactgatgaaagaagcctcaaagccgaaaacggatctctctgcacaaacccgggcaagcatgtcagaattgaactcttcctatctatattgaaatccgttgtatcaaattcaattatatggttcctatttatttttgtcaattataaaatgttcctaaaatgccattcgcccttccgaaaaattcattatgaccctatattttgtgccaaaaccacacaattcttcaaaaaaccttccaaaatagaaggatataatgcagacaggaagcggccatcttgcaaagatggccgcttcctgttctggcaaggaaatagagacacaaatcgagttaatttatggagataataaaacaaactgtcaaaatagacttcacgcagtcgctgtactctgctgtacaaatgcagctgcctgagacatcacggctgcaaagctctgtacatcaaagcctggaatttcctgaaatacattgcccaggcgctgatgcaggcactgccgaaattcttcggccagggcacgccccttctgttccaagtgaatgatccaggagcggcggtcattctcatccaggcaggtcgataaatacccttttctccgcagagaatccaccatgcggcaaatggatgagactgagagcggaagattggttgcctgaagcttcttttgggtgcgagcatcgggatacagcgccaggtggaccaagacaagcatctcattctctgttaaatgatgttcctttcccaggtcagatagaatgcagcgatattggtctgttaaaacataacaggcgttgatcacagcaaatgaggcatccccgttacagagggacgtgctgtcggctctcattttagttcccccttcaaatatgacaaaatcgccggaaacggctgtttattacagaggaaactataacactggaaaccactttttgcaagcaaaaaatttattctttcatattttttgtaaattttcacgattattttagggttgtcacgggataagatgcaaaataatgctctaaaaatgaatcaatttatgcaagaaggaaatgtttctgtcatttttttcctgttcttgcatcaatggcaacatcctgagcttttgaaaattcccccgttttgttctgttctgaattgatctgtggtataaaaataggatctgctattacaagcagatcctatttttgcattgtgttaggttcccagataagctgcttttaccgattcgttggccagcagttcctgccccggcccagacattgtgacgcgtcctgtctccataacataacccatatccgctgtcttcagtgccatgtttgcgttctgttcaatgagaaggatggtaacgccttttttgttgacctcttcaatgatccggaaaatttcccggaccaccaacggagccaagcccagagagggctcatccatcatcatgaccttgggacggctcatcagcgcccggccaacggccagcatctgctgctcaccgccggacagagtgccgccggcctgccattcccgttcccgaaggcggggaaagagactgaacacccactccatatcttcactgatgtcatccttccgaagatacgcgccgacgcggagattttccttgaccgtcagatccgcaaaaatccgccgcccttccggaaccagcgtaataccccgggagacgatctcagtagggttttttcccgtgatgtcttctcctcgaaacaggatttttccgcccttgggcttcaccaaaccggaaatggcccgcagcgtggagctcttgcctgcgccattggcgccgatcaacgtcacgatctccccttccggtacatcaaaggaaatccccttaactgcctcgattcccccgtaattgacttgtaagttctgaatgctgagaattggttcactcatcttctaccacccccaaataggcgtcaatcacgtgttgatttttctgaatctcactgggcagtccctgtgcaatcaggctgccaaaatccagcacgtagatccggtcggaaatgttcatgaccaagtccatgtggtgctcgatgagcaggatggtcaaatggtgtttgtcccgaatttcatggataaagtccgccagttccagggtctcctgcggattcatcccggcagccggttcatccagcagcaggagtttgggttccgtagccagggcccgggcaatttccagacgccgctggaggccgtaaggcaggcctgtggccaaagcgtctcggtgctgccacaatccctgctcccgcagcaaagcctcggtttcctcccgcatgcgggcctcttccttgcggctgatccggaaggtggaagaaaatacattgtgcttggcccgcatgtgcttggcgataatcacattgtcaaagacagtcatactcttccacagacggatattctggaacgtacgggcaatgcccattttcgtgatatggtcgggcgttggggccagaacatggtttgaaaacacgtaatgatcccgctgcttctcctcttcttttgtcttttggccttccagcttgtactcgctggtatatagcagtccattttctcccttgtatcccttcttcatcttcccttggggatgattgcggagatagaccttatcatggaacagtgcctggccattggtgggctggtagacgccagtaatcacattgaatgccgtcgtttttccagcaccgttcgggccgatgagggcgacgatctctcccttgttcacctccagggagaggttatttaccgccaccacgccgccaaactgcatggtgatattttctaactgcaagacgtgttcccgctcacgcatcggtgtcgtcccccttcccttcggtcttttcgggcagctttgcttctttggatgccttccgttttctcgcctttcgaatcattcccgagaaggagagctccttgtctcccataatgccccgggagaagaaaagaacaatgatcataataacaacggagaaaaccacttttcggaaaccatctcggaagaagggcaccgacatccccataaaggaaccgctgtccaggaagcgcagccaccactccgagcaggcgatgtacaggaaggaggccagacagcttccggtgatggaaccgatgccaccgattaccacgatcagcagaagctcgtaggtcatcgtggaggcaaagggatccgcctgcacggttgtctggaacatagccagcagcgcccctcccacgccggcaaagaagctggaaataataaaggagagcatcttgtgcttgaacaagttaatgcccatggcttccgcggccacttcatcatctcgaatggacttaaatgcccggccataggaggagttgaccaacaggacgataatcacaatgctcagcgtcgcaatcaaaaacgggaagatggtatccagttggaaaatggtgccgcctatctgaattttaatgtcatggaagttggtgtatttccgcagcaggttggagccattggtgatctttcccaagccattccactggaaaatcgcccggataatctctgcaaagcccagtgtggcaatggccaaataatcgctcttcagccgcaggacggggatgccgatcagcgcggcaaatacagcggccaccaatccggcgatcacaatgcagatgatcgcacccaaaaagtttccagcattggcgccaaagacattccccagcatttccggaatggaaaactgaatcgcgcctccatcaaaatactgatacaccgaggcgtgctgctccgccgggatggagaaaatggaaaaggcgtaggcgccaatgagcatgaagcccgcctgtcccaaagagaacaggccggtgaatccattgagcaggttcatggacacgcagaccagcgcgtaaattgcccccttcttcagcaccgtaatcagcataacggtggtggaattgctcggcaacgcgttatccagcatgaaaaggaagacatacagggccaccagtaaaacgatggcgatcaggctcccgatcttcttatcggaggtcattgcaggtcgtaatctttttcccatcattaccacctcacaccttgtccgtggacttctcaccgaagatgccggtgggcttgaccaacaaaatgacgatcaaaaggacaaaggtaaacgcatcagagaattccgtcagccccagtcccttgatgatattctcacaaattccgatgataaacgcgccgatgaccgcaccgggaaccgaaccgattccgccgaacaccgctgccacgaaagccttcagaccgggcatggcaccggaggtgggaatgaccgagttatagttggtgaagtagagcagagagccgatagcagccaggaagcagccgatcacaaaggtcatactgatcacgttgttgatcttaatgcccatgagctcactggtctcaaagtccctggagaccgcccgcatggccattcccgtcttggtccgcttgatcatcagcaccagcagcagcaccagaacaatggtcagaattggtgtgatgatagtaaccatcttggtggtggcggaaccgatctgaacctgttccgacaggaaaggaatggtgggataaatctgcggcaggccgcctgtgaaatacaaggcgcagttctgcaacaaataggatacgccgatggcggagatcattaccgacattcggggcgctgaacggagaggcttataggccaccttttcaatgataacaccaatggctaccgtgaccaccaccaccaggacaatggaaacatagatcggcagggaggcggttgcgtaaaccataaccaagcccgccaccataaacacatcgccgtgggcaaagttgatcagacggaggatgccgtagaccatggtgtagccaatggcaatcagcgcatactgtccgccgacggagatgccggagagcaagtagggcagattggcagataaaaattcagacatcgcagtctcttctccttctctcttgattttggggagcgcatcgatccgtttctcagaaacggaaggtcctgtggaacgcatagatacgttcccaacgggaagctttcacacaagatagaaaatcctgtcgaagggaatcct

SEQ ID NO: 2219 - DNA, 204670 bp, KLE1738
ccgcctgccgcaggtcttccgcgacgctgagcacgccgatcttggagaaggtgatgagagcgtcccccggctggacctgggtgtagtccacggtgtggttcatgcagaccaagggggtcttccggtggtggacctccacctcataactgtctccacagctggcgatgatgcgcaggagaaggtccttggcctccggggcggcgcagaggtggacctctggcgccaggacccccagaatggcccgggtccaggcatagccccgctgccggtcggcgatcatttgacactcgtcgatcacagccacctcgtagggctgtttcaggtccagcttttctgcggtggcggccacgtgggtgtctcccgcccggcggtcctcctcctcaccggtggtgaggctgcagtcgatgccggcatccagcaaaacctcctgggcttccagggccagcaggcgcagaggggccagatacaccccggtgcgggcctgcttaaggcgctgaaacccggcgtaggttttgccggtgttggtgccgcccaggtgaagaatgaagtggcggtccatggcccgggcctcagggtactcgtccttggggttcagggccatgaggacctctaagctggtgcggatggcttggggaacatagcagacggagtagagatagcccaaggttcgggagagcagctgagagacgggaaagtccttcatctgcagcagcgccggcagatcggcctccggctgggcggcggtgaagctgacgatgacctgttccgcggcggcccggagaaccccgggatactgggctttgaccaacccggccaggggagcgtctggatgatcccccagccagacacccgcttggacgaaatgggtgagcaccccggggagctgggcctcatcgcagcgggttcccagggagagaaattggttgagaaagccggaaatctgattggaccgcagcccccggccccgggcggcagcggggaggtgggagacaatggcctggtgataatatccggccagcacccaaggccaggtttcctccctgggggcgtcctgccaggcccggcccaaaagggcggctgccgcttgggccgcagccgcggcggcctgcaggtcggcgccccggggcagggcccccctggatttggcctgaaaggccgcggtggcctctgcggcccggacatcgtcccggtgccaatgggggacggagcgaccgttgaaacggcggtattggggacggggaagaagctgtgccataagttccttggtccatccccggcttttcaaaagtcctggggtccaaagcttgcctgatctcctgtttgccatcgccgtctccctccttgttggttctcttattgtagcatgttttccgcctgggggcaatcggggctctgccttgacattctcccctggacgggcgtatcataaaaccagaagccttgattttttgagatttcattgtttttataaaagaggaggttccatggcagagcagaagcagaaaaaggcggggctgaccatttccctggggcgtcggcccaaagtgttgctgctgggcaatgggatgaaccgggtctatggcggcgcctcctgggcggggctgctggaaaagatcaaccggacgtcctttaccgccgaccaggtaaagtccatgccctttcccatgcaggcggttttgctgagccgggaccaggtggatgtttccctccaggacctgcagcgggagctgacccaatgcgaggtccatccctggctgggggagcagctgcggcgtctgctggcgatgccctttgactgcatcctgacccctaactttacctatgaggtggagtgcgcgctggtccctgactttatggatcatcccctgcgctatctccgccatactgcggcggttcctcgggcggagaaggggtttatgctccacacctattataatctgccccggccccagggggatcttcccctgtttcatgtccatggggaggccagggtgcccaatacggtgattttgggccattactactatggcaatctcctcttctgctgtgatgaatacctgacccaccgggcgccggagcagcgttatcccctgtggccggggcatgggtctctgccggcgctgagctggctggattactttattttgggagatgtctattccctgggatttggctttgatacctcggagatggacctgtggtggctgctgtgccggaagaagcgggagcgggccccccacggggacctgtggttttttgagccggagcgtcagtccgctgagaccaaacgcgccctgctggaggcctaccatgccaagtgcgtgtccctgggattcagggagccgggggcgggggactatcgggccttttatgaagcggcaatccaggagattggacggaggctcacggaggaaggaggagccagccagagggagtaggcgaacgggaccgcctgaggagggggagatgggaatgagaaaaatccactatggctgggtgatttgtgtgacctgcaccttgctcctgtttgtgaccatggggacagtatccaatggattctccatttacctgccctatatcatggcggagcgggggctgacccatgcccagacctcctccctggtgacccttcgctgcctggtggcctttgtggccatgctcctgattggaggatactatcgaaaggtgtccctgcgggtggggaccgggcttgccgtgtgctgtgcggggcttgccttttggctgtacagcgcggcggagacctacccgcttttttgtgtgggggcggcagtgtccgggatcagctatggtctgggctcgatgattcctgtctccatcctcatcaaccgttggtttgaccagcatcgggcgctggcactgagcatctgcgcttcgggcagcgggattgcgaccattgttctgccgccggtcaccacccatttggtggaacggttttccatgtctgcggcctttcgcatgggaggggcggccattcttgtttgtgcaggggtggttctgctggtcctgcggaatgaccccagggagaaggggttgcgtccctgcgggcagacggagataccaccagaagcgccggcaacggcggtgtctccctcccagggggcgctggggagacgaacctggatcttactgggctgcgccagcttatttatgggtgcggtggccaatccgggcttttcccatctatccgtgctgtataccacggaggggtttgcaccggccacggtggcgctgatgatcagcggcacgggggtgatgattaccgtgggcaagctcctctatggggagaccacagaccggatcggcgggcgggggtcctgcctgctgtttggcggggttctgctggctgggcatctgctgtgctgtttggcctttgtccagagtacggcactcagcgtggtcaatgtcctctgcctgggactgggctatcccatcgccaccatgggtccctctgtatggtccaatgatttggccgcgccggagcaataccccgtggtggtccggcggctccaggtgatctatgccggcggtgccctcctcttcgccagcctcccgggtctgttggcggaccggctgggcgggtatattccggcctacctgctgttttccgccatcattgccctcactctcctctgcattgctttggcctatcggtcggggggaggcgaccggtgagatagaaaaagagaacgtcctccgtgcggttttccgctcggaggacgtttttttgatctcagggggcagttccatcttggggggaggtgccggcaggcggctgtttggctggccggtcaaagtcaggcagaaggaaggtgcccaccaaaaaggtgagggaatacagcgcggtgaacatcatggccacagtccagctgacggtgttggccaggtggaccacaatggcatagataatcatctgtaaaatgtacgcgccggtccagtagagggtgaggatcacggcgaccttttgcggggtagcgcctggcaggcgggcgggcagggtgaacagagagggggtggaaataaagatcacaaagcccagcaaaatggcgcatacggtggccagaacggcggaattggtgagaatcatggcgaaaaagagaatggactgggcaaccccagagaaacggaacagcgtgatctgccgtttgagctttttggccaggacgatgcccaggatcgtgcctggaatccccgtcaaggcgatcatcagggagataaactgtgcgtccactgtgaagtcgggatgcaggggaaacagatacagcatgacggtgtacatcaccagacggccagtcatggtaaagaggaatttatagagaaagggctctcgtaagccgtcccgatagcggtagaccgtggaggagagggtctcctctttggccttttccgcaatgggatatccccgacccacaaagagccagagaaccagaaaaaccacgctgaagatcccgtaaaagaggatgacgctgcgccaggaccccagccacccccggacggcggtgacgctgagcagggcgatgagattgccggtattggggccggcgttgttcagcccgatgaagatgggctgctgtttgggctcaaagcaatagaccacatagggggtcatgcagatcatcagaatcgcgccgccgaatcccagcagaaaccgcgtgagaatgaaggcgggaaaagaggtggaaaacgcccccacaaccaccgcgcagatcagcaggcaggacagggagaccgtccgcttagggcccagcttcagaagaatccaggcggcgacaaagtttcccagaattttggccgcggagatggcgttgttgacagaggagggaatggtatacacgccgaattcctgggccatgtccgttgtgacgatggacccaaccatccaggaggcactgaagaaacagtaggcaaaaaacaagagcaattcaatggagagggcccgcttggggccaatgaccttgggtggcaagggagacgcctccttttttgagcccccagttttgggggcataataaagctattgtaccttgaaaatgaccattcgtcaaggaaaacggagcctccttttgggcaaaatggagagaaaaccccaaaaagggacggctttgtcggaaggaagagaaaacggttgaaaaaggagcagtctgtcttgcagggaatttggcggtggtggagcagagccgcctgaaccggcaagcacaaaaaatggaaaaaaaccagcagttcccggtgttcggggacagctggtttttgttattctgggaaggggaacgtgcgacgccggacagaaagggaggagagacgtgagaggaaagcgatatgggtacatccgtgtttccagtacagaccagaatgaggaccggcagaagctggctatggcgcaggtggcggtaccggaaaaggatatttatatggacaaacagtctggcaaggactttgagcgcccgcaatacaagcggctggtgaaaaaactgcgaccgggcgatttgctctacattttgagcatcgaccggctggggcgcaactatgaggaaatccagacccagtggcgggttttaaccaaagagatcggggtggacatctgcgtgttggacatgcccctgctggatacccgcaacggcaaggacctcatggggaccttcatcgcggatctcgtgctccagatcctgtcctttgtggcacagaatgagcgggagagtatccgcaaacgccaggcccaggggattgctgcggccaaggcccggggtgtccatcttggccgtccctcttccgcccggccggataattttagtaagattgtccgggcctgggaggcccagaaaattacctttgaagaggctcttcaccgctcgggcctggggcagtccaccttttatcgccgccttcgggaataccggctggaggtgggagaagaaagaaggaaataatggagagagaaaaaatcagctatcaaaaggtacaccttttgatagctgattttcttgctctcattttatcttcaatagataaataaagcaaggtttttttcggcgtttattgaagaattgacgaaaaactgtggcatttgcaaagaaaatagaggactttcaaaaggtgtaccttttgaaagtggaaaggagcaaatgaaacagacagagaggaaaccccattcagaaagaaggaggaagtaagattgaagagaaaacgatggttggcaatggcactggtgttctgccttttgggaactacggttccgctgacggcgctggcagcaggggaagacggggaggttcagtatatcgtaagtaacgatggaacaaccttgaccatccaaggcgatggtgagattaccagtcaggctttggatgccaatgtgacagcggaacagaaaaagacactcacttctgtggagattggcgccggcgttacagggattgcagatggttacagctcggtatttcccgcgggtgtaaccaacgttaccctgaagggatcgggggcgttccgatttggcaagtattcttttaagggacagaaaaatctaacggtgcagtcagagcgtacatcccttgccattggaagctatgcttttcacaatgctgtactaaccgagtttccaatggaccaactgcataccattggaagctatgggttttccaatgcggttttgccgttggagggggagacgctgacgctgcggatagaggaccaggtggatgtggaggcacagtacccggccatttctgtggggagctgtgcgttcagcggcgtaaaaaataaagaaggaaccgctttttccaaggcgagcgttaccattgggggaacggttcaatttggcgattattctttcaatgcaagcgatgtatttggaagcagtgcggccttggaggagctcaccttccacctgaaggagggagcctatctcatctttggaggaggtgccttgggaatccccgctctgcgcagcgctgtgtttaccgggacgggacagattgattttcagcatcccagctatcgctatgtgcaggcagcaccctttcgcaacgggaagcaagtggaaaccctggatttcagtggatttaccggggagatcacatttgctaaaaatatgtttcatgccagtgcaacttcaaaaccagggctaaagcaggtgatcttgggggaagggtgccaggtaacgaaaatccgggaaaaggcatttgcctactgtacgcagctggagacctttgacttttccaaggtgacaggagaaattgcaggagaggcgtttcgagacaccgggttgaaaggagcattggacctgagccgggtgaccgccatagaggtgggtgccttcgaaaacgtcacaggggtgacggattggagtgcaatctgtcagggggccgaggcgggtatcctgaaaaagctggaatacagcaatgtatttctcaaggacgacgcggtatgggacttggtggagcgagcaatggacggtaagttccgcctcaaccaagacggcgggtatccgacgttgcggcccaccgacaacgcatgggaggacagtcacctgggtgagaagaacggactgggcgcggcctccacacagctgaccaaggcggccaaatggaccgacgaagacaggacgacagcccaagtggagattcaggcggcctatgcgccggaccggcagagagatttcgtgtttgtcctggacaccagcacctccatggagcaggtcaacggacagggcgcggccctgaacaagatgtatgagatgctctccaaagtggcggatgtgaccgaaacgctgctgacctcccaggaggtggacagccgggtggcggtactgtcttttggcagcggggtgaacgcagcttccgcaggcttttttgaggggagcaacgcggcgcatgccggggaagtgatccgaggcctaagctgtgaggggaggaccaattacactgcaggattggaaaaggcggtggactatctccgcatggcccaaagcctggggcgttcggtctcggtggtctttctttccgatggggaggccaatgaggacacagagggaatccccgtagcggcgcaggcgatacaagcccttggggtttcgaccattggggtgctctataaaagggaaccgacagagcaggagaagacctatatggaccaggcctgcacggaattttatctggctgaggatacggacgggttcagtcgggcggtgaaccgtaccatctatgatgctttccgtacctttacgctgacggatgtggtgggagaggattttcagaccatccagcaggcggcgattcaagtgactggcggcacggcgacgctggcagaagacggacgcaccgtcacctgggacctgtcggggacagagccctatgagacctatacgatgaccctccatctgacccttgcccctggacaggatggcacatatccggcggggacttttgccaccaaccagggagagagcgtcctgagggagcaggggacggagaaggtacaaaatcaggtggcctcgccccagctgcgccggggaatccaagacggtggaggcggtggaggtggcgggggagagacccggtataccctccgctatgattcccggggaggaacttcctacccgccggaacagtaccccggcggaacgaaggtcctgctggaaaaagtaccgacacaggaggggtataccttcaccggctggtatggggaggaaacattgagtaagcggcttacagaggtgacaatgacttcggaccggacggtgtacgccggctggcaggccacatcggtgccggatatgctcaacggagcagatcactttgcctatgtgatcggatacccggacggtcaggtgaagccggggggctccattacccgggcagaggtggccaccattttcttccggctgctgaagcaggaaattcgggacggaaacctgacccgggtcaatgggtttaccgatgtacaggacggcagctggtttcagcagccggtgtctaccatgtcggctctgggcattctcaaggggcggacggaggaacgcttcgcgcccaatgcccccattacccgggcggagtttgcggccatctgtgcccggtttgacactggagtgtccgacggatgcagcgagtttacggaccttgcagggcactgggcccgggaggagattggaaaggcggccagtctgggatggattcaggggtatgaggacggaacatttcgtccggaccaatccattacccgggccgaggcgatgaccatgatcaatcgggtgctgaaccgtcttcccgccgccaaggaggacttgctgcccggcatgcttcagtggccggacaaccaggacccaggggcctggtactatctggcggtgcaggaggccaccaatagccatacgtggaaggagaaaggggaaatttctgagcagtggacggaactgactgaggcgccggactggagccgttacgagacctgacctgtgcagccgcagcgtagggcgccgagggaaagcagggaaacggagagaatttttgcgcttttcgacaggaaccctggggaatctgggaaaaagaaggagaatcccccttttcagaagaactggaatccgctaaaatagaacgggaaaagccaaagagaaccgggaaccctggcggcgtccagcatgggcagggggcctgggagaaaaggggagaggactgtgccgaattaccgcttgaccctctgctatgacgggacccgctggaaagggtggcagaagcagggaaataccgaacagaccattcagggaaagctggaggctcttctgtcccgcctgctggatcagccggttgaggtagccggttccggacgaaccgacgcggggacccacgcaaaaatgcaggtggtctctttccgggccaaaacccaaaagaccacagaagagatcttggccggcctgcgccgctatctgccggcggacattggcgctatccggctggagcgggcggagccccggttccatgcccgcctgtcctgcactgggaaaacctatgtctaccggatatggaacagcgatctgcccaatgtctttgagcgcaactatttgtatcacctgcacgaacctctggacctggcggctatggttcaggctgcggaggacctctgcggcacccacgactaccgggccttctgctccctgaagaaattcaagaagtccacggtgcgccgggtggagtccatcaccattcaagccttggggccggagcttcgctttaccctgagtggggacggctttctttaccacatggtgcgaatcctggtgggaaccctgctggaggtgggccggggacatctgcggcccgaggatatggcggacattctggcctcccaggaccgacgccgggcgggggagaccgtaccggcctgcggcctgtgcctggaggaggtccgctattaaggacagaaaaaagcccttgcgctgaaaggcgcaagggcttttttgagttcaggaaaggggcttgtcgtccttcatcatcgtctccgccgccacgcacagcagaatgatgaccgcgccgagaatccctggggtggagagctgctcccccagaagaagacgggagaacatggccgtcatcacagggcagaaacactggagcagggccacggtgcgggaggagagcacccccagcgccgcgttttggagcagatagccggccacagtgcagaagagggccaggtagaggatgctcatccaaaccgagggggtggccgcgcccaggtgaattccctggtcaaaggccagggcgcacagcagggccatgagggctgaggcggcggtctggagggtggtgagggtgacggggtccacccggtccagggcgtgctcgccaaaaatcagggccccggccagcagaagggcggagaggagggaaaagacttctcccagaccaaacccggacagcccgcccaggccgcagagcaggtagagccccacaaggaccagcagctgaaccggaatgtgtttttttccaaacttgcggcggtagaaagccagggccaaaagtggggtcatcatcgtggacagggagcgcagaaaggccacggaggtggcggcggtgagctccagggcgatgttgttggccacataggcgccccccatgcagaggctgggaagcagccagtcccggggggagcagaccttcagtccccgccagattcgccggccgaacaccagcagcagaaaggcaagggcaatgccgtagcgggcggtcagcagggaatagacggggagaacctcataggcggacttggaaatggggtcccccagcccatacagtacactttgcagaaagataaacaggaaagggagccagcgcagggaggcacccttccgcagggggagccgggtgacaggggtggattggtctgacatggtgattcgcctccatccggaaaaagctggcggctgacagcggccgtgcttcccgattatacaatatggggcagggaaagacaaggcttcccatggatacagattgttcacagggtttttaagttcagttaaagaagccctggtattctgaggctgctccgggggaaggcccggggaaaggaaaaaggaggcggtggtatgcggctgctgctggcggaggatgagcggtccctggcccgggccctcacggtgctgctgcgaaaaaacaactatgaggtggacgcggtttacgacggggaggaggcgatggcctatctggggtccggcaactatgacggggccattctggacatcatgatgccaaagcgggacgggatcgatgtgctgtgtcagctgcgccggcaggggaaccggctgccggtgctcctgctcaccgccaagtccgaagtggacgacaaagtgctggggctggacagcggcgccaacgattatttgaccaagccctttgccagccaggagctgctggcacgcatccgggccatgacccgggaacagacggtacaggccacctcccggcttcaggtgggaaacatcaccctggaccgggccacctttgagctctcctctcccaccggccggcttcggctggccaacaaggaatttcagatgctggagctgctgatgtgcaacccccggaacctcatctccaccgagcggtttttggagaaaatctgggggtatgacaatgaggcggagatcaacgtggtctgggtctacatctcctatctgcgaaaaaagctcgccgcgctgcatgggaacattcagatcaaggcccggcggaacgcggggtattacctggaggaggccatatgatccggaaactccggaccaagctggtggcggcggccatgctctctctgctggcggtgctgacggtgattttaggggtgattctcctgaccaactatcggggaattgtctctgacgcggaccgcatcctggacctgctggcggacaaccagggcaagtttccagagatcaaagcggacttcgactgggaggaactgggcccccggcaccggtccgtagagctgggctatgagacccgatatttttccgtgctcctggaccggcagggaacagttttggccacggacaccggaaagatcgccgcagtggatgaggagactgcggccagctatgcccaggccgtctgggcccaggacagtccacggggattttggcaggactaccggtatttggaggcgcgggagggggagaacacgcgggtgattttcctggactacggcgcccacctgtttacctttcacagcacgttggtgaccagcctttgggtggcggcgtcggggctgctggcggtgcttctgctgcttctgctgctgtcccggcggatcattaagccggtgatcgagggacatgaaaagcaaaaacgcttcatcacggacgccggccatgagatcaaaacccccattgccatcatccaggcggacacggaggtcctggccctggagacgggggaggagaatgagtggatcgtggacattcaaacccaaattaagcgtttatccacccttaccaatgatctaatctacctgtcccgcatggaggaggagcagggacggcagcagtttctgccgctgcccttctccgaactggtggccgaggccgcccaagcgttccaggcggtggccaagcgccagaacaagacgctgtccgtggatgttcagcctatgctcaccctggtgggcgaggagaaaagcctggtgcagctggtgtccatccttctggacaacgcgctgaaatattcgccggagggcgggcagatcgccctgcgtctgtcccgacagggcaaacacctgcgcctgtcggtggagaacacggcggaagtgctgagcaaggaactgctggagaatatgtttgaccggttttaccggggggatgcctctcgaaactccggccaggggggatatggcatagggctgtccattgcaaaggcggtggtccaagcccaccgggggaagctctccgccgcggccaaagggacggaccgcctggtgattacggcgctgtttcccagcgcgtgaagtccatgacaagtccggtgaggggcaaaaagaggcgcggttcccggacttggtgggccggaaccgcgtctttttgagggagcacatctccctgtgggaagaaggagggatcgcaaatgacagcgaacgagttttacggcccggagctggcgcagatgcgtctggccgagcgtcaggttctggaggcggtggaggaactgcagcgggtatggaaggcccaggggcggcagtctcccgtgctttataccagttcccggatcaaatccccggagagcatgtgccgcaagctggcccagcggggacagccacagacccggcaggcggcgctgacccgggtccgggacgcggtgggggtccgggtgatctgcgggtttcaggacgatgtgtatcaggttgcccggtggctggaggaccaggcggcgttttccgtgctggagaccaaggactacatctcctaccccaaggagaatggctatcgaagctaccacctcattttgggcctccgggcggggccggggcgggggatgacggtggaggtgcagctgcggaccatcgccattgatttttgggccagtctggagcaccagctcaagtacaaacggcaggtccctcatgcccgcctggtccgggaggagcttcggcgctgtgccgatgagatcgcctctgtggacctgtctatggagaccattcgggagctgctggccggtagtttctgaccggttacgcctcaggggcggaggtccggggatgggttcggcgccagagaatgcccgccaccacgcagagcagccccaggagcagaaagcccaagatgatcaggaacatcacgttggcgctcatggcggcggcccagttgtgaaagtcaatggggaggatcagctgatagggggtactggtgaaatagcccatgtgcagatagatctgatccagaacaaagggcgccagccagatccacaggccggtccacgccagccccaccccggcccggaaccaccggcccagggggaggtagcgcagggcgcccagccagccccagggaagggccagacacagcagggcaatgggcagcatgggcaggggaaagtccccggtgcgtccctcccaggccaggcccgccagcaggagaatggactcaaaggacagatagaccaccgccttgtgccgggaccagttccagggcagggggagctgccggagcaggagggggagcagggcaatgcccagtccaaacaccgtccagagcgcggcgctgaggaaccacgtgcccccggtgtacagacaggccaccccgaacagggcgagaagcagcagaagctcgatgcccacgtagagggagaccttccggtgggccaactcctccggcaggggcagggcgcgcagggcgaaggggaggaagaccaggcccataccaaacagcacgctcaccccggcgatgaggaaccagtccccgccggtatagagacagcagaccagcagcaacagcagcaggcagccggtgaagccccccaggctggccagtccccgccgtccctctggaacgaaggtgggcagcaaggtaagggaggccaccatgagttctgaggccaggacgatccagaaccaggtgagggcatgctggctgagcaggttgcccagcagacagcccagggtgatcaggccatacaggatatattgtcccagccggtagtttcgggtcagctgcaaatattttttggccagctgttccgcccgcctgccctcggtgtcttcgctggaggacagcagctctttctcactgcattgcaggacctgacagatgctctggagcagggtgatgtcagggtaggccagcccccgctcccatttgctgaccgcggagtcggtgacaaagagacgctgggcgaattccttctgggtcatgcccagctctttgcgccgctggcagatgaaggtgccaaatgatttcttgttttccatccgttcacacactcctttggttggatgtgccttgcaagacggaagcatcatagcaaaccatgggggagaaagtcaatgcaaagcccccgtttttccactcgaccatcaggaaagtgcagcaatgccaagggttttcagagagttcttcccgcatgcaccctgctgaaaaaacggctatgagccccctgttttcagggggctcgttttctttgggacgcgggcgggtccccggtgggcgaggcagaatagggagttacggggatacggcccggcggaacagggtccaggtggagagcgcgtaagccagcaggagaagcagaagaatgccagccagggcggacacttgagacaggagcgcatcaaagcccaggtaggcgttaatctctgtggcaatcgaccaaaagaaaaaggcggatatggccccagagatcagaacggccagacccacaggcaacccaaaccacagagccagctgtttggaaatgagatggtggatggagcggtcctccacgcccagcttgcgcagcacaccgaaccggtagcggtactggttggcgtcccacagctgctggagggagagaatggtaaagcagatgaccatgagcaccacggctccgtagaccatcacggcgtggaataagaaaatctgtgatttggtgtcactgatctgctgggttcgggtatccaggctgtactcgggaccgtcctgcagggactgttccgggtaatgggtggagaaggcgtcctgcagagcagcggcgtctgcatagggaatggggtgggccgtggcaagataccgcttggtcataacgggaaggagctgatggcagacctggtcgggcaggacataggttacatgggtgtaaagattatagaaagtttcccccatggactctgtgtggagagcatcctgggccagggagagggtgccggcatcggtggacagggtgggatggttgcggagaaaggccgcctggtcttccggggtggagatggcgtcccactgggtgctgaactccctcgcccccaaggagatggggggataccccagcatctgccggatggcgttgtaatcggacagtgccacagccacaacggggaagtcatacttgtttcggttgtggaactgggatgcctccggcaggtaaagggaaaagacacggtcttgggtgatctggatgccccgcgcctctaaaaacgtggggacaaagtcatacgtgtcttgaggcaggtcttcctgacggaggacattgttgtaataactgttgatctgcacgtcatagatggcccgctcctccagatagccctctgcccagccgctcagggcgggggagagggcaaacaggacggtggacagtaccagggtcaggctgatcagagtcatggatttgctggcagagcgaagcttggagagaacctggccgtagaaaaagaggttttccccggtgtacttatgggcgggggacctgtccttccaggcggacagcaggcggctggacagatacatcaccgtacagaggaagaaagacaggtagacaagaaaaaagagcaggtaggagcgcaggctctcctgagaaatgggcagggagtaggtccggtccatccacggggccagggcgatgaagaaaaggctgatgagggactggaccaggagaaaggccaacagagggagaaagcgccgccgcttaaaacaccatagtccgctccctgccaaacccgccaggggaagtacggcattggacacatagaagatacgggccagtagaggcaggcgggaatcatagtaaagggaggcataccagagattcatcgccgcgattcctgccagcgcggccaggtagagaatggtcaccacaggcatccagcggctctttttcagactgtcctcatttttgcgccgggcctggagcatgtcgatgacatggagcttttgaatggaccggacgttaaacagacccaccacgaaaaagctcagggagaaaaaaagcagagtgagggcggcggtatccgggaaaagggcccaggagagctgaaaagactggccatagctggacaggagcatagcggtgatgaactgggagaggaggctgcccaacgggattcccagccccagggagagcagtcccatgaggaacgtctcgccaaagaacagccaggcggtggttcgctgttccatgcccagaatggtttgcatggcgaattcctgctgtttttgtcggatcatataccggttgacataccggatgagaaagagcaggagcagtgtgaccccacagatggccagcttcatccactcactgagaaaggagagatcaaattccgcccccagagcagggtggtaataacggctggagatggagagaaaggcatagaacagccccacgcacagggtcagggttaccaaatagatcaggtaatcctggacggatcgccgggcgctgcggaggatcagtttaccgtacatccactgtgccccctcccatcatggtgagcacatccagaattttttcaaagaactgttttcggctgtcgttcccccggcgaagctcggagaagacggcgccgtcccggagaaatagaatgcgctctgtgtagctggcggtgaaggcatcgtgggtgaccatgacaatggtggcgcccatctgctggttcatgctctccagggtgcccagcagcatctggctggcgtggctgtccagagccccggtgggctcatcagccaagatgagcttggggtggtttatcatggcccgggcgcaggcgcaccgctgcttctggccgccggagatctgataggggaacttggacaggatgtccccgatgttcagggcgtccgccatctgctggacctgcccatcaatctggccgggcgggaccttgttgatggtgagggccagggcgatgttttcccccacggtaagggtgtccaggaggttgaagtcctgaaagataaaccctaagttttcccggcggaaccgggccagctccttgggtttgagctgggtgatgtcccggccctccagcagaatggagccggcgctgacggtgtcgatggtggagatgcagttgagcagcgtggtcttgccagagccggaggcccccatgatccccaaaaattccccggaggagacggagaagctgatgtcgtcgatggcgcgggtcaccccgccgccgttgccatagattttctggatatgctccagacgcagcagttcgttcatgtgaatcacctcccctgtagtctaagagatgccggagggaatttgtagcttcttttcttacaaagttctaacaaaattgtaagaattacagcggaccctgcaccccgtggatgaagtcgttgatccgaaaggtcagggaaagggtggttcccgctggggaggattgggcctggaggccgatgtccagcttgtcgcacaggcgtttgcagaggtagagccccagcccggtggcgtttggggcggaccggcggccattttgaccggtaaagcctttgtcaaaaatgcgaggcaggtccctggcatcaatgccgatgccgttgtcttgcagagagagggtcagtgtatcctggttccggacggcgcggaaggtgaggaccggagggtcccgccggtattttaccgcgttgctgatgagctgattgaggatgaagcaaagccatttttcatcggaaaatatggtgtcctccgtctcatgcacctgaagggtgaccccgttttgcagcaggagatacttgttttgccctatggactggtggactgcgtcaaagagccggagttcccggatgaaatagtccttttccgtgtgttcgctgcgggcgtagtagagggcttgctcggtgtagcgatcaatggcctccagggcggacagcagtgccggggaagcggggctggggtggttttcgcagaggagcttgctggcggcgatgggggttttgacctcgtgaatccactgctcgatgtactcccggtattccccgcgctcccgctggatggcgctgatctgctccagcatggaccggccggcgcgcttgagaatttgataatagacctgatcgtccgcccgggtgggcgcctgcatgatttcaccgatgagataggtctcccggaggctttccgacagggacagcagggcatccagctggtgcttgcgcagcagataagaccggaccatccagccccccgccaccccggcccaggtcagcaggatcagcagaatgctgtcccggttgttcccgtttagggcgagaaagcaggccagggcggccatggacagcagatggaccaggagcagggggaactgctgtttccagaacagacgggcgctcataaggtgtatccctgccggtgtttggttttgatgaaattttctaagcccagggtagaaagcttttcccggattcggccgatgttgacgctcagcgcgttgtcgtccacatagagctggttgtcccagagataggagaccagatccccccgggcgcagatggtcccggcgtgtttgaacagatagtaaaggattttcagctcgtttttggtcaggtccgccgcctgcccctgatagagaagctggctgcgttccaagtggagttccgccccgccataggtgagcacttgaccgggttggtcgggataggcccgacgcagcagagcggctattttggccaggagaatggcggtgtggtagggcttggtgataaaggcgtcgccgcccagcagaatgctgctgagctcatccatgtccgtgttacagctggtgacaaagatgatgggaaccgtggagaaagcgcggatctgggagcacagggagaacccgctttggccggggagcttgatatccagaaggatcaagtggggctgaacggtgtttacctgagagagtgtagtggagaaatccaccacggcggcggcctcatatccctcggcctggagaagggtgaccagctcccgttggatggtgggatcgtcctcaacgacaagaattttgtatggcatcgcaaaacgtcctttctatggtttgcgccagaccagggtcagatagacctggcctgtctctggctcggtgtcctggtcgaggggagagaagccctcccgttggtaaaaggccagcgcccgctggttgttctgatagacctgtaaggtgatcagcgggtgcctggctttcaaatgagtgagcagggcgcggccgatcccggtggagcggcaggtgctgcggacgaagagaccggacaggtggtgccccgtcatgccggcaaaacccgcgatgtgtccgccggtttcgtaaatggacagctccgcttgggggagcaggcgggccaccagggcggtgtgccggtgccaatggtctggcgggataaaggcgtgggcctccagattgccggacagccagaggtccatcagagagggcaggtcgtcagggcggaaggatcggatcatggagactcctttctgtggggccgggcggcggtgcccggccggcgtgtcattttttaagaaaacctttcttttttcttcatttctccccaagaaattcctgctatgatacgaaggcgctgcccgggcaccggcgtgaaaggaaaggaggagaaaaggccagcctcgtttggctggcctggaagatcagtatttcatctggaacagggtctggctcatggccagcttgtccgggcggctgttttgaaaggtgaccgtgccgaacccggttcggtcggtcagaagagacgcggcctccagctggcggcgaagctgccgggcggtgccctcactgccgtcgatgatggagacgggacggccgaaattgcgggcgatggcctttcggacgaagggatagtgggtacagcccaaaacaatatagtcgatgttgcagtaccggaaaggcaggaggaggtcctgcaggtaggcgtccagaaccggaccgtcaaagatgccccgctccaccatctccgccagccccttgcagggcagggagatgacgttggcgtggccgcagaaagcggcggccagcttttggtatttatcctcccggatggtgaggggggtggccatgacgatcaccgaagaactgcccgcagccagcgcggcgggcttcaccgcaggctcgatgccgatgatgggcagtcccgggtggagctggcgcagcaggccgatggctgcgctggtggcggtgttgcaggccaccacgattcctttgaccccttgctccagcagcctgtccacggcggagagggtcagggcccggacctggtccagggacttttccccatagggggcgttggcggaatccccgaaaaagagaaaattttcctggggcagcaggcgcacgcaggcgcggagaacgctgatgccgcccagaccggagtcaaagaccccgatgggacgggcttgggcttccatattccttccccctctctcctggctggcggctggatgcgggccatagccgttttgcgctattataccaccatttttccggccgcgccataggattttttgggaaggagggaccaagcgggcgcaaaaaggctggcaggggcatagagtggtttgagggtgacctgccctcatgagatcgtcccgccgtttcggcggagaaaggaagcaatatgaagcgttaccaatgcaacgactttgaattgcccaaccggcggccctggacaccgcctggctgctgcccgccccagtgcccgcctcagtgtccgccgccctgcccacccccgatgccggagccctgccccccgcagcctccctatccgccccaacccccctgcccgcctctgcctccctgcaacaccgggtgcgtgcccacgccctgggtgctgggcggcatttaccgggcgggccagctggtgacctataatggcttcctctatgtggccaacgtagacaacgccagcggggtgcctggggagtctccggactttaccctgctgtccacgctgcagcccatcggccccacaggccctgccggccccacgggtcccacgggccctgctggacagcccggaattccgggtcagccggggacgcctggcgctgcgggtcccacgggtcccacggatgcaaggaaggatggacaacacaggcgggaaaaacggggaaaaaaggggaaatttggtgcgcttttgatgcagaacataccgtacaatagactaacttcactatgtgcttttttctaaggtgcaggtaggaattttctggaaggtgatgtgggtgaaacaggccatcagctggtttcttgtatttatgattctgttctcctcggcgtccctgctccgcgaaccggcgggaagcacggaggactgggagaacccttatattgatgtgacccaggatctgtggagttatcaatacatcacggagctgaataaggccggcgtgctgccttccagtgagaaattccaggggcaggaggaggagacccggggaaacctggtcctctacctttataatatggaccagggcgttttcaaggaccgcaagaagagccgggacaagaagaaggagaaagcggcccccaacttcaccgatgtcaccaaggattccccctactacgacgcggtgtgctgggcctaccaaaacggcctggtgggcgggaccaccgagaccacctttgccccggagcactccctgacccgggagcaggtgtgcaccgttgtggcccggtttgcggccctggaggagatctctctgctgcaggtggtggagcccgaccagtttaaggactccctgtatattgatgaatatgcccgcagcggggtgaccgcctgccagatggcggggattgtcaagggatatgacaacggctttttccagccggacaacaccctgacccgggaggagtgcgccgctgtggtctatcgggtgatgacggcggcggacatggagatccccgagggcagcgcggtggtggacctgacggaaggggcctatgacagcctgtatgacaattaccaggacatcacgttcacggcgctggtgccagagacggaggaggggcctgtgaccttctttgaccaggcggtctttatcggggattccatctccatgaccctggaggcctactgcggcgccagcggcgcgctgggcggcgccaagttcctctgtgccggcagcatgagccccaccaatatgctcactggcaagatcctgccggagtatcccaaggggtccggccaaaagccggccattggggacagcgtggcggccaccggcgccaaggtggtctatgtgatgctgggtatggacaacatcgcctatggggtggagcgggccaccaaggattacctcactattctcaaccagatcatcgaaaagaatccaggggttcagattgtggtgcagtccgtgacccctatggcggattccagcaccagctactcggaaaagctgaacaacgaacagattaacgcatttaacgagaccatgaaagcgtattgccaggacaatcgctggtattatgtgaacgtggccgaggcattcaaagacgaaaagggcttcctgaaaaaggagtactgcagtgactacggcagtatgggcatgcactttacctatgagggagccaagatttgggtgcagtatctcaaaacccatattccccaggatttgctgtaatcaatggaaaggagaattccatgaaaaaatggacgatccgaattctcgtcctactattcctattgaccgggtctgcctgcagccagtcggtgccgcctgccgaaggggaggagacgctgctggtccaaggagagagcggcggcccggaaaatctgccgccagcctttgaccctgtggttcccgccgccgaggcggtggacccccagtggtttgcagatgcggcctttgtgggagattccgtgtcggtgatgctggaaaattacaataccagcacaggccggctggggagtccggcgttcttttgctctgtgagcttgagccagaccaatgccttgtcctatcaggcggggaatgcccggcttccggaatatcccaaggggtccggccagcaccccctggtggcggacggcatcgccagcgccggcgcgaaaaaagtttatttgatgctgggcatgaattgtatcgccgggggtgttgacagagcaagtcaagatttggtaacattagttgatcagatcctggccaagtcccccgaggcggccattttcatccagtcggtgacgccgatgaccgcggacagcccccgggcggatgacgccttaaacaatgggaccattcaggcattcaatgagagaatgcgtcagatttgccaggagaagcagtggtattttgtcaatgtggcagaggcggtctccgatgagaatggatttctccggagtgagttcagcggggaccgggccatggggatccatttcaattacgacggtgctgcggcgtgggcagactatctcctcacccatgtgccccaggcgctgaagtaagatattttttaggaggatgaatgaggaagtatgaaacggatagtatctcttgcagccattgtgctcaccttgaccatggcgctgtccttggccgcctgcggcgaggagcccggaaccaatgaaaacacggaaaacggccagaatcagaccagttccaatgagacaggcaaaaccgtggacctggcggcgctgcggacccagtttgtaacggattacagcctgacggatgtcctggaggtggagaccgagggactgaataatctgtatggaattacggaagatatggtgaagaattccgccagcttttccgcctcctccggggcagcgtttgcccaggaagtggtgatggtggaggcggttgacgagtccgctgccgccactgtggctgaaaagctggaaacccgtctgtccaccatcgcagagcaggctgcctcctacgatcccgacagtctggcgctggcggaaaagtgcaaggtggtcaccgacggcgtctatgtggggatgttcttctcctcccactatgacgacatggcggccgcgttccagagcgcgctgtcctgagtgcgtgttcccagagcatcaaaaaagaaaccggctgccgggcaatcgaaggactgcccggcagcatttattggagaataaacgcctatggttttttcaagtttacctttcctgttcctgtttttgacggtggttctgttggtcagccacattctgcccttccgattccggaacttcttcctgctcctggccaacctggttttttacgcctatggagagcctgtttacgtcctcattatgatcggctccattctggtgaacttctttgccgggctgctcatggacaagcagtccacccagggccggcgccgggcggtgctggtggtgggcatcgtgctgaacctggcggcactgggggtgttcaagtacgccggcctctttgtaagcaccctgcgggagattccggggctgtcctccctgccggaggtggacattgcgctgcccatcgggatttccttctacaccttccaggcggtgtcctatctcattgatgtctattgggatgactgcgcggcctctcataacctgattaactttgcctcctacatctccctgttcccccagctcatcgccggccccattgtccggtacaaggatgtcaacgagcagctggtctcccgacgggagacgcccaccctttttaattccggggttcgcctctttgtggtggggctggccaaaaaagtgctgctggccaaccagtttggcatgctgtgggacgccatgtccgccgacccggtggccgccggcgccctgggggcctgggcgggagcctgtgcctatacgttgcagatttatttcgactttgccggttactccgacatggctcgaggcctggggagaatgctgggctttgaattctgcatcaacttcaactatccctatatttccaagagcgtgacggagttttggcgccggtggcacatctccctgtccacctggttccgggactatgtgtatatccccttggggggcaaccggtgcggcaagctccgccagtgtgtcaacattctggtggtgtgggccctgacgggcttttggcacggcgcggggtggaacttcctgttctgggggttctactacggggtgctgctgctgttggaaaagctgttgctggggaaatatatccgccggctgccggcagtgttccagcatctgtatgccatggtcattgtgatcatcggatgggtgttctttgcctccccggacctgtccacggcgctggcctaccttcaggtgatgttctccttctcgccgggcaccatgggaggggcttccctggtgatgccgtggcttggtatggcggtcattggggtggtggcagccacgcccctggccaagaatctgtgggagaagctccaggggaaaaaagccatgcccttggtggaaggggcgctttgtctggccgcgctgctcctgtgtactgccagcctggtcagcgacagctacaatcccttcctgtatttccggttctgagagggggaacctattgtgaaaaaattgtattcctttttgccggcgctgatcttcctggtatttctgggggtcatggcccttctgctgctgttctccccggtgcgggactactcggagaatgagaaacgctatctggccgggcggcctgaggtgacggtctccgggattctggagggggaaacccaggaacagctggagaagtttactgcggaccaggtccccggacgggatttctttgtgggggtcaacgcctattggaacctggccaccggccgcaatggagcccaggatatctaccactgcaagcagggctatctgatcaacgcccccaagacttacaatgagaagattttcacggacaacctaaccaagttcgatcaattcgccgcccagctgggggttccggcagacctgatgatggtaccctctacgggctatctcatggaagaagtccttcccacgttccatgggacctacgacgatgaccagctctatgacaaggcagagcagatcttgcaaaatacccgtctggtggatgtgcggcaggccctgctggaggggaaggaaaccggccagatctgctaccggaccgaccaccatctgacttcctatgggaactatttgctctaccgggcctatcagatcgcccagggggcgccttacctctcccgggatgcctatgaggtggccagctacgatgggttctacggcaccacctggtcgggcagcggctactggttcacccagccggatcaggtggaggtgtgggacagcggaattcagcccacggtgaccttgatcgacggaagcgccgcgccccaggtttcgcacagccttttcttcccctcgcacctggaggagatggataaatacccggtttttctggatggcaaccacagcctggtcaccatccagaatcccaacgcggagggggggaaccttctggtgatccgggattcctatgcccactgcttcagtaccttcctggcgtccgactatcaaaatatctacctggtggacctgcggtactaccgggataacctgtcccagtttgtggcggaacatccggtggaccgggtgctctacctctatggggtggacaacctggtcagcgacaccaattccgcttggctgaaataagcttgcgttccggcgggcccgccccctcacaggggtgggcccgcttgatcaaatgttaagaatttcgacatgactgggtcataaacgcgggatatcctgggagaaatccaggtatccggagaaggcacagcggtaccattgggcatgaggtacctgacgacagcgtggtacgccgccggcttgccagaaccccgacgggatggtatgatagacctgattcaacaggaagaggaggggcggcatggcggagattaacattgcgctggagtgttttggaagcattctcaccctcattcttctgggcagtctgctgctccacggggaccgctccaacccttccacccggctgtttgtggggatgctgctggtgaacttagtgtccctgtgggcggatgcctgggcctggtattggaacgggacggagtatgtggtttggaactggctgggaaattttctgcaatacctgtcgggatatgtgcttctcttcctctactgtcagtatctcttggtccgggcctctctttggacaacgtgtccctggattcggcggagtgtgtccgcgttgtgcctgctggggattggcctgaccgttctcacccagtttaccggcctgttttataccatcacgccggagcacctctgcctgcggggagagggattttggctctcccaggccatcgggctggtggcgctggccttggtggggggcgtgatgggcctgcatcgcaagggacaggcgcgggaggagagagaacttctgccggcgtatgtgctgctgcccatgggcattctggcggcggaactgctttggacggagattaccttgctgggcatcggggcgacgctgaccctggtgctggtctttgtcaatgtccagctgcagcgggaccggcgtctgcgggcccaggacaaggaactggcggagaagaagattgccattatgctcagccaaattcagccccatttcctgtataacattttgggaagcatcgagtggctctgtgaaaccaatccccagaaggcccaggaggccaccgatgagctggcccgcttcctccgggggaacatggacagcctgcagagcacgcgggtcatccccgccagccgggagctggagcatgtgcggtgctatctgaatctggagcgtatccgctttggagcccatctgcgggtggagtatgccattgagaccagcgatttcttcctcccggccctgagcctgcagccgctggtggagaacgcggtacgccatggggtcaccaagcgggaggagggcggcaccatctggatctccgcccgggagacggaggagagttaccaggtgaccatccgggatgacggtgtggggtttgacccggtgcgggtgcgtggggacgggcgggaacacgtggggatcgagaacgtccgcagccgcttgaccgcccagtgcggcgggacgctctgcatcgccagccaggagggcgtggggacagtggcccaggtgcggattcccaagacaggggatacccaaggaaaggagtcttttgatgcggatcatcgcggcggatgacgaggccctgatgctggatatgctcacggaccggattcggcaggcctgtccccagggggaaatccatcccttttccagtgcccgtcggctgctggcgtggctggaggagactggagagggctttgatgtggcctttttggatattgagatgccggggatgagcggcatcgccctggcccagcggctgaaagagctctgtccccggggcaacctgatctttgtcacggggttttcccaatacatggcggaggcctttcagctccacgccagcggatatattcgcaagcctgtcaccgtcaaggcggtggaagaggaactgcgcaacctgcgttaccccgtacaggagcgggcagcacccaccctgcgggtgcaggcgttcggcaattttgaggtcttttatggagggcggcctgtccatttcagccggagccggaccaaggagctgtttgcctacttgatcgaccgccggggggcggggagcaccatgggggagctgatctccatcctgtgggagggccgcctggacaccccgagcatccgcagccagctgcgcagcctcatcacggacctgcggaccaccctccaggggctgggccagggggcgatcatcattaagaagcgggatttgatcgcggtggacccggaacgggtggactgcgactactatcgcttcctggccggggaccggcgggaggccaatgcctttcgcggggagtacatgtccaactactcctgggcggagaccaccctgggggcgctgacgcggaaggaaggacagggggaaacaggttcatagagggcggtgcccgatgcataggttctaccgaagacggttgtcccaggacggccgaaaaaggagggagcctatgggcagaggcggaaagctggccggcggcctttggcgggtggggctgtatatccgtttgtcccgggatgacgggcgggaggagagcctcagcgtgcagaaccaacgaaagattttgctggattacctggagcatgaattccaaggccagtgggagctggccgggatctatgtggatgatggcctaaccggcaccgatgacagccgggagagtttccagcgaatgatcggggatatgaaggcggggaagctgaactgtatcgtgtgcaaaaccctctcccgggcctttcggaactatgcggaccaaggctattttttggaggaggtgtttccccgctaccgcacccggtttatctccctgggcagtccccgggtggacagctttttggaccccgaggcggtgcagatggggctggaaattcccatcaatgggattctcaatgaccgctatgccgccaaaacctccgcggatgtccggcggaccctggatatgaagcggcggcggggggagtttatcgggtccttcgccccctacggatacgataaggacccggcagaccggaacaccctgatcccggaccccgaggcggcggcggtggtggctcgcgtatttgagtggtatgtccagggggtgggaaaggggaccatcgccagccggctcaacggcttggggctgcccaatcccaccgcctataaggccgggaaggggtcccgataccggcgcccagggcctgccaacgatggcctgtggaccccggccacggtggcccggatgctccaaaatcccgtctacgcgggtaccctggtgcagggccggcagcgggtggtgagctataaggtgcaccagaccatggcggttcctcctgaggactggtatgtggtggagggaacccatgtcccccttgtgcccccggccctgttccagcgggcccaggaactggcccagcgggagacccgccgggcgccgggacagaggacgttgcacctgtttgccggcttcctgcggtgcgcggactgcggcaaatccatgagccggaagaccgcccggggcatcgtctactacacctgctccacctaccgccgaaagtccaagaccgcctgcaccaagcacaccattcgggaggaccggctccggtcccaggtggcccaggcgctgggggtacagccagaggcgttgtcccggcggcttctgtttgaacaggtgcgggagattttggtccatgaggacggcgaggtgaccgtctgtcctttgccagcggaaggggcttcctctgtttaacgaaaatttaacatttgggtggttttttattttacatgctggggatagactggttgtaaagaacaggttaaatgggaggaaatgaggaggcatccccaatggaacgaatttacttgctggaggacgacgacagcattcgcaagctggtcatttacgccctgggcagccaaggctacgaggcccagggctttgaccggccttctgatttttggagcgcgatggagggcccccagcccgccttgatcttgctggatattatgctgccggaggaggatggcctttccatcctgcaaaagctgcgggcctcggcggccaccaagcgcattcctgtgatcatgctcaccgcgaagaacacggagtatgaccgggtggtgggcctggacagcggcgccgatgactttatctccaagcccttcggcatgatggagctggtggcccgggtccgggcggtcctccgccgcacggagcagaagccggagaccgaggactaccaggtgggggaccttttcgtcagcccccagcgccatgtggtccgggtggcaggggaggaggttcccctgaccaacaaggaatttgaacttctgtgcctgctgctggagcaccagggcatggccatgacccgggacgccatcatggacggggtctggggccaggagttcagccgggagaaccggaccttggatgtccatgtgcggaccctgcggaccaagctgggcgctgccgggcactatattgagaccgtccggggggtgggctacaagattggaggggcctcatgacggggaaaattttccgcagctgcttcctagtggggctggcggtgatgatcctgtgcaccgggcttttcgtggcggtgatggcctcccagtatgaggaggaggtctatcagcagctccaggaggagctggcctatgtgaagcacggcatggaggagagcggacaggcctacctgaccggtctgcggaccacccagcgcctgacctgggtggacaccgacggcaccgtgctctatgacagtgtggcagaccccgccaccatggagaaccacggggaccgggcggagatccggcaggcgctggaggagggctctggacagggaaaacatctctccaacaccctgctgcaaaagaatctctactatgccgcccgtctgtcggacgggacggttttgcggatttcctgtgtggagaccacggtgggggcgctgattctgggggttctccagccggtgctgtggattttggtgctggccctcatcctgtcggggattctggcctcccggctgtcccggcagattaccaaacccatcaacagcctggatttggaaaaccccaggctggatgagacctatgaggagctctttcccctggtcagccgcctgcgggagcagaaccgcaccattggccggcagatggacgccctgggccgccggcagcgggagtttgccgccttggcggagaacatgagcgaaggggttttgctcatcgacagccgttaccatgtgctctccggaaatcagagcgcctttcacttgctgggggagaagcagcagcccgagagcatccggcaggggacctgccggcgggagatctgggaggccgcgggcaaagccctggccggccgccatgccgagaccctgatgcggggcgagtcccacatcttcgagattctggccagtccggttactgccaacgggcaggtgaccggcgcggtgattctcatggtggatgtcaccgaacgagaggagcgggagagcctgcggcgggagttctccgccaatgtctcccatgagctgaaaacccccctcacctccatttccgggtttgccgagctcatgaaagaggggctggtggaagcggataagatgagggagttcgcgggggacatttacaaggagtgcggccagctcattgccctcattgacgacattatgaagctctcccgcctggatgaggggtcggaagagctgtcggcggaacgggtggacctgtatgacctgtcccaaaagatcctccaggagctcacccctgtggccgcgaagcggggaatttccctgcacatggaaggggggcgccagacgatccagggggtgtggcggattctccatgagatgatctataatctctgtgacaatgccattaagtacaacaaagacgggggcgctgtgaccgtccgggtgacggaagaggaggaccaggtggttgtatccgtggaggataccggcattggaatctccgaagggcagcaggaccgggtatttgagcggttctaccgggtggataagagccattcccgccgggtggggggcaccggcctggggctgtccattgtcaagcacggcgcccaataccataatgcccagctctccctggacagtgaaccgggcgcgggaacaaccattaccctgcgtttccccaaacaaagcgcggcctgaatggaggagagcgagcaccttatttgaagttagaaggagaaatccatgattacatttgaagaaattaaaaaggacccgggtatccggacctatattcagaaggcagacgagtccctgatcaatctgggctttaccgagcacagctttgcccacgtgggactggtggcggccaacagcaagtatattttggagacgctggggtacaccccgcgggaggtggagctggtccaaatcgcggcctacctccacgacattggcaacctggtcaaccgcatcgaccattctcagagcggggcggtgatggccttccgcctgctggaccatctgcatatggaccccttggacattgccgaggtggtcactgccattggcaaccacgacgaggggacaggtacgcctgtcagtcccatggcggcggcgttgattctggcggacaaatccgacgtccgccgcagccgggtgcgcaaccaggacatcagcaagtttgacatccatgaccgggtcaactattcggtgaccaaggcggagctgaagatcaatgagaacaagacgctcattaagctcaaactccacattgacacccggtatggctctgtgatggactattttgaaatttttctcaaccggatggttctctgccggaaggcggcggacaccttggggcttcagtttaagctgattatcaatgaacagcagctgatttgaggcagagaaagagacacggctacgaaagcagcgacggcctgaggtaattacctcaggccgttttttctttgccatccaagactttttttctggtacagggggaaaaataccaagggaagaaaaaattttgatttaaccaaaactttatctttctttggtttttcctttaaccgaaactggatacactgtacttgtagaaaacaagagatcaaacagaaaaccaagaaagaaatgaggaatttaaccatgaaaagaaccatgaagaaagccatgagcattcttgctgcctctgcggttctggccctgacgcttgccggctgcggaaatgaatccaccgatcctgcaacaacagatggcagcgatacggactctgcgtccactgtctccggtacggtggctaccaatggctccacctccatggagaaggtgatcggcaacctgaaggagcagtttgaaaatgacaacgacggcaatgtgacggtctcctatgatgccacgggttccggtgcgggcattgaagctgtggtcaacggcaccgcggacatcggcctgtcctcccgggcgctgaaggaagaggagacctcctccggcctgaaaggaaccaccatcgccctggacggcatcgccgttatcgtcaatgccgacagccaggtggcggacctgacggtggaccagatcgccaagattttcaccggggagatcaccaactggagtgaagtaggcggcgccgacggggagatcgcctgcatcggccgggaggccaactctggcacccgggacgggtttgagtccatcaccggaaccgaggacacctgcaagctcagccaggagctcacctccaccggcgcggtgattgaggccgtgaagaacagccccaacgccattggctacgcgtccctgtctgcggtagagggcaaggagggcatcaaggccctgacggtgaatggtgtggcctgctctgaggagacggttctggacgggtcctatgagattcagcgtcccttcgtgctggtcaccaagtcggatgcgtccctgtccacggctgcacaggccttctttgactacgccacctccaaggacgccagtgagctgatccgcaacgccggcgcggttcctgtggcggaataaccaagcgattcacccaagcggtgcgggcctcctgcctctcgggggcagggtccgtaccgcttaccttatggttttgttggcgagagaaggagcttcccatggaaaaagcattgaacaattccggccctgccgcggccaagcctggccacagggcaaaaagagccgaacccggacgacggggggccaaggatgccctggagtggctgatgcacaccatttttctactgtgcggcattgtggcagtgggctttgtgctggtcatcagtgtgtacctgattatttctggtgtgcccgcgatgaaggaaattggcctgacggatttcctgctgggacagacctgggcccccacggcctctgacccctcttacgggattctgccgtttatcctcacctccatctacggtaccgccggagcggtgctgatcggggtccccattgggctgatgacagccatttacttggccaaggtggccaatccccggatggctgcggtcattcacacggcggtggagctgctggcggggattccctcggtggtttacggcctggttggtatgattgtgctggtgcccgggattcaaaaggccttcggtctgtcctccggcgcctgcctgctggcagcgattgtggtgctggccattatgatcctgccctccatcatcagtgtctccgagacctctctccgagcggtcccggaggagtatgagcaggcctccctggccctgggcgccacccacttggaaacggtgttccgggtgacccttccggcggcccggagcggggtggccacggctgttgtcctgggggtgggtcgggccattggcgaggccatggccattatcatggtggccggcaatgtggccaacatgcctgggctgttcacctcggtgcggtttttgaccacggccatcgcctcggagatgtcctatgcctcggtgggcagcctccagcggcaggcgctgttctccattggcctggtgctcttcctgttcatcatgctgatcaacgtcttcctgaatgtctgtatcaaacgaaagaaggagaattgagatgtcatccctttccaagcggcgcaaggcgtatgaccggagcctgcgcaccctgctgtatctctgcgcggggatcacctgtgcgctgctgcttttcctcattggatatatcttttaccgggggttgggcaacatcagctgggaactgctctccagccagaccagctatatcaacgacaccatcggcattctgccgaactttctcaataccctctatatcattctgctggccatggtcattgtcctccctctgggggtgggtgcggccatctacttgacggagtatgccaccaaccggaaggtggtggcggccattgagtttgccacggagaccctcaccgggattccctccattatctttggtctggtgggcatgctgttctttctccagctgtttggattgaaggcgggcattctggccggcggcctgacgctggtcatcatgattctgcccaccatcgtccgtaccacccaggagagcctgaagacggtgccccagtcctaccgggagggggcgctggccctgggcgcggggaagtggcacatggttcgcactgtggtgctgcccaacgcggtggacggcattgtcaccggctgcatcctggcggtgggccgcattgtgggcgagtctgcggctctgctctttacagcggggttcggcctggagctgaacaatttcatcacctctcttcaggcctcttccgccaccctgacagtggccctatatgtctacgccaacgagcggggggagaccggtgtggcctttgccattgccgcggtcctgatgctgttggtgttcctgatcaactttgccgccaccctggcaggcaagaaactgaaacgaaaggcaggctgaaccatggcagctgagatcattaccgccaagtccctgaacctgtggtacggcaccgatggaaaaaccagtgccagcgaccgggggcatcacgcgctgaaagatatcaatgtgaacattccggcccggcagatcactgccctgattggtccgtccggctgcggaaagtccaccttcctcaaaaccctgaaccgaatgaacgacctggttcccggggtgcacattgagggggaggtctgctttgacgggcagaacatttttgacaaaaccgtggacaccacctggctgcgcaagcaggtggggatggtgttccagaaggcaaacccctttcccatgtccatttatgacaacgtggcctacggtccccggacccatggcatccgaaaccacagcgaactggatggcattgtggaaaaatccctgcgggacgcggccatttgggatgaggtgaaggaccggctgaaaaagagcgccctgggcctgtccgggggacagcagcagcggctgtgcattgcccgggccctggccaatgagccggaagttcttctgatggacgagtccacctcggcgctggaccccatctccaccgcgaaaattgaggacttggccgtggagctgaaggagaagtataccgttattatggtgacccacaacatgcagcaggcggttcgtgtgtcggataaaaccgcgttcttcctgctgggagagctggtggagttcggggacaccgacaagatcttctccatgcccaaggacaagcggacagaagagtacattacagggaggtttggataatgcgggaaaagttcaaacagcagctggaggagatgtaccggcagatggtcattatgggcagcctttgccagcaggccattgccgtggcggtgagaaccctggacgaggaggaggaccgggcggaaaaattggaggcccaggtgtttgccgtggacggggagatcgacgacatggaacgggagatcgaggctctgtgtaccaaactcctgctcaagcagcagccggtggcggcggacctgcgccggatcaccgcagcgctgaaaatggtgaccgatctggagcggattggggaccaggcctcggacattgcggagctggcccggtttattcgtaaggggggagcgcacagccacctgaaacagatggcggcggaggtcatccggatggtcagcgagagcgtggacgcctttgtccggctggatctggaccaggcccgggaggtcattgcctacgacgatgtggtggaccggtggtttgatcagattaaaaaagaactggtttcccagattgccgcggacagcaccgctggggaggaactgctggatgtcttcctggtggccaaatatctggagcggattggcgatcatgccaccaacctggcggagtgggtggagtacgcgctgaccggaactcgttccaaggatgggcactgggaggcgccggacggagagtaaggacaaaggactctttatttaacctggatttaacctttttatggtttttctttttacgtggggcagataaacttttcattacgacaggaaacgtaaaaggcacgtaaaaaaagagaaaacagagagggttaaacgatggatctatttgacgtattgactttattgggaggactcagcctgtttttgtttggcatgaaccttatgggggcctccctggaaaagagggcgggcagcagtctcaagattttgttgggaaagctgacctcccgcaaaatattgggattcttgacgggaatgggtgtcacggcggtgatccaaagttcctcggccaccacggtgatggtggtgggctttgtgaactcgggactgcttaccctgcggcaggccatcagtgtcattatgggcgccaatgtgggcaccacggtgaccgcctggatcctgagtttaacgggtttggacggagacaatttttttgtcatgctgctcaaacccacttcttttacccccattctggcgctcatcggcgtggttctcaccatgatggccaaaagcgacaagaaaaaggacgtggggatgatcctgctgggctttgccgtgctgatgttcggcatggacaccatgagcggcgcggtggccggcctggaagaggtgcccgaattccggaatatcctcttgatgttcagcaaccctgttctgggggtgctggccggcgcgggcctgacggcgattatccagagctcctcggcctctgtgggtattttgcaggcgctctctgccacggggcaggtgacctatggcgcggcgatccccattatcatggggcagaacatcggcacttgcgtgacggcgatgatctcctcggtgggggccaacaagaacgccaagcgggcggctgtggtgcatctcctctttaatattgtaggaaccgcggtttggctggcggtcttctacggcatcaacgcggtggtccagttctcttttgtctcccattccattgaccagctgggcattgccgtggtgcatacggcctttaacatcctgtgcacggcgctgctcttccccttctccgggctgctggaaaagatggcctgccgcttggtccccgacaccaaggcccccgagaagattcaaattttggacgagcgttttttggcaaccccttctgtggccattgaccgctgccaggaggtggcggagaccatggcgcggatttccatggatgccttgaaaaccagctgtcagctaatcgagcactatgaccccaaaagcgcccaggcggtccgggagacggagcaagaggcagaccagtatgaggacatgctggggacctatctggtgaagctgggccgggcggatttgaatgcggcggacagccgggagacggcgaagcttctgcacatcattggggactttgagcggatctccgaccatgcggtcaacctggtggagtcggcagaggaaatccgcaacaagggcttgagcttctcggtccacgccaagcaggagctggcggtactcaccgcggcggtgggagaagtgatggacctggcgctggacgccttcctccagaacgaccctgcgctggctgccaaagtggagcctctggagcaggtggtggataccctgaaggagcagctgcggaaccggcatattctgcggctgcaaaaaggggaatgtaccattgaattgggctttgtctggtcggacctgctgaccagcttggagcgggtggccgaccattgctccaacatcgccggctgtgtcattgagatgtcccatgacagtttggatgtccatgaatatttagacaatgtgaaagccggcggccccggtttcctccgggcctatgaggcatacgcccagaaatatgcgttgatgtaatcctctccggcataggatgtgatatcccgctttgagagggcaaaaaacaggatcgtgttgttcataaatcatggcttccaccggcgccgtgggccccaccggaccaattggtttgactggggctcccggcgccactggcgcaactggggcagcgggtgccaccggtgccaccggtcctgctggtcctacggggcctgccggtgcagccggtcccacgggccctgccggcgcggctggtgccacgggggcgacaggtcccgccggtgccacgggtcccaccgggcctgctggtgctgtgggccccacgggccctgccggcgcggctggcgccacgggggcgacaggtcccgccggtgccacgggtcccaccgggcctaccggtgctgtgggccccacgggccctgccggcgcggctggtgccacgggggcgacggggcctaccggtgccacaggccccactggtcccacaggccccactggccctgtcggtcctgccggccctgggctgacggatgccacggcctttgctccgggaaccacctatcaggagggcgacttggtcttctacaatggcgcgttgttccgtgcggcgatcaacgcgcccacgggaacccctgggacatcggctgactacaccctgctcacggctacggagaccggtcccaccggccccacgggccctgccggggcagagggagcggccggaccgaccggtcctgctggcgcggctggtgctactggaccgaccggtcctgccggcgcagctggtgccaccggccccactggacccgagggcgcggccggcgcggagggtcccactggccccaccggtcctgagggcgcggccggcgcggaaggtcccacgggtcccactggacccgagggtacggccggcgcggagggtcccactggccccaccggtcctgagggcgcggccggcgcggagggtcccactggccccaccggccctgagggtgcggccggcgcggaaggccccactggccccaccggtcccaccggccctgcgggtacaacgggttctgctggtgcagaaggccctacgggtccgacaggaccggctggtgtggtgacacccgctgcggctgtaacggatgccaccagcactacggatattgtgacccaattcaatcagctgttggccaacatgcggacagcaggcctgctgtccagctgacacggaagagaacgatccaactggatctcaacacgaaagaggggcggcgcactgcgccgcccctcttggctcagagaaggaggtcctatgaaaattgttgtgtatgccatctgcaaaaatgagaggccctttgcagatcgctggatggcctccatgtcggaggcggatgaggtgtgcgtgctggacacagggtccacagacggaacgccccagagactggaggagttgggggccaaggtctctgtccaggtgattaccccctggcgctttgatgtggcccggaaccaatcgctggagctggttccagaggatgcggacctctgcgtgtgcaccgatttggacgaggtgttccagccgggctggcgggaaaaggtagaggcggcctgggcccctggtgtggatcgtctgctctaccgctatgtttggaacttcctcccagacggacgggaggggatggtgttttggtatgacaagatccaccggagaaagggctgccgctgggtgaatcctgtccatgaggtgctccaatttgacgggggagcgccccaggcccggtacgtggagggggtctgtctggagcaccatgcggaccgaagcaagagccggggacagtacctgcccctgctggagctggcggtggaggaagaccccaacaacgaccgcaacgtgcattacctggggcgggagtattttttctaccggcggtgggaggagagcattgccatgctcaagcggcatctggccctgccgacagccacttgggcggatgaacggtgtgcctccatgcgcctgctggcgaaggattattttgccctggagatggcgggagaggcggaacggtggattttccgggcggttggcgaggcaccccatctccgggagccctggctggacctggcggacctggcctaccaccaaaaggactggcacggtgtgctttgggccacaggccgggccctggccatcacccagcggccccgaacctacatcagtgaggcggcctcctggggagagcatccctgggacctggccagcctggggtacttttacacagggcagtacgaaaaggcgctggaggcggcccggaaagcgcgggacctggcgccggataacccacgcattcagaagaatcttcaactcatcgaagggaaattggcgccggcttgaggcggggcgagggcagcaagcggttgcgttgtctctccctttgtcgtatgatagaaaccatactacgaagaataaagataggggagaatcgagcgatgtacattcgaaaagccgccgaaggggaccttccccggatgatggagatctatgccgtggctcgccgctttatggcggcccatggaaaccccaaccagtggggaccgaccaactggcctccggaggaacgcatccgcgccgacattgccgagggcagcagctatgtttgtgtccggcaaaaccgcgtggtgggggcgttttacttccgccaaggggaagggatcgaacccacctatcagaggattgagaatggcgcatggaaagaggcgggtccctacggcgtgattcaccgcctggcgggagacggatcggcaaaggggattggaaccctctgcctgacatgggcctatcagcagtgtggtcatcttcgcatagacacccacccagacaaccatgtcatgcagaatttgctgcgaaagaacggatttgtccactgcggaacggtctacgtggtggaggacacctaccccaggctggcctttgagaaggtgtcatcccagtgaagcaccggcggagatgggaaaagaaaacgttatggagaacgggaaaaaaccgttctccataacgttttttgctggaaagagattgtttttgaaacctgcggtggaggttaaaagtccgcgctccccacagtgcgggggtggggcagaacgtcgcggatgttggagatgcccgtcagatacatcaccatgcgctcaaagcccagcccgaagccggcgtgcttgcaggaaccatagcggcgcaggtccagataccaccagtagtcctgggggttcatccccagctcctggatgcgggcctccagtacgtccagccgctcctcgcgctggctgccgccgatgatctctccgatgccagggaccaggcagtctgtggcggccacggttttgccgtcgtcgttcagacgcatatagaaggccttgatctctttgggataatcggtgacaaacacggggcgcttgtagacctgctcggtgaggaaccgctcatgctcggtctgcaggtccgtgccccattccaccttaaagtcaaacttgtcgttgtgctgcttcaaaatctccactgcttccgtgtaggtcacccggccaaagtcggcgctggccacgtgctggaggcgctccagcaggcccttgtccacaaaggagttaaagaaatccatctcctgggggcagcgctccaggacggtgcggatcacatacttaatcatgtcctcggccacgtccatgtctccggccaggtcacagaaggccatctccggctcgatcatccaaaactccgcggcgtggcgctgggtgttggagttttccgcccggaaggtggggccgaaggtgtagacgttgccgaaggccatggcaaagttctccgcgttgagctggccggacacggtgaggctggcgggcttgccgaagaaatcctggctgtaatcaatttggccgttctccagccgaggggcgttttccgggtccagggtggtcacccggaacatctcgccggcgccttcgcagtccgaggcggtgatgatgggggtgtgcacgtagacaaagccccggttctggaagaactcgtgaatggagaaggccgccacagaccggacccggaaggctgcggagaagaggttggtccgggggcgcaggtgggccaccgtccgtaaaaactccaccccgtggcgctttttctgcagggggtattccggcgcggagggaccttccacctggatggaagcggccttgatttccaggggctgcttggcctggggggtgaggaccaccttgccttggacaatcaaagccgcgcccacgttctgcttggcgatctccttgtaattttccaaggagccctcctcaaaaaccacctggatgcttttgaagcagctgccgtcgttgagttcgataaaaccaaagtttttcatgtcgcggatggtgcgggtccagccgcagacggtcacgtcctgaccgtcaaagtgttccatatccgcaaagatacgggcaatttctgtgcgtttcatggtgacagtgtcctttcaatcaatgagagtcttaaagtgtaggaaaaggcaatagggggctgggaaagaaaaccagagaaaattatgcctgccggcctggccccgccatccgctgggtgaccgggacgtaggaccggctggctttccctgtgatttgcaggggctggatgcgcagcagggtggtgttcttggctttcttggccagatactgtgccttaatttccggggtcacatccccaagggtgtcaatgaggctgcccagggcggccaggcgttcctcctctgcggtgaccacctgagcccggcccagcaccaccacgctctcatacagggtggtgatatgggcggggatcacctgggcctgggtgacgacggtgaagcacacccggtcatcccgggcaatggcgtccagcttatagcccgccctggcgcagtggaggtaaatttgtgtccccatcacggtgtaattcatgggaaccgcgtagggccagccgccgtcgcccacaaccgagagtacgccgtgggttcctttggccaaaatggcgcgggcatctgccgcagaaaactgccggtccttccggcgcatgggccgttctgtcataggagatgcccctttactgttcagccaccacatcgccatgctcaatatggtaggcgatgcgctggatgatcatcatcagagccacggagttttttccgccctccggcacaatgaggtcggcgtatcgcttggagggctccacaaactgctcgtgcatgggttttaccgtggccaggtattgctccaccacggagtccaggctccggccccgctccttaacatcccggacgatccggcggagaatgcgtacatcggcgtcggtgtccacaaagagtttgatgtccatgagatcccggagggtcttgttttcaaagatgagaatgccctccaccaaaatgactttgttgggtttgagctcccgggtctcctcggtgcggtcgtggatggcgtagtcgtagacgggacagtggatggttttgcccgcccggagggcctgcaagtcctggatcatccggtctgtgtcaaaggaggcgggatggtcatagttgagggtttgccgctgctccagggagagatcgtggtgggcggcataataattgtcgtggggaagtacgctgatgtcatcgccaaactgctccagcaggcggtccaccagggtggttttcccggagccggtgccgccggcaatgccaatgatgaggggtttcatggtttcacctccaaatagaatggggaccagggccccggcaagagaacagagaggaccggggcgggggtcctgtgccgggggacggttacgtgtcctcctcgcttcgttcgttgaactcggtcagaaccagctgaggattgtggtcggagacccatttaatggaccagaaggaggagaacaggaggagcttgttgcccttgtaatcctccaccagcttggtgtcgttgcccaaaaccaggtcggtttcatggaactccacgggctccttgatccagcgcaggtattcatagggcagggtgtccatacggatttccacgttgtactcgttgcgcaggcggtattggaagacgtcaaactggagggtgcccaccacgcccacgatgacctcctccatgccggtataggggagcttaaaaatctgaatggcgccctccagggcgatctgttccgctcccttcaggaactgtttccgcttcatggtgtccaccgggcgcacccgggcaaagtgctctggggcaaaggtggggatggggtcaaagcgaaatttcttccccggggagcacagggtgtctccgatggagaagatacccgggtcaaacacaccgatgatgtctccggcataggcctcctcaatgatctcccgctcggcggccatgagctgctggggacgggagaggcggagctttttcttgccctggacgtggtagacctccttctccgcgtcaaaccggccggagcagacccggagaaaggcgattcggtcccggtgggctttattcatgttggcctgaattttgaagacgaaggcggagaagaagtcctccatggcgtcaatttccccctcgctgctgtgccggggcagaggagaggtggtcatacggaggaagtcctctaagaagggctccacgccgaaggtggtcagggccgagccgaagaagacgggggagagcttgccgtggcgcacccggttcaggtcaaagtcacaggaggcgccgtccagcagggcgatgtcctcgatgagctggtcccgccgggcctgccccagcatgtcggtgagaaccgggtcgtccagatcaatctgcgtggtcccggacttcttggcgttggtgttggaggagaagtgcaggatctcctgcttgttccgatcatacacccctaaaaagtccttgccggacccgatgggccagttgacgggataggtgtcgatgcccagttccttttcgatctcctcacacagggcgaaggggtcgcgggcttcccggtccattttgttgatgaaggtaaaaatggggatatcccgcatgacgcagactttgaacagcttccgggtctgtgcctccacgcccttggcgccgtcgatgaccatcaccgcggagtcagcggccatcagggtgcggtaggtgtcctcggagaagtcctggtggccgggggtgtccagaatgttgatgcagaagcccccgtactgaaactgcagcacggaagaggtcacggaaatgccccgctgcttttcaatctccatccagtcggagaccgcggcccgggtgttctttttccccttcacctggccggcctgggcgatggccccgccgtaaagcaggaatttctccgttaaagtggttttgccggcgtcggggtgggagatgatggcaaaggtccgacggcgtttgatttcagattcgaattgagacaaggtggtaacctccgaataaaagttcaaatggagagattccccagagaaaggagacgggagaggccgccgggcatttgaggtgggcagggagctgactttctccagagggaatcgtttctataacatctcattttagcatgcaatcggccggaccgcaagagaaaaaccaccttctccagggagtcccgcggcagtttttgttctgagcgggcaggtgatttttcccaagggcctctgaggaaaacagagagaaagaacgtgcgtggaatggggttcattctacgcacgttcctgggaaacagaggataaaatcacgttgtgcagaaaagaccgtcaagggtcttctttgccctcgggcagaagggtgaccagggcctcctccagacgatggtgctgaatttgggtcatttgaatctggagacggtcggtctgcaggagaatgttccggccgtcctgggggacagagccgtacagaccaaagacatagccgccaaaggtgtcatactcctccaggggcaggtctacccccagggttcgggccacatcgtccaggggggccgagccctgaatccgccaggtgccctcttccaagggctggatttcgggcagttccccctcctgctgaatctctcccaccagctgttccaataggtctcggatggtgaccacccccagcagaccgccgtattcgtccagaaccacggcgtaataggtccggcgctgcttcatctgctggaagagaacgtctgccttgagggtctctgggacaaagaacgcgggctttaccacggtgtccaggatttcctggatgggacggtcctggaggcggaaaaagtcccgggcgtccaagatacccaccacctggtccaccgagccggcacagacgggatagcgggtgtgccgggtttcaaagaggatctgcttccattcctcggtggtttggcttgtccagagcaggtccagttctgtgcggtgggtggcgaattctcccacggtgaggtcgtcaaattcaaagacattctgaatgaactccttggtggcggagtcaaagacccccttctcactgccccggtccaccatcattttgatctcttcctcgctgacctcctcctcgtcggcgttggggtccacccccagcagacggaggacgccgttggtggaggcggtgagcaccgtgaccaccggggcgaagatggccgaaatggcggagatcagggcggacagccccatggccagggactctgattttttcatggccagccgcttgggcaccagttccccgaagactaaggtgaaataggagagcagcagggtgatgagaatgacggaaagggtgtctaaggtcttttccgggatggggaccccggcgcgcagcagaagggccaccagccggtccgagaagtggtcggcggcaaaggcgctgcccagaaagccggacagggtgatggcaatttgaatggttgccaggaactgggccgggcggctggtgagccgggccagccgcagggcgcgcttgtccccttgggctaccagctgcgccagcttgttgtcgttgacagagatcaccgcgatctccgcgcaggcaaagacggcgttaagggcgattaggatgacttgcagcaataagggccatagaacagcctgcatggttggaattctcctcctcaaaatttctgggggtttcccaggatatgactgaattatactatgccccttgtccggggtcaagatggggcgggggtatttctggaaaagaatgacagatgaaaagaagaaaacaggctggagagggactattggggggtggacatggggtcgggctgcatctccggcaggttgtcccagtaacgcttgggcatgtgggacatgcggcacttggggttgtggcgggcgggaatggcgatggtctgatagaaccgccgccagagagcctgacattgcagttcggcctggtccggtcggtccaggtccagatggtccacgggacggattttccacttgcggtcggcgtagaagaggccttcccggtgggttttgtcgtggaggagaaaggcttcttccggtagccgctggcagaagtgagggcggagcagggggagcacccggttcttcggggcaatctggcccaccaagacaccgccgtagtctgcaaagcggacgaatcccttgagctggtgggcctcatgggtcaggtgctggatggcccgggtgagcaggaggacccggtcgtcggtaaggtcctggggcagggcctggtgaaaggccagatagatcaggtcgaacatagttcgctcccgctggggcaggcaggtaaggaagctgtacgtgatcagccggcggaaggtggaggagacggtttcctccaggctgcggtagaccgacttggccagggcctggtcggtgggagtttccagaatggggtacagggagatctgctccacgccaggggagagaaagtagaagggatagaccttctgccggaaactctctccgacgcaggtgagaaagccggcgaaggagccgtcatacagcatcgcgcatgggggccaggtggacatcagaacctcctttcaggcggggaaaagggagagctgttcgtagggcgcgggcagagcgggggcctccaggagggtcagggcccgcaggacccctgccggggtaacccggagggcgggggtcattttgccggagcaggtgatgaaatactgggcccgcttcagaaccacccccagcttgcccagggcggtgtgatccaaagaccgccaccgccgggcggagagaatccgccgggcactgaccaccccgatgcccgggacccgcaggagggtgtgataatccgcggtgttgacctccacgggaaagtattccaggtgggacatggcccagctgcatttggggtccagctgggggtttagggtggggtgatcgggggagagaagctcgtctgcctggaagtggtaaaatcgaagcagccagtctgactggtacagccggtgctcccgcagcaggggcggccggaaggacaggggggaggggagcagaggactgtgggtcacaggaacataggcggagaaaaagacccgcttgaggccgtatttccggtacatcccctccgagagcttgagaatgtgatagtctgtctcatccgaggcccccacgatcatctgggtggactgccccgccggggcgaaggccggggcgtggcgaaacttctggcgctctgccttggactgtaaaatttcctgtttgatctgagccatcggctgaaaaatggcgtcggtctttttgtccggtgctaaaagcgccaggcttttggaggacgggagctcgatgttcaccgacaggcggtcagccagccgccccagccgggcggtgagcaggggatcggcgccggggatggccttggcgtggatgtagccggagaacccgtagtcctcccgcaatagggtcagggttcggatcatcagttctgtggtgtagtcggggctgcggaccacggcggagctgaggaagagcccctcaatatagttgcggcggtagaagtcaatggtgaggtccgccagctcccggggggtgaacatggcccggggcaggtcattggaggtccggttcacacagtattggcagtcgtagacgcagacattggtgagcagaagcttgagcagggagatacaccggccgtcggcggaaaaggaatggcagcagccggccgcgatggttttgcccaggcggccgccccgccggtctcctccgctggaggtacaggccacatcatacttggcggcgtcggtgagaatggtgagcttttcggcaagggtcataggggacacctcctgaagggaatggccaaaaaatcgaacgtatgtacgaatagtataccagcctgtcaggggatgtcaaaggaaaaggatggcaaaaaaacaccggaggaaacttcctccggtgttgggtccgcgttttgggactgattaggcctggttgttggcaaaggcggctggaatttcgtgcttgatgcagcggcggccctccttggaccagatattgcccagacatttggtgcagccgacgcagggagagtcctcgccttgctccaggtggcggacgaagtcgggctggcagatgaagggacgggaggcggagacgaagtcgatgccggcgtccaggatctgctgggcggtctcagggccgcggaccccgcccaccaggatcagggggatggagaccgcctgacggatttgtacggcccggtccagatagaaggtggggatctttttcttgccgaggcccaaccagttgtagccggacagctcaatggcatcggcacccagggcttcaaactggcggcagaagtagagaatatcctgggcataggcctcgtcagcctctccggcgcagttggtgttgaccttcaccaggatgggatagtccttgcccacggcctggcggatggcggagagacattccccggcgaagcggaaccgattctccgcactgccgccgaattcgtcggtgcggtggttggtgttggggtccaggaattggctgaggaggtagccgtgggcgcagtggagctggatgccgtcaaaccccatctcctgggcggccttggctgcgtccacaaagtcgttgcggattttttcccgatccgccgcggtgatctccgtggtttccatttcgttgggggctttcatgccgccggagggggccagcagcttgccccctgccacgtgcttttccggcatgaagacattcatgccggcgtgcatgagctggaggatcaggcgcccgcctgcggcgtggacggcgtccagcacttccttctggctggcccgctgttccggggtggcaaaacccacctggatgccggtggaacgggcctccggggagatgtagctgtacgcggtgatgatggcgccggtgccggctgcggcgatctcgcggtagagttccacctgctccggggcgcaggtgccgtcccggcggccgaaggggtcctgggtggcggaacggatgacccggttgggcagggtcagggtgccgatctgaccggcggtgaagagtttagaagccatggaaacgtctcctttgtcaagtgtcatgaggctttgggtaccattacagtacaactttttcattatatcgaaaggtgtcggaaaatacaagagaaaagaaccgggcgaccggcgcaggttacttatcgtagcggaatgcagaaacgatataggcaattctcgatgccccataaggtaaaataccgcccataaccagccagataaaggcatattcccgagtcaggccgaaggcaatcatgccagcgataattgtcataaatgatgcatgtagcgcaacccgaaaggctttcgcggcacattttaactcgatgtattgatttctttcgtcctgctctgcaatcaaatcctcctccgttttcttaggtctaagggcaaaaataagggccagcagaacaaggataacgagagcaacgcctgccgtggctttttgtgggggtgtgagtgtagtaatatcgccgagatagaagctgaagaaagcagctaataccaatagcacaccgaatagtttgctttttccattgaataattgcatgtttatagttcctccccttcttcttcaccgtcaatatgtagcgccatgaccatgtgataaagagcggcaaggaggcagattccgatgaatatgatcggccttaacataccgtgcgtagcgtcggtgaatatacaaaaccttgatatggcaataccaacgccaagaagcaggagtaaaatgccccgtacaaacatttttttatctttgatcctcatgttgtccttcctccaacgtcacattttctttcaaacagcacaattcctccactgtcgtgttgaataagcgcgcaattttgtaggccagtaccaacgacgggttatattcgccccgttctatggaattgatggtcctcactgttacgcgcacctggttggcaagctgctgttgtgtcaacccggcggcagtccgtaaatccttgatgatcgttttcacactcctcacctctgaaataggaagcttacttcttaggaagttaacttcatattatagcaaggcaaagggaatgtcaagagaaaagaagttaacttcttattgctcacggggaaacgaaggaatgctgttttgtgaaacggctggagtttcttccggcaggacctattttgaacggagaaatcaggccgggaaagttccgattgacagggttgggtttgaggggatagaatgaaaaagagagaaaagagagggggctgccgatggagcaaaagaaaaccctggggctgatgacagtgaccgggtgctatgtgctgtggggaatcttggccattttctggcgctttctggcccaggtaaactcggtctatgtcctggcccagcggatcatctggtccctggtttttatggggctgtacctgctgtttacccgacgggggcgggaggttgcggcggctttccgagaccgaaaaaccatggtcaactgcctgctgtgcggggttctcattaccctcaactggggtatgtacatctacgcggtcaacagtgggcatgtgctccaggccagcatgggctatttcattgagccggtggcggtgggtctcatcggggtccttgcctttcgggaaaaacccagtccgggggagaaggtcacctttctgtgcgctggggcgggcatcgtgtttttgacggtccgcacagggagcctgcctgtgctggccctgatggtggccattccctttgccatttacggggccctgaagaagaaaatcaccctgacggcccagacttcgctgtttatggaaaccctgtggatgacgccgctggccctggccttttccggctggtggacggcccaccaggggggcacggcggctgtgctgggggatgcggccctgtggctgctgccggccagcggggtggtgacctcggtgcccctgctcctgtttaacctgggggtacgggagattccctactacttttcaggcattctcatgtatattaaccccaccctccaattcctggtgggcctgctctactttggagaggcgctgcaggtggatcagcttatcgcctttgtcatcatctgggcgggcatcagcgtcaccatggtggagaaggggcggcggattcgccgggagagagcggcctggaaggagggggcgtcagggggataaccgaacgggcaccgcctctcccagggtcaggctgtccggggtgacggtacagcagcgggccagaacggcaacccccgcctgggccgcctggcgcagagcttgtccaaaggcggggtgggtgtggtcgttgggggcgaaaaagtccgcctgctccatttgaatgacgaagcatacggccccctcataaccttgggccaaactgtctgtcaggccgtggagatgctttatgccccgctgggtgggggcgtcagggaagtaggcggccccgtccctctccagggtaacccccttgacctcgacaaagcccttgcggggcccggcctcccagtaaaaatcaaagcgggagtccccgtgacggcactccggtttgagtaaggtgagctgggggacaaagtggccggcggcggcccattcataaaagacctgattgggagcctgggcatccatgttgatgagccgggctcctttctgtaccgcgatgaggtcataggcggtctttcggttggggttggtgctcttggtcagccagacctgggccccggggaggagaagctcccggcagcggccggtgtttttgacatggacggtgatcacttccccctccaaaaggacctgggccacaaaccggttgggccgggagagaaagacagcagaggtgacgttggggtaatgcaagggggacctcctttcggaaatgggtggaaaatgtcccacggacatgctacactaaggaaaaaccgatggtgagggcatcataccgcaaccgatggccctcgtcaagaaagcggggcgatttcgatgacggactatctcttggcgctggatcaaggcaccaccagctcccgggcgatcctgtttacccggcagggttcagtggtgtcttcggcacagattcccttctcgcagtattatccgcagcccggctgggtggagcacgatcctttggagctgctggacagccagctccgggcggcggcccaatgcgtggcccagagcggcgtgcggcccggtcaaatcgccggggtggggttggccaaccagcgggaaaccgcgctgatgtgggagcgggagaccggcaagccggtggggcgcgccattgtctggcagtgccggcggaccgcggcgttctgcacccagctgcgggagcaggggtatacggaggccattcgggcccggaccgggctgctgccggacgcctatttctccggcaccaaataccggtggctgctggagcacacccccggcgcccggcggcgggcggagcggggagagctgctctgcggtacggtggacagctggctgctgtggaatctcaccgggggaaaggtccatgcctcggactactccaactgctgccggaccatgctctttgacattcaccgccggtgctgggatgagaccctgtgccagttgctggacgttcccatgggctggctgccccagccggtggaaaacagcggggacttgggaaccatcgcctcgggggtccctcatttgcaggacctggcggggctccccatccggggggcggcgggagaccagcaggcagccctctttggccagggatgctttcaggcgggacagctgaaaaacacctacgggacgggctgctttaccctgatgaacacgggggagaccccggtgctgtcgcaaaatggcctgctcacctgtattggatggggcctggaggggaagactacctatatcctggaggggagcgtgttcaacgccggctcctccattcagtggctgcgggacgagctggggatcatccggcaggccagcgactgtgacagactggctgaacaggtgccggacaacggcggcgtgtacctggtctccgcctttaccgggctgggggcgccccactgggacatgtatgcccggggcacggtggtgggactcacccgggggaccacccgggcccacctctgccgggcggccctggagggcattgcctaccagacggcggacctcattgccgccatggagcgggacgccgggcggcccatccagtcccttcgggtggacggcggggccagtgtcagcgattttatgatgcagtatcaggccgatctgctgggagtgccggtggaacggccggcggtggtggagaccaccgcctggggcgcggcctgcttggcgggcctgggcgcgggactgtggcacagcccccaggagattgcccgggagggggcgccgggcagggcttacgcgcccaaaaccgaccggagccgggagtatgcccgctggcaaaaagccctggagcgggccaaagcgtgggaggaggcgtgagagaacagatgacagcattggagcggtttttgaagtatattacctttgatacccagtccgaggaggggtcggaggcgaccccttccacggagaaacagcgggcgctgggcagggttttggcccgggagctggcggagatgggcctggaaggggcctgcctggcggacaacggcgcggtctatgggtggctcccggccacccccggacgggaggacgtcccggtgattgccctcatcgcccacatggacacggcgccccgggtccccgggggaccgatgaaggcccgggttgtctcctatgagggaggcgtgctggtcctgaatgaggagaaggggattgccctgtctccggcggcgtttcccgacttgctggagcaggtgggcaagcagctggtggtcaccgacgggaccactctgctgggggcggatgacaaggccggcgtggcggagatttttgctgcggtggaacgtctggtccgtgacccgcggctggcccatggacgggtggcggtgtgcatcaccccggatgaggaggtaggccggggggcggactatgtggacctggcgcggctgggcgccgcgtttgcctatacggtggacgggggtccgctggggacgctggagtatgagaacttcaacgccgccgctgggacggttctcctccacggggtgaacatccacccaggggagggaaaaaacaagatgcggaacgcctgcctgatggcggcgcagttcatcgccatggtacccccggcggaggcgccggcccatacggagggatatgaggggttctatcatctgtgcgccatgaccggggacgagagccaggcaaggctggagtggatcatccgggaccatgaccaggcccgtttcgcggagagaaaggagaccctgacccggatcggcgcctatctggagagacagtatgggcccggttccgtggaggttatcctcaccgactcctactacaatatgaaggagcggattctcccccacccccagttgctggactgggcccgggcggcctttcgtaaggcgggggtggagccccgggacgtccccatccgcggggggaccgatggggcgcggctgagctatttgggcctgccctgtcccaacctctccacaggcggctatcacttccacggggtctatgagtatatcccagtggaatctttggaaaaaatgaccgaaatgctggtgtatctgctgacgggaattgatggaacaaagaaaaatggaaaaatttaaaatgcctcttgacaaatggaggctttttgggtatactaaacatcgctcgttacggcgggcggacgcggcggcatagctcagttggctagagcattcggttcatacccgaagtgtcactggttcaaatccagttgccgctaccattggttttgggagggtcacctcccggaaccagcctggcccgttggtcaagtggttaagacaccgccctttcacggcggtaacatgggttcgagtcccgtacgggtcaccatatggaggcatagctcagctggtagagcgctcgcctcacacgcgagaggtcacagattcgagttctgttgtctccaccaagaaacgtcttgaaattctaaaatttcaagacgtttcttttttgtgtccgttcccattcggggcgctgtgctgttatttgtccgtgccatcgaaagcgcggcccttctcctcggagaagggccgcgcttacttggtacactgggggtcagagggatcagccggtgcggcgcttcatgggtagggcaattttatggagtgatatgaaatgattattttgggggccgggaagaaaaggacgcggaagggcagatcctgtcgggacggaagaaatcccccttgacaggaagagaaattgtgataaaataaacaagtgacgaaaaataaaacttttgcttatggaggtgaggggatgacccagcgggagcagcagattctggactggattacagaggacccgatgatctcccaggaggccctggccgagcgggcggggattacccgctcttcggtggcggtacatatctccaacctgatgaagaagggccacattgtgggccggggttacatcctgcccgccggcggctacgtggtggtggccggcgcggtgaatgtggacatcgggggacagtccgccggcccgctggtggggcgggattccaaccccggcaaggttacggtgagcatggggggcgtggggcggaacattgcccacaacctacggctgctgggggtcaaggtctccctgctgacggcgctgggagaggacccccacgctgggcaggtgatggactcctgcgagcggctggggattgacctgagccgggcgctccacgtgccgggggggaccacgtccacctatctgttcctcagcgacgagacgggggacatggccctggcggtctccgacatgggaatctatgaggagctcacccctgcttactttgcccggcaccaggggtacctcaacggggcggccctggtggtggccgacgccaatctgcccgccggcgccctggcctacctggccgaccactgcaccgcgccgctgctggtggacccggtgtccacggtgaaggcggagaaggtgaggcccattctggggaagctccacaccctcaagcccaaccgcatggaggcggaatccctttccggggtgaagatcaccgaccgggccagcgcccgccgtgcggcggaaaagctgctggagaccggtctggagcgggtgtttatctccctgggcgaggagggcgtttttgccgccgatcaccaacgggacgtgtggttcccgtgctgtcctgcccagatgcacagcgccaccggggcaggggatgcctttgctgcggccctgggatgggcattcctggagggaaaggacctggctgacagcgcccgggccgccaacgccgcggcggccatcgcggtggaaggagaaaaaaccatcaatcccgcgctctccgcagacgcggtacagcagcggatgcaagaacaggaggaaagaatatgaatcagtatcttgacgtgaaccccgaggtggcccaggcagttgcccagggcaagcctgtggtggccctggaatccaccatcatctcccatggcatgccctatccccagaacgtggagaccgcgctgcaggtggagcggatcatccgggagaatggggcggtgcccgccaccattgccgtcctgggcggccggctgaaggcgggtctgaccaaggaggagatcgagtacctgggcaagcagggccaggcagtgaccaaggcttctcgccgggacctgtctgtgctggtggcccagggagcggacggcgccaccacggtgaccaccaccatgatgatcgctcacatggcaggtatcaaaatttttgccaccgggggaatcggcggtgtccaccggggggcggagaccaccatggacatctccgcggacctggaggagctgggccagacggacgtgatggtggtctgcgccggcgccaaggccattctggacctcccgctcaccctggagtatctggagaccaagggggtgcctgtgctgggctaccagaccaaggagctgcccgccttctacacccggacctctggcctggcggtggactaccaggtgaacagcccggaggagctggccaaggtgctgaagacccaccataccctgggactgaagggcggtatcctggtggccaaccccattccccaggcctattctatggacgccgatgccatcaacgccgttattgaccaggcggtggcggaggccgacgaaaagggcattcacgggaagcagaccacccccttcctgctggcaaaggtgaaggagattaccggcggagacagcttggaggcgaacattcagctggtcttcaacaacgcgaaactggcggcgcagaccgctgtggcgtacagtgccctttcctaaagagaatctaaaaacagccgtttggaatgcgttccaaacggctgtttttgtgtgagaggaagttgttaaagagaaggatctgtttccttctgggattccgccacgcaaaaatcgaaaaaccgctccacgctgcccatggggtgaggggcgcttcggcggacgatgtagaagtcactctcctgcaccgggtgggtgagggggaggacctttacatccgggcggtggacaggcggggtgtccagcaggaccgtgatgccaaagccctgggccaccagctccaaaatgaagttggcgtcctccacctggtaggcgatgtgccaccggtcccggacgggagcaaagaggcggtctaccgggtcgcgctgcccgctgagccaggaataggtcacgtgggggtaggggagggtttcctctaaggtcacggtgtcctggcgggccaaagggtggtccagagggacggcggccaccatggcccggcgctggatggccgcgtagaccagctggggatcggggaggattttggagcagaagccgatgtccgccttgccctggatcaccgactggcagacctggctggacatgccggtggagaactcaaagtcgcagccggggttggcctgcttgaactggcggcacagacgggtcacggtggggatgatgagcagaggaatggtctgcaggcggagggtccccaccccctcccgcagcatctggaagtgccgcaggcagctgtcagccagggctacaatctgctgggcttgggagagcagggcggcgccgtaccggcccagggcaatcccccggccgcttttttgaaacagggagacccccaactcctgctccagggccgcgatggcgtggctgagaccggactgtgagatgttcagccgctgggcggcccggctgtaatgcatctcctgggagaggaccagaaagtagcgcaggtgatcgatgttcaaaaaacgcaccccctttccaattagtataccacaattcatgcgaaaaaggaatgagtctatggggttctgtgccttgattttccagcgggcggggggttcaatagaggagagaagagcaagtgcttcccggcggggcgctctgtgcggaagctccagggccgggggaggaggacgacatgaggcggtatcagacggaaggctcccgccggctgcatcagcagaccgtgccctacctgctggacggggtggggagttccttccacgtcagcagctaccgggactatccggtggctatgacccatgggaaagggtcgaagttatacgatgtggacggcaacgaatacattgactacgtgttgggctttgggcccatgctgctgggctattgcccgccggcggtggaccgggcggtagcggagcagctgcggcgggggagccatttctccgcccccacggaggacctgaaacggctgtctcaacggctggtggagatcattccctcggcggagctggtggcctatcagaactcgggaaccgaggtggtgatgtatgccctccggctggcccgggcctacacaggaaagtataagattgtgaagtttgaagggcagtaccatggctggtccgatgaggagaaggtcagcattgacgcctcctgcgtggaggagctgggggaccgggagaacccccgcaagatcctccataccaagggacagcggctgtcctccgcagaggacctgatcgtcctgccctggaacgacctgccggcgctggagcgcaccctggccgcccgaggaggggagatcgcggcggtgctcatggagccctgtatgtgtgattccggccccatcctgcccaaaccgggctatctggagggagtgcgggaggtgacccggaagtatggggtcctgctgatctttgacgaggtgatcaccggtttccgactggcattgggcggggcccaggcctactatggggtcacccctgatctgtccacctttgccaaggccatcgccagcggctacccctttggcgccgtggtgggccggcgggaggtcatggcctgcggggtccccgcctcggggaccttcaatgggaatcccatcggggtggctgcggcgctggccaccattgaaaccctgtcccagccgggggtgtatgcccatttggaggggctggcccagcagctggagacgggattccgggccttggcgcggaagtaccacaggcccctgtaccttcggcatgtgggcagcatttttatcctgtactttggctttgcagaggatgtggaagacttccgggactggctgacccaggcggacctggcgtcctacacccgctttgtggcggggtgcgaggagtatggcgtccggttcaccgaccgacggggcagggaatacctgtcagtggcccacacccaggaggatatccggcgtaccctggctgtggcggaccaggtgctgggggagatggaacgaggagagcgctgacccgccggggaaaccgggaagagatgggtttgaaaacgaaagagcttattgggaaggaaaggagcgtgcgtgccatgggcatgaaaatcagcattctgtatctgggaaagatggagtttcccaagtttcgcctggtggactggaaggatgagggggcgatggtgcaatccccggcggtcgccatcctgatccagcatcccaccctggggaatattctgtatgacacgggaaactgtgaggatttttcggcggtttacacagaggagatgctccatgattaccccattacggagatgatctccattcaggaggcgctggcccaaaaggggctgaccccggatgacatcgacttaatcatcctctcccaccttcacttcgaccacgccggcgggctgaagcactttgtggggaccaaggccatccggcgtgtgctggtctcagaggcggacctgaaaaacgcctactggagtgtgatgaccggcaacggcggggcgtacatccggtctctgttcgatgtggaggggattcagtttcaaaccattcgggagacgaccaagctggcggaggacttggaactcttcattcaggcttcccacaccccgggcgtcatcggtatggtgctgaaaaccgaccaccacggcaccatcctcaccaccagtgacaccatttataccgcagagagctatgaaaaagagctgccccccggcgggaccatcaacaagacaaccgatgagttttttgacaacctgaagcggatcaaggagatggagaaggcctaccacgccacccttctgtttgggcacgactacgaccagatcatggattgggtggccaaaggcgtgattgattgacgaagggggagcggggataccccctgcttcccggaagggagaagtgttatggcagtccataccaacgccaccgccggcgccgccctgggcaatgagctgcgggcgggcaccgttgcccaggtgggcagcaccaaacgaatccaggcactcaacggcatgctccatgccaaccggcccaatgtggacatcacccgggcccgggcctacacgaagatttacaaacagactgagggcatgcccagtctcatgcgccggtacaaggcctcggcggaggtctaccggaccctcagcgacaacgtctatgaccacgaacaactggtgggctggcccacccaaaagattcggggggccaatttcgccattgagctccacgcccactggctggcggaggacctgcccaacctgcgggagcggacctatgacccctttgacatcaccgacgaggactatcgggagttggaggaggaactgctcccctattggaaggataagaccatggcggtccagtggggccactatgtgagccagcgggagtggaaccggggacagtttggaggggtttccgatgtgtccaactacctctgcgccaacgggtcccatttcatcccggcctggaccgatgtaatccagcatggctttgtcaagtactatgaaaaggcccagcggctgctggaggcgctggaccccaatgacccggaatccattgacaagcggatcttttacactggaatcctggaggtgctggaggccatccgggactggggagagcggctgtccgcagcctgtgcccggcgggcccgggaggagaaggacccggtacggaagcaggagctggagaacatggccgccatgatgaagcgggtgccctgggggcccgccacctccttccatgacgcctgcgaaacggcgtgggcggtgtgctttttccttttcgtggagggggcggggccttccatcacctggggacgctttgaccagtatatgtatccttattataaggaggatattgagaaggggattttgaccccggagaaggccatggagctcattgaggaactgtatgtccgggtgacctccaacgtgtggttccagtccacccagatggcctatattttcggcggctattaccgctatccccacctggatgtgggcggcctggacgagaacgggagggacgcctccaacgaactgtcctatctctgcctgcgggccatgcgctatgccaagaccacttcgccggcggtgagcctgcttctgcaccagaaaaccccggattccctgctctatgaggcctgcgaattggccgcagaggggatggggcatccctccttcttcaactgcgaggggctctactccatgctggagcaccgggctggagggctggaggggtactcccattatacccgaaaagacatcctgaagttcggctctcccatcggctgtgtggagcccggtgcggaagggctccaatatggccacacggattcggggatcatcaatgtggccggggcggccctgatggcggtgaccaatggggtgatgccggaggaatcggacaacatgtttgccgggaaactgctgacctttgagagcggggcgccggggtccttccagacctttgaggcgttctatgacgcggtgaaggcgcagatcaagtacgccatcgacgaggcccatgccaaccttctcatctgtgaaaagctgctggccgaacagtttaacctgcctaccttcaccgttttgctggagggggcgctggagaaggggaaggacgccaccgcaggaggggccaaggtcaatgtggggcccaccatgaacatgtgtgggttcggcaccatggtggactcggtggccgcgatcaaaaaggtggtctttgaggaccgggcggccaccctggaggaggtctgcgcggcctgcatgcagaactttgtgggctatgaggacttgcggaccaagctccaggccgcgcccaaatacggcaacgacgacgactttgccgacgccattgccgccgacctgtggaagtggttctccacgtgtaccatgcggctgaagatgtaccgggggcattactgcgacgctgcggtgcagatggtccagtccaacgtgggctatggcgccatgaccggggccacccccaacggccgcctggcgggtatgcccctctcggacaccatgtccgccacccagcaggccgacacccacggccccaccgccgcggcccggagctatgggaagctggatttcccggcctataccaacggcaccttgctgaacatgtggatcagccagtctgagctgattgagcaatcgtaaaggaaaggagaatcgccatgacaaccatccgtgacatgccgctggactgcccggaagccacctatgtggagcctgtctacaaggaggctgggatgcggaattttaccaatctggtccgcaccatgctcaatgactacggggtgtaccatgtccagtttaacaccatcaacaagcagacgctgattgatgccaaggcccacccggagaattatcccacgctgatggtccgggtggctgggtacagtgtctattggacggacattgccgagcgggtccaggacgacatcatcaaccggacagagcacacattctaagcacctgagacctggggggaaggaggggggatctgtggaagaaaagaaggcgattgtttttgacatcggacggttccgaaacaccgacgggccggggattcgcaccattctctttttcaaggggtgccctctgcgatgtctctggtgcagcaacccctttggattctcgccggcgccccagttggcggtcaatccggtcaagtgcacaggatgcggcaagtgtgtgccggtctgtccccaggggagaaataccctggtgcccggggagaaaatccaggtggatttttccgcctgccaggggtgcggggcctgtgtaccggtgtgtcccagcggggcccggatgatcacagggcgggcctacacagcccgtgagctctatcgggaagcggccaaggatgcggcgttttaccggaagggcggcggtggggtgacgctctccgggggagaggtcttgctccagtgggaggtggcgtcggaaaccctgcggctgtgccggaccaattatatcaacacctgtatcgagacctcggcctttgccccttgggcccatttgtggcaggtggcccagtactgtcacacggtgtttgtggacctgaagcacatggacagcgaaaagcaccgggagcagaccggggtacccaacgagctgatcctggaaaatattcagaagctgtgccaggcgctgccccagcggggagggagggtcattgtgcgcctgcccctgatcccgggttgcaacgacggggcggaggacgtggcggcggcggcccggttcgtggggagcctgcccaaccgcccggagatgaatcttctgccctaccacaacttaggagagagcaagtacggtatgatcggagagacctgtgcgctctccggcctggagagcaggaaggggagggacccgaagctgctggcgcttcaagagctctgccagcggtgcgccccggacaatcgggtcagcctggggggagacgccatcgcgctggaatagtatgaaaactcagaagccccgccgcggctgcggcggggctttcgggtaggaagatggttggggttgtctaagatggaccttggggggcagatacgcaatggatcatggttctttggcattcatccacattaaaatttttttgcagtgcggacaatgccaagcgggagagtctaaaacagaggatgcaacgctgatggttttcttggtgaagaagcctttgattcctgttttctttttttcttcgtctgaggtaaattcataccagtgcccaccgccctgtccgatgccttcgacactgccgtgttccatttccgttccacagtccaaacatttcatgtcaggtgttcctttcacattttattcttccgctttttcattgagaagagaatgcacccgttcgacggggaagctgtcctctatgtctatcacatcaaataagtgtgagggcaattccgtgcagccgatcaggctgagatattcaccgacagcgcgccggtccacggcaatttttccatgtccggcccaatggcggttactttcccgcttttttaggccggaaatccaatacgcctctccgctttcaatatctctgtaattggaatatgtccctctgcatttttggaaagcgtggtcgttaaagtaaagtgtctttccgctctttgaagcctttacatacccgatccacgcagggccatcgtcggaataaccggtctttaactctatgtacattagatcgtgcgccattttgggctcctttcctttatggatcatccatttttgtctgtttcatgataccatagaaccgagagaatgaaaatgcccttttacagcgtgtggagcgggcctgttttgtacaaaatttttgcagaaagccgagaaaaaatgattgacagagggagagattcgtagtattatatatgagcgcctgaatgggcgcagtctgcgatgatgcgggagattgcggtgaaaaccggtaacttccgcggagtatgtccgtgaatcgggcggctggggaatctgctgcatggcgtatatcgccatgacaggagaggaaaaagccggcgaagtatgccggttttcttcatgcttatggagtgatacgcacggttaagtgtatcggattccccaccgtacggagcgtggcagagacaatgacacttcgtatgttttaggaggaaagcagcaacatggcacagaatgaaatgatccggattcgactgaaggcctatgaccatcagctgatcgaccagagcgcagagaagattgtggagaccgccaagagaaacggcgccaccgtttccggccccatccccctgcccaccaagaaggaggttgtcaccatccttcgcgcggtccacaagtataaggacagccgggagcagttcgagcgccgcacccataagcgcctgatcgacatcaacaatcccaaccccaagacggtggaagcgctgatgagtctggacctgcccgccggcgtggagatcgagattaagctgtgagaacagccggcaccctgcggacaggcagggtgagacagatcccaaaggaacgctggcatattgcatttgtgtacccgctgcctgtcgccttatcgtgagacaggcgggtcatgttgacaaaccaatgacagcccaatggtcatgtttgccaaccaataacctatttaaggaggaaaaccaacatggaaaaggccatcatcggcagaaagatcggcatgtcccagatctttgacgaagccggtaaggtcatcccggtcactgtgatcgaggcaggtccctgcgtcgtggtccagaagaagaccgaggagaaggacggctacaacgccgtacagctgggcttccaggacgttgcggaacggaagctcaccaagccggaacagggccacctgaagaaggcggaagttcccatgaagaaagtgctcaaggaattcaagctgaacaaagcagcagagatgaacgtgggcgacgagatcaaggcggatacctttgccaagggcgatcacattgacgtgaccggcatcagcaagggtaagggctaccagggcgtcatcaagcgctggaacgccggccgcggtcggatgacccacggcggcggcccggtgcaccgccatgcgggctccatgggctccggtaccgatccttcccggatctttaagggcaagatcggcgcaggccacatgggcgcggagcaggtcaccgtccagaatctggacgtggtgagcgtggaccccgagttcaacctgatcgctgtctgcggcgcggttcccggccccaagggcggcattgtctatctgaagtccaccgtgaagaccatccgcgagaagaagggcgaggccggcaccagcgtcaacccgcagaaggcttccgcacgtgccaacccccagaaggcatccgccagaaaccggtaaggaaaggagagtttgagaaatgcctaaagcaaatgtctataatatggctggccagcaggtcggcgaggtggaactctccgagggcgttttcggcgtagaacccaatgagcccgccgtccatgccgtcgtggtaaatcacctggcaaattgccgtcagggtacccagagcgccctgacccgcgccgaagtgtccggcggcggaagaaagccctggagacagaaaggaaccggccatgcccgtcagggcagcacccgtgccccccagtggacccacggcggcatcgtgttcgctcccaagcccagagattacagctatcgcgtcaaccgcaagctgaagagactggctctgaagtccgctctctctgccaaggccgccagcggtgacctgctggtggtggataacctggctctggacgccatcaagaccaagagcatccaggccttcctggacgctgtgagcgccggcaagaccattttcattacccccgaggtcaatgtgaatgtttacaagtccgcacggaacatccccggtgtctccaccaccaccgccaagattctcagcgtgtatgacattgtcaacgccgagaagctggtcatcgaccagaaggcgctggccatcatcgaggaggtgttcgcatgaagacagcatacgacatcatcagacgccctgtgatcaccgagcagtccatggctgataccgagaacaaaaagtacgtgttcgaggtggccaaggatgccaccaagatcgacatcgccaaggcggtggaagaggttttcggggtgaaggttgtcaaggtcaacaccctgcgcgtcaccggaaagctcaagcgcaccggccggtatcccgccggacgccagcccagctggaagaaggcagtggttaccctgtctgaggattccaagtccatcgagttcttcgaaggaatggcataaggaggttaatgcactatggctattaagagctacaagcccacaacgcctgcccgccggaatatgacggtctccgcgttcgagggcatcgataagaaggccaagccggagcgtagcctgactgaaactctgaagaagaacgcaggacgcaacagctacggcagaatcaccgtccgccaccgcggcggcggcaacaagcgcaagtatcgtatcatcgacttcaagcgcaacaagctggatatgaccgcgacggtgctccgtctggaatacgatcccaaccgcagcgccaacattgcccttgtccagtacgaggacggcgagaagagatacatcctggcccctgtcggcctgaaggctggcgatcaggtcctctcctccgccaatgccgacattaagcccggcaactgcctgcccctggcaaacatccccaccggcaccatcatccacaacattgagctctatcccggcaagggtggccagctggttcgttccgccggcacctctgcccagctcatggcaaaggagggggatgaggcgcagatccgtatgccctccggggaggttcgtatcgtgcgcctgaactgcaaggcctccattggccaggtgggcaacatcgaccacgagaacatctccatcggcaaggccggccggaagcgccacatgggctggagacccaccgtccgcggctccgtcatgaaccccaatgaccacccccacggcggtggtgagggtaagtcccctgtgggccgtcccggccccgttaccccctggggtaagccggccatgggctataagacgcgtaagaagaagaaccgcactgacaagttcattgtcaagcgccgcaacgcgaagtaaggaggaggcagtaaaactatgagcagaagcatcaagaaaggcccgttttgcgcccccgagcttcttaagcgggtcaaggaaatgaatgagtccggcgacaagaaggtgctcaagacctggagcagagcctccaccatcttccctgcgttcgtcggtcacaccatcgctgtgcacgatggccggaagcatgtgcctgtctatgtcaccgaggacatggtgggccacaagctgggtgagttcgcccccacccgcaccttccgcggccacgccggcagcaagactggtaagtaaggaggagagagaacaatggtagcaaaagcttacgcaaagtatctgcggatctctccccgtaaggtgaagatcgtcgcggacctgatccgcgggaagagcctggcccaggccaccggcattctgctgaccacccccaaggcggcttccgagccccttctgaagctcctgaagagcgcggcggccaacgcagagaacaaccacaagatggaccccgagaagctctatgtctccgaggtctttgcgacccccggccccatcatcaagcggatcatgccccgcgcccagggccgtgcctatcgcatcaataagagaacctctcacgtcaccctggctgtggcggagaaggaataagggaggaggcagaatatgggacagaaagtaaatccccacggcttgcgcgtgggtgtgattaaggactgggattcccgctggtatgcccgcaatgaaaaagtgggcgatctggtcgttgaagactacaagctgcggaagtacctgaaaaagaccctgtactccgccggtatccccaagattgagatcgagcgcgacaacgccaagatcaagatctatctgcactgcgcccgccccggcgtggtcatcggcaagggcggcgcggagattgagcgcctgcgcctggagctggaaaagaagctgggcaagcccgttgccctgaacatcgtggaggtcaagacccccgataccgacgcacagctggtggcagagaacattgcccagcagctggagaagcggatctccttccgccgcgccatgaagaactgcatgggccgcgccatgagaatgggcgcccgcggcatcaaggtgatgtgctccggccgtctgggcggggcggaaatcgcccgcagcgagtgctaccatgacggcaccatccccctgcagaccatccgcgccgatatcgactacggctttgccgaggctgccaccacctatggccgcattggcatcaaggtttggatctacaagggtgaggtcctcagccagaccctccgcaccaccccccgcaccctggacaccaagaactttaaggaacgccccgaccgtcctcgccgccgcgatggcagaggcggcttcaaccgcgaccgtaagcccggctatggcaaccgtccgcagggtggttataacaacaaccgtggtccccggcccgctgccggtggatctgctcccaaggaaggaggcaaagcctaatgctgctgcccaagagagtcaaataccgccgtgttcaccgtggccgcctgaagggcaaggccacccgcggcaacaccgtgacctacggtgagtttggtttgcaggccacggagccggcatggatcaccagcaaccagatcgaggccgcccgtgtggccatgacccgttacaccaagcgtggcggcaaggtctggatcaagatcttccccgacaagcccatcaccgagaagcccgcggagacccgcatgggttccggtaaaggttcccccgagtattgggtggccgtggtgaagcccggccgtgtgatgttcgagatcgccggtgtttccgaggaagtcgcccgcgaggcactgcgtctggccagccacaagctgcccatcaagacgaagattgtgaccaaagaagaaacggcccctgagagcgagaatggtggtgaagcatgatgaaggcaaacgaggtacgcaaactgtcttccgctgatctggaaaagaagctgaccgagctgaagaaagacctcttccagctccgtctccagcatgccaccaatcagctggaaaatcctgtccgcatcaatgaagtgaagcgcgacattgccagagtcaaaaccattatccgtgagcagcagctcgctggccagtaaggaggaactgaatcatgcctgaaaacagaacttcttcccgtaagaccagagtcggcctggtggtttcggataagatggataagaccgtggtggtggccattgccgaccgtgtggcacatcccctgtataagaagatcgtcaagagaacctacaaactcaaggcccatgacgagaacaacacctgcggcatcggggacagagtaaaggtcatggagacccgtcctctgtccaaggataagagatggcgcgtggttgagatcatcgaaaaggcgaagtaaggaggtgccgtaaatgatccagcaggaaacctatctgaaggtggcggacaacaccggcgccaaggaaattaaaaccatccgtgtcctgggcggctcttcccggaagtatgcgaacatcggcgatgtgattgtcgcctccgtccggaaggccgcgcccggcggcacggtgaagaagggcgatgtcgtccgcgccgtggtggtccgctccgccaagggtgtgcgccgggcagacggcagctatgtccgtttcgacgagaacgcggccgttctgatcaaggacgacaaaaaccccagaggcacccgtatctttggcccggtcgcccgtgagctgcgtgacaaggactacatgaagatcctgtccctggctcccgaagtactgtaagggaggggactaagatgatgaataagatgagcattaagaaggacgacaccgtggtcgtcatcaccggaaaggacaaaggccagcggggcaaggtcctgaccgtgatccccaaggaaggcaaagtggtggtggagaagatcaacctggtctcccgccacaccaagccccgcaagcagggcgacgagggcggcatcatccagaaggaagcccccctgtatgcctgcaaggtgatgcgtgtctgccccaagtgcgacaagcccacccgcgccgccagcaagatggtggacggcaagaaggtccgtgtctgcaagcactgcggcgctgaaatctgagagaggaggagtcaatgatgtctgaaatgcccaatctgaaagcaaagtacagagaagaagttgctcctgccctcatgcagaagttcaactataagagcaccatgcagatcccccgcattgagaagatcgttgtgaacgtgggctgcggggaagcccgggacaacgccaaggtgctggacgctgtggtccgtgacctgggtgtcatcaccggccagaaggccattgtcaccaaggccaagaagtccgtggcaaactttaaggttcgtgagggaatgcccatcggcgccaaggtcaccctgcgccaggacaagatgtgggagttcctggaccgcctgttcaatgtggccctgccccgtgtccgtgacttccgcggcatcagccccaactccttcgacggccgcggcaactatgccctgggcgtgaaggaacagctgatcttcccggaaatcgagtatgataagatcgacaagatccgtggtatggatatcgtcatctgcaccaccgcggagaccgacgaagaggcaagagagctgctgaccctgatcggcgctcccttcggcaagtaattaggaggagaacgatcaatggctaaattatccatgaagctcaagcagcaggctgagcctaagttttccacccgccgctacaaccggtgcaagatctgcggccgtccccacgcgtatctgcgtgactacggtatctgccgtatctgcttccgtgaactggcccacaagggccagatccccggcgtacggaaggcttcctggtaatcagtatggtatcgcctgaccggatgcacccaaccatccggtcggcgttcccataaagttttctccgtacctacggagaatggtccccggccggcggcaataggtcggttcctctgagacccgataccttgccgctgatacaggcgctgcctgtaatcttataggaggtattaccctatgcacattacagatcccattgcggatatgctgactcgtatccgtaacgcgaacaacgccaagcatgacaccgtcgacatccccgcgtccaacatgaagaaggccattgcccagattctgctggacgaaggctacatcaaggcctttcagctggtggaggacggcgcccagggcgtgatccatgttaccctgaagtacaacaaccccggcaaggaaaaagtcatttccggcctgcgccgcgtctccaagcccggcctgcgtgtttatgccggtgctgacgagctgccccgtgtcctgcgtggcctgggtgttgcgatcgtgtccacttccaagggcgtcatgaccgacaaggcggcccgcgcggcccatgtcggcggcgaagtcctggcatttgtgtggtaaggaggagaggttactatgtctagaatcggtagaatgcccatctctctccccagcaatgtggaagtgactgtgggcgaaggcaatctggtcaccgtcaaggggcccaagggcaccctgacccagaagctcagcgagaagatgaccctgacccgcgaggacaacgtcatccatgtgacccgccccaatgatgagaaagagaaccgcgctctgcacggcctgacccgtaccctgctcaacaacatggtggtgggtgtcaccgagggctataagaaggagctggacgtcaacggcgtcggctaccgtgtggccaaggagggcaagaagctgaacatgaacattggcttctcccacccggtgatcgtggaagagatcgacggcatcaccatcgacgttcccagccccaacaagatcgtcatcagcggcaccgacaagcagaaggtcggtcagttcgctgctgaggtcagagggaagagacccccggaaccctacaagggcaagggaatcaaatataccgacgaggtcatccgccgcaaggaaggcaagaccggcgtgaagaagtaagaaagaggtgtgcctaaatgattaagagacccgatactaacgctcagcgtcagaagcgtcacacgcgcgttcgcggtaaagtctccggcacatccgagagaccccgtctgaacgtgttccgcagcggaaccaacatctatgcgcagatcattgacgatgtgaagggctgcaccctggtttccgcttcctccctggagaagggatttgagggccgcggcaacaactgtgaggccgcagccaaggttggcgaggccattgcccagcgcgccaaggacaagggaatcgacacagtggtctttgaccgcggtggttacctgtaccatggacgtgtgaaggctctggcagagggcgcccgcaaggctggcctggaattttaaagggaggaggaaacgaaaatgcctagatttgaaagagaacccagcgagtttgttgaaaaagtcgtttccctgaaccgtgtctccaagaccgtcaagggcggccgtgtgatgaagttctccgctctggtcgtcgtgggcgacgagaagggcaaggtcggtttcggcctgggtaaggctgccgaggtccccgaagccatccgcaagggcctggaagccgccaagaagaacatgttcaccatcactctctccggcaccaccattccccatgaagtggtcggtgaattcggcgctggccgcgtgctgatgaagcccgctgcccccggtaccggcgtcattgccggcggtccggtccgtgctgtgctggaagctgccggaatcaaagatattcgtaccaagtgcctgcgctccaacaacccccagaacgtggtttccgccaccatggagggtctgaagtccctgcgtggtcctgaggctgtggcccggatccggggtaagagcgtggaagagatcgtgggctaaggagggctttgaaccatggcgaatctgaacattaagctcgtcaagagcctcagcggccggattgcaaagcataaggccaccgcagaagccctcggcctgcgtaaaatcggcgataccactgtgcagcctgacaatgctgccacccggggcaagatcgcccacatcggttacctgatccaggtcaccgaggaacagtaaggaggtgcgcaacatgaaactgcatgaactttctcccgtgcccggttccaaccccaaggcctatcgcaagggccgcggcaacggttccggcaacggcaagacggccggccgcggacagaagggccagtgggcccgttccggcggcggtgtccgtgtgggctttgaaggcggccagatgcctctggcccgtcggatccccaagagaggctttcacaacatctttgcaaagcccctggaagctgtgaacgtttccgccctggaaaagttcgaggatggtgctgtggtcagcgcctgcgacctgctggaaaagggtatcctgtccaagtgtgagcacggcgtgaagatcctcggcgaaggcagcctcaccaagaagctgaccgttcgggccagtgctttctccgcctccgcgaaggcaaaaattgaagaggcaggcgggaaggctgaggtggtctaatgtttaagaccatccgtaacgcatggaagctgccggagctgcgccgcaagctcctgtttgtgatctttgcattactgatcttccgcgttggcgcggcgatcccggtgccctatatcaacaccgagtatctccaagattatattgcggcaaattctgggacgattttcggcctgctcaatacattgagtggttcggccctgtcccaggccacgttgtttgccctgtccatccagccctatattaacgcctccatcatcattcagctgctgaccattgccatcccggcgctggagcggctggccaaagacggcggtgaggagggcaagaagaagatccagtccattacccgttatgccaccttggccatcggcctgctccagggctggggatactataccctgatccggagctatggtctgctgaccaacgaaggtgtttgggcggctgtggtgatcgtggtctccttcacggctggcgcagttttcctgatgtggctgggcgaacagatcacagagttcggcgtgggcaacggtatttcgatcatcctgtttaccggtatcgtctcccgtatcccccacatgatcatgtctctggtgaccggcgtgaagaactgggctgccaaccttgacatgaccaactggacggagcagcagatcaacagcaccatcgtgatgaaccctgggattgttgccctcctggtggtgggcatgctgctgctgattattttcatcgtctttatcaccaattctgagcggaaagtgcctgtccagtatgccaagcgtgtggttggccggaaaatgtacggtggtcagtccacccacattcccatcaaggtcaatctcagcggcgtgctgcccatcattttcgcccagtccattgccatgatccccgctaccatcggcatgtttgttccctcctcccagcaggaggggtcggcgtggcataccttcctttcggtgttcaactccaccagtgccctgtacgcggtgatctacttcctgctgatcatcatgttcagctacttctatgctaccatccagtttaatcctgtggaggtagccaataacctgaagaagaatggcggattcattcccggcttccggcccggccgtcccacggcggagttcttggccaaggtactctcccgtctgaccttcttcggcgccatttacctgggtatcgtagccatcctgcccattattaccgagaacatcactggcatccagaacatgtccatcggcggtacctccgtcatcatcgtggtcggcgttgccctggagacagtcaagatgctggaagcgcagatgctcatgcggcactataagggcttcctggaatgagaggtaatataagatgaaactgattcttttgggccctccgggcgccggcaaaggcacccaggctgagattctgaataagaagctcaacattcccaccatctccaccggcaacattctccgagctgcggtgaaaaacgggactcccgttggcctgcaggccaaggcgtatatggatgccggcaagctggtgcccgatgaagttatcatcggggtgatctccgaacgcctggcggaagcggactgccagaacggctttatcctggacggggtgccccgcaccattccccaggccgaggccctggaaaaggtgggcatcacctttgacgccgtggtctccctggaaatttccgatgaggagattgtggagcgtatgggcggccgtcgggtctgcgcctcctgcggcgcgcccttccatgtgaagaacctgccccccaaggtggagggtgtgtgcgacgcgtgcggcggcaagctggaagcccgggcggacgataagcctgaggtggtccgtgacagactgaaggtctatcacaaggagaccgcgcctctgaaggatttctacgcagcgcgaaacctgctgaaaaccgtagagaatcagcccactgtggctgagacgacaactgcgattctgaaagcactggggctttgagtatgatttcattaaagtctcccagagatattgaggggatgcgccgagcaggacaaattaccgcggcggcccgtgctttggcgggcaaaatggtacgtcctggcgtaaccactctggaaatagatactgcagttcgtaaattcatcgaaagccagggggcaaccccctccttcctggggtatggcggcttccccgcctccgcctgtatttcggtgaacgatgaagtcatccatgggattccgagcaatcaggttctcaaggaaggcgacatcgtcagtgtggatgtgggcgcctacatcggaggcttccacggggactgcgcgggcacctatccctgcggaaagatcagcgacgaggcggcaaggctcattgccgtgacggagcagtctttctgggaggggatgaagttcgcccgttttggttaccgtgtctccgacatctcccatgcggtgcagaagtacgtggaagaaaacggcttctctgtggtacgggactatgttggccatggcgtaggcgccaatctgcacgagtctcccgaggtgcccaactatgggaaacccggccacggcccccggcttgctcccgggatgaccctggcggtggaacccatggtgaaccagggggactggcgggtcaaggtgatgaaggacggctggacggtacggacagccgacggctccctggccgcccactatgagaactcaatcctcattacgaagggtgagcctgaaatcctcacccaagtgggggatctgcgcctatgacgtttctgcgaggagacgtggtacggtccgttgccggccatgacagaggagacctctttctggtcctccgggaggagggcgactttctctggctggtggacggaaaatgcagaaaacttgagactcccaaaaaaaaacggcgaaagcacgttgtttccgcgggggtctggacgcacccggttgccggccgcttgcaagacggcgagccggtgctggacagtgacatcaggagggcgctggccgccttccggaataggttcagtgagatgaaggaggtatgacgcttggcaaaaagcgacatgatcgagctggagggaaccgtggttgaggcgctgcccaacaccacattccgggttgacatcggaaacgaccatatcattctggctcatatttccggaaagctcaggatgaatttcatccgtattctgccgggtgacaaggtaacggtccagatttccccgtatgatctgacacggggtcggatcacctggcgaagcaaatccaccaagtaaagcaacaggcttacaggaggtaaaaagttatgaaagtaagaccgtccgtcaagcccatgtgcgaaaagtgcaagatcatcaagcgcaagggcaaagtcatggtcatttgcgaaaaccccaagcataaacagagacaaggttaagaaggaggcgctgaagaagtatggcaagaatttccggcgttgacctgccgaagaataagagaatcgagatcgccctcacctatatttacgggatcggtcgcaccagcgccaacaagatcctggcggagacgggcattaaccccgatacccgggtcaaggacctcaccgagcaggatgaagctgctctgcgtgatgtcatcggccatggctacatggtcgaaggcgacctgcgccgcaatgtggcaatggacattaagcgcctgaccgagattggctgctacagaggcctgcgtcaccgcaagggcctgcccgtccgcggccagcggtccaagaccaacgcgcgcacccgcaagggtcccaagcgcaccgttgccaataagaagaagtaagggagggaagaatcgctatggctaaccccaagaagaaggttgtcagaagacgccgtgaacgcaagaacattgagaagggcgccgtccatatccgctcttccttcaacaacaccatggtcactgtgaccgataccaacggcaatgccctgtcttgggcttccgccggtggcctgggcttccgcggctccagaaagtccaccccctatgcagcccagactgcggccgagaccgcagccaaggcggccattgaggcctgtggtctgaagagcgtggaagtgtatgtgaagggacccggttccggccgtgaggccgccatccgcgccctgcaggccgtgggtctggaagtcaccatgatcaaggacgtgactcccattcctcacaacggatgccgtccccccaagagacgccgcgtctgatcgaaggaaaggagaaaagcaactatggcaaagaatacacagccgatcgccaagcgctgcaaggcgctgggtatttctcctaccgttatgggttacagcaagaaggagaccaaccgtaaccccggcggtcagatgagaaagaaaaagagcgagtatgccctgcagctgacggagaagcagaaggtcaagtttgtctatggcatcctggagaagcagttccgctcctactatgagaaggcaacccgaatgtccggcaagaccggcgagaacctgctgatcctggtggagcgccgcctggacaatgtggtctatcgcctgggcttcgccatgacccgccgggaagcccgccagctggtgaaccatggccactttaccgtcaacggccagagagtggacattccctcctatctggtgaagcccggtgatgtggtggaggttgcggagaagagccgctcctccgtgaagtttaagagactgaccggtgaggatgccgtgatggtcaccccgccccagtggctggagcgggaaaagaacgccctgaagggcacggtgaccaagctgcccgcccgtgaagacatcgacatgcccattgaggaacacctcatcgtcgagttgtactccaaataatacgctaccctcggcaggaaaacggaatgacgatacggcaggccgccggtctgccgacgtaagaaggagggtaacaaatggtagaaatcgaaaagccgcgcatcgaatgcatcgagaagccgggagacaactcctatggcaagtgcattgtcgaaccgttggagcgcggctatggcaccacgttaggcaactctcttcgccggattctgctgtcctctttgcccggcactgcagtcaccagcatcaagattgcaggggtgcagcatgagttcagctcgatccccggtgtgaaagaggacgtaacagaaatcgtcctgaacgtaaaggggatcattgccaagctgtacagcgagggtaccaaaacagtgtacattgaggcctccggcgagggggttgtcactgccggtgatatcaaagctgacagcgaggtggagatccttaaccccgagcatcccatcgcaacgctggggcctgaggcggttctgaatatggaactgaccttgtcccacggcagaggttatgtccccgcagaccggaacaagaccccccagacggtgatcggggtgatccccgtggactcggtctatacccctgtcaaaaaggtcaattatacggtggaaaacacccgcgtaaaggatttgaccgactttgacaagctgaccctggaggtttggaccaacgggaccattgccgcccgggacgccgtttccctgggggcccggattctctgcgaccactttatgctctttacagatctcagcgagaccatgggcaacaagtccacggtggtggaaaagtctcccgacatccgtgacaaggtgctggagatgaccattgaggagctggatctgtctgtcagaagcttcaactgcctcaaacgtgccaacatcaacactgtggaggacctgatctccaagacagaggatgagatgatgaaggtacggaacctgggccggaagtctctggaagaagttatcaacaaactggccatgatggggctttccctggccagcgacgacaattgacccaaggttcggcactgctgaaccatcaataccgaagggagttgaaccaacatgtccggtaatcgtaagcttggcaagcggaccgatcagcggaaggccatgctccgcgctatggtgacctatctgctggagaacggtcagattaagaccaccctggcacgtgccaaggaagtggccccgctgacagagaagatgatcacgctgtccaagaagaatgatctggccgcttaccgtcaggctctggcgttcatcaccaaggaggacgtggcacacaagctgttcaccgagatgaaccagaaatacatgagccgtgacggcggctatacccggatcgtgcgcatgggcccccgcaagggcgatgcggccgagatggctattatccagctggtttaagaaaaagagaaagagacccgttgccgaggctgtggcagcgggtctttttgctataccaaagcataacaaaatggccatgtgccccctgacagcggcgcggccagaaaattacagcgcgtgggccggggcgcttagagttgcaccggggggaaaactatgctaaaatccccatagaagaaaaacaggaaaggaagggcgagacagatatgaaggtactgtttgtcaactgctgtatccggggggaggcgtcccggaccctccggctgtgccgggttgccatcgaggcgattcacaccaccttccccaccgcggaggtggaggagctctgcctggaccaggaggcgctgctgcccctgcacagtgatacgctggcccagcgccatgcgctggaggtggcccaggcgtttgaccatcccatgttccgttatgcccggcagtttgccgccgccgatgtgatcctggtgggggcgccttattgggagtaccagttcccggcgctgctgcggtgttatgtggagcatatctccgttagtgggttgacctttgcctatggagaagacggacgcccccatggtctgtgtaaaggggatcgtctgttttatctgaccacagccggcggacccattctggaccggaactgtggctttgactatctgaagacactgttgggcaatatgatggacttcaaaaaaatggactatgtggccgctgagtgcaccgacgtgatcggctatcccgtggaagaagagctgcaaaaagcggaggaacaggtgcgggcccagattcaaagctggcggtaacctgcgcatgcgggagaggaggttacgcggtgggagagtggaagcatatcattaccatcggccgggaatacggggccgggggcagaagtgtggccaaaagaatttccgatctgctggggattccccactatgacaaggaaatcattcagctggcagcggaaaagacaggcctttcggaggagatgatccgggggaccgaggagcatgagagcggaaaaaccctcctcaactggtttctccccagcggctctgcctccgcctatgaccaggcaattttggcccaggcccaaaccattcgcaagatcgcggagcaggggccctgcgtcattgtagggcggggggcggactatatcctccgggattttccccacctggtcaatgtcttcctgtatgcggaaaagaaggacaaggtccgctatgccatggagacctacggggaaagctatgagcaggcggtccgccgggtgcgccacgccgacgcggcccgggagtcctattaccattacctgacaaaggccaaatggggcgacttgaaaaattaccacctgaccttgaacagcagcccagtgggcaagcaggcctgtgcggagatcattctccagtatgccagcaggaaaaacggatgagggaagcgaaaaatacggcggcggcacccgatcaggtgccgccgccgtgttttctgacaaagaaaggtgtcccacaaaaaagaccgaagaaaggattgactttccccggcataagtggtagaataccttgatattatctgcggagaaggaaggaatttcctcccactctggggacagtatagcagaaatcaacgaaaaagacaacaggttgagaaaagttttttccacgcccccgcgtgatcgcaagaaatcaggatacgacaccttttcaacgaaaggactggtcaagagcaatggtaaaggatgtatactacggaaaaaccctgcgcaagagctttgcccgccatgaagaagtgctggacatgccgaatcttctggaaatccagaagaagtcctaccagtggtttttggacactggtctccaggaagtgttccgggatgtggccgccattggtgactacgctggaaatttggagctctccttcatcgacttcaccatggatgaaaagcccaagtactctgtggaggagtgcaaggcccgggacgccacctatgccgcgcccctgaaggtgcgggtgcgcctgcgcaacaaggagaccgaggagatcaaggagcaggagatcttcatgggggattttcccctgatgaccaaggggggcacctttgtcatcaatggggcggagcgcgtcatcgtctcccagatcgtccgttcccccggcgtctactatgcccgcaatgccgacaaggcagacaacatcacctatgccgtaacggtcatcccttaccggggcgcctggctggagtatgagaccgatctgtctgacattttcaacgtccgcatcgacaaaaaccggaagctgcctgtcacctgcctgatccgggcggtgggtccccagaccgacagtgaaatcctggagctgtttggagaggagcccctgctggtgagcaccctggagaaggacacctgcaagacccgggaagaggccatgctggagatctaccggaagctccggcccggagaaccccccactttggactcagcggagtccctcatcaacagccttttctttgacgcccgccgttatgacctgtccgcagtgggacggtataaattcaacaaaaagctctccctgtggccccggctttccggccagaagctggccgcgccggtggcggacccccgcaccggtgagatcattgccgaggcgggccagaccctgacccgggcccaggcccaggaactggagaaccgaggggtgtctgaggccatcgtggatgtggacgggcagagcgtcaaggttttctccaaccgcatggtggacatggcccaatttgtctccttcgaccctgaggcgtgcggcattaccgaaaaggttcgcttcgaggtcctgtgcgagctgctggaccagttcggccaggacgaggccgccctgaaggaggctgtggccgagcgcaaggacgacctggtgcccaagcacatcattgtggatgacatgatggcctccatcaactacctgtgctccctctcccacggcgtgggcaccccggacgacattgaccacctgggcaaccgccgcctgcgctgcgtgggcgaactgctccagaaccagttccgcatcggttttagccggatggaacgggtgattcgggagagaatgaccattcaggacctggacattgtcaccccccagtccctcattaacatccgtccggtgacggctgccattaaggagttctttggctcctccccgctgtcccagttcatggaccagaccaaccccctggcagagctgacccacaagcggcgtatgtccgccctgggccccggcggtctgtcccgggaccgggcctcctttgatgtccgagacgtccattacagccactatggccggatgtgccccattgagaccccggaaggtcccaacatcggtctgatctcctacctggccacctacgcccgcatcaatcgctacggcttcattgaggccccttaccgcaaggtggataagcagacagggttcctcaccaatgaggtggagtacatgacggcggatattgaggacgagttcatggtgggccaggccacggagcctgtggatgagaacggctgcctggccaatcagcggattacctgccgccaccgcaacgagatcgtggaagtggaccgggaaaaggtggactacatcgacgtgtcgcccaagatgatggtctccatcgccacggccatgattcccttcctggaaaacgacgacgccaaccgggccctgatgggcgccaacatgcagcggcaggctgtgccgctgctcaccacccaggcccccattgtggccacagggatggagcataaaaactgtatcgactctgaaattgccgttctggccgagggggatggggaagtgacccgggtctccgccaccaatgtcacggttcggtatgacggaggggatgtggtggactatccccttattaagttcctccgttccaaccacggcacctgcatcaaccagcggcccattgtgtccctccgggaccgggtgaaaaagggggatgtcatcgcggacggcccctccaccaaccagggggagatctccctgggcaagaacatcctcatgggctttatgacctgggagggctacaactacgaggacgccatcctgctcaatgagagaatggtcaaggacgatgtctttacctccattcacattgaggagtatgagaccgaggcccgggacaccaagctggggccggaagagattacccgtgacatccccaacgtgggcgacgacgccctgaaagacctggatgagcggggcattatccgggtgggcgcggaggtccacgcgggggacatcctggtgggcaaggtgacccccaagggggagaccgacctcaccgcagaggagcgcctgctccgggccatctttggcgaaaaggccagagaggtccgggacacctccctgaaagtgccccacggtgagagcggcatcatcgtggacgtgaaggtctttacccgggagggcggcgacgagctgggccccggcgtgaacatggtggtgcgggtttacatcgcccagaagcggaaaatttccgtgggcgacaagatggccggccgccacggcaacaagggcgtggtctcccggatcatgccccaggaggatatgcccttcctccccgatggaacccccttggacatcgtgctcaatcccctgggcgtgccctcccgtatgaacattggacaggtgctggaggttcacctgggccgggccgcccaggcgctgggctggaaggtggccacaccggtcttcaacggcgcggatgagaaggacattatggaactgctggcccaggcgggcctgttccgggaggtctatcccaatgagaccatcgccggaaagcagctctacctggtcacagaggacggaaccgatgtgcgccgcctggatcaggaggagatggccgatgcacagcagatccgcatttggcggaaggaaggccggctccgcctggccgacggcaagaccaagctctatgacggacgcaccggggagatgtttgagaacccggtgaccgtgggctacgtttacttcctcaagctccaccatctggtggacgacaagatccacgcccgctccaccggcccctactccctggtgacccagcagcctttgggcggcaaagcccagttcggcggccagcggttcggcgaaatggaagtctgggccctggaggcatacggcgcggcctataccctgcaagagattctcaccgtcaagtccgacgatgtcaccggccgtgtgcggacctacgaggccattgtcaagggacacaacgtgccctctcccggcattcccgagtccttcaaggttctggtcaaggagctccaggccctctgcctggacatcaaggtgctcgatgcccagggagaggagatcgagctgcgggacgatgaggaagaaggctatcagaatatcaaccagattcgggatgatgattatgagccttaccgggaggacgcggacgcgcagttctccgcagcgggctataccatcaaggaatccagtgacgacgatgacctcaccgtgggcgacgacagtgatagtgacaccgctgaagatgactacggcgatggggattatgaagaataacgaaagggaggacgatgaatatgagttatgctgagtttgacgccattcgtattggtatcgcttccccggaacagatccgtgactggtcctatggcgaggtgaaaaagccggagaccatcaattaccgcaccctgaagcccgagcgggacggcctgttctgtgaacggatctttggccccaccaaggactgggagtgccactgcggcaagtataagaagatccgctataagggtaaaatctgtgaccgctgcggcgtggaggtcacccgggccaacgtccgccgggagcggatgggccacattgaactggccgcgccagtctctcacatctggtatttcaaggggattccctcccggatgggcctgcttctggacctgtccccccggattctggaaaaggtgctctactttgcctcgtatattgtgacggaccccggctatgcgccgctgaccaagaatcaaattctctcggagaaagagtaccgggaactgcgggagaagtatgaggacgacttcgacgccggaatgggtgccgaggcggtgaaaaagctgctggcggacatcaacctggaggaactgtctgttcagctccgggaggagctccagcacgcttcgggacagaaaaaggcccgaattgtcaagcggctggaggtagtggacgccttccggctgtccggcaacaagccggagtggatgatcattgacgtgctgccggtgattccgccggagatccgtcccatggtccagctggacggcggccggtttgccacctccgacttaaacgacctgtaccgccgggtaatcaaccggaacaaccggctcaagcggctgatccagctcaacgcgccggacatcattgtacgcaacgagaagcggatgctgcaggaggccgtggatgccctcatcgacaacggccgccggggccgtgcggtcaccggcgccaacaaccgggccctgaagtccctgtccgacatgctcaagggcaagcagggccggttccggcagaacctgctgggcaagcgggtggactactccggccgttccgttatcgtggtgggtcctgaactgaaaatttaccagtgcggcctgcccaaggagatggccattgagctcttccgcccctttgtcatgaagaagctggtggaggatggcctggccaacaacatcaagtccgccaaaaagatggtggaccggggccgcgccgaggtctgggacgcgctggacttcatcatcaaggagcatcctgtcatgctcaaccgtgcccccacccttcaccgcctgggaatccaggcctttgagccggtgctggtggaaggccgggccatcaagctgcaccccctggtgtgtactgcgtttaacgccgactttgacggggaccagatggcagtacacgtgcctctgtccgccgaggcccaggcggaggcgcgtatcctgatgctttcggccaacaacctgctgcggccccaggacggcggaccggttacggtccccacccaggacatggtgctgggctcctactacctcacctatgagaaggatgcccccgccgaccccgcctatatctatgcctgtgcggaggatgccgccgccgcgttggaggcgggaaccctgtgtgagagcgaccacatttgggtggagaccccggaacggctcctgcccacctcggcctatgaggcccgccgggtctccggcacgggtgagctccccaaggaagtgctccacgcctttgccagcccggaggaagcccgtctggcctatgacgagggacagctggagcttcacgtgcccatcctggtgcggatgaccgccacggtggacggggaaacgcgccacaagctggtccgcaccaccgtgggccgcctgattttcaacgagggcattccccaggacctgggctttgtggaccgagatgaccccgacggctgctttgagccggagatcaacttcgtctgcggcaaaaagcaactgggcaaaatcattgacaagtgtatcctccgccatggctttacccagtcggcggaagtgctggatatcatcaaggcccgcgggtaccactactccaccttgggctcgctgacggtctccatttacgatatgaccgttccccagaagaagtaccccctgatccgccagacggagcaggagattgtgaagattgaaagccagtttaagcggggcttcctcaccgacgacgagcggtaccgcctggtggtcaaggcttgggagcagaccaccaaggatgtgaccgaggccctgcaggcgggactggaccggtacaaccccatctttatgatggcggactccggcgcccgtggctccatggcgcagatccgtcagctggccggcatgcgcggcctgatggcggatacctccggccggaccattgagatccccatcaaggccaacttccgggaaggcctgtcggtgctggagtactttatctcctccagaggcgcccggaagggcttggcggataccgccctgcggacggcggactcgggctacctgacccgccgtctggtggacgtgtcccaggaggtcatcatccgggagcacgactgcggcaccaccgagggcatcacggtccgggagatcagcgagaacgggcaggtcattgagacctttgccgagcgcctgaaaggccgctaccccgtgcatgatgtggtggacccccagactggagagctcctgttctccaaggatcacatgctcaccggcgaggacgccagcctcctggaggcgcggggcattgagagcctggagattcgctcggtcctcacctgccgggcccggaacggcgtgtgctcccggtgctacggcgtgaacctggccattggcgagcctgtgggcgagggcgaggccgttggaatcatcgcggctcagtccatcggggagccgggcacccagctgaccatgcggaccttccacaccggcggcgtggccgggggcgacatcacccaaggtctgccccgtgttgaggagcttttcgaggcccgcaagcccaaaaagatggcccagctggcggagatcagcggccgggtcaccttggaggagagcaaacgcatcaccatttgcaacgtcaccatcaccgccgacgacggcgaggtggtcagctatgccctgccgtacagcgccggcatccgctgcaaggacggcgactgggtccagaagggggatcagctcaccgagggtgcgctgtctccccatgaggtcctgcggattcgcggggtctctgcggtccacgactacctgattcaggaagtccagaagccttaccgccagcagggcgttgacatcaacgacaagcacattgagattatcgttcgccagatgatgcggaaggtccgggtggaagagccgggagactcccagctcctctccggcgccactgtggagctcatggagtatctggacgccaaggcagaggtccaggcccggatggatgcgggcgagacccatgaggacggcagtgagctggtccttcccacggctaccaccctcctgatgggcattaccaaggcctctctggccaccgattccttcctatccgcggcctccttccaggagaccaccaaggtcctcaccgaggccgccatcaaggggaaggtggaccatctcatcggcctgaaggagaacgtcatcatcggcaagctcatcccagccggttccggtctgtcgatgtaccgccaggtgaatccccgggaggaggaggcgccccggaccggttatgccgccgtggctgccgcggtgcaggacacacgagaggacggagcggtcgagctgcccgaggacgaggcagcctccctggcggccgccatggaggaagacgagatcgtctccatgtccctggaagaagtataacggagggaatttccctctcttgcgaaaacggtcgcggaaactccgcggccgttttttgtcggggaaggcaggtggggagaatttttcaaatggactactatttccggggggaatctgctataatacccataaagaatggaagaaaagagggaggggtctcatggaggaactaaaggtactccaatccaaactcaaagcacagctgccggacctggagctgcgggaacaagagccgatgcggctgcataccacctttcgggtgggcggtcccgcgtcgctgatggccctgccccggcgcgaggccgacctgggacagctcctgcgtatggcgttccaggctggggtcacccccttctttctggggaagggctccaaccttttggtggcggatgagggggtggaccgctttctcatcaaactggcggggggcctcaaccggctggagcgggcggaggggaccgcgatctatgtgggcagcggggttaccctggcccaggcggcggtgtttgccgcccatcacggcctgacggggctggagtttgcccatgggattcccgggaccatgggcggcggtgtctttatgaacgccggtgcctacgagggggagatgtcccaagtcgttgattgggtggactgcctggacgaggagggtatgccccgccgcctgtccagggaggcgttggcactgggttaccgcagcagcatttttctccggcggccctggctgattaccggggcgcacctgacgctggcgccgggagaccctgcggccatccgggagaaaatggccgacctgtcccgccgccgccgggccaagcagcccctggagtatcccagcgcgggaagcacctttaagcgcccggccgggcattttgccgggggtttaattgagcagtgcggtctgaaagggacaacggtgggcggcgcccaggtgtcggaaaagcacgcgggttttgtgattaacaccggccaggccacctgtcaggatattttgacgctgatccgtctggtccgggaccgggtgtttcagcagaccggcgtgcgcttagagccggaagtccggctgttgggctgtaccctggaggaaccataacgcaaaggagaagcaacgatgggagatcatttttttttgctgatgtatgccaccagcggggaggagcggaatgtcacccgcttcaccagctatcgccgtgtggaggatgcagtggccatggtgaaggaatggctggagaaagcctgctgcatggactgttacccggcggcggaggaggcggccctgcgggaggccaacggcggccaactgccggagacggctttcctgtgcccggaggtccgagagccggcggacctggccaagtacaatggtttctatgactatgagagtttggggatgtttaacctcttcctgacgccggtctacgacacggagagcgccaggcaattccgggccagcatgaacaaagagtttggcatcgaccaggagtacagcggccgggcagaccgcctgctggcccatctggagacctttgtgaactctttttccgaccccggtttggactatacggaggcggaggaggccattcgaaccttcctggtccagggcgggttccctctgtttgacccggaggaggagggcgcctcggatatcttcgtcattccggaggggggctttgcccccaatgaggacccgacggtataagcgggaaatgggtcctggaaaaaacgaccacaaagcaaggcccccgggaggcgtcttcttttgaagacgcctcccgggggccttttcagcgggaaaaggggcctggtcaggtcatctcgtctcggagggcatccaggatgttctcctgtttgagctggcgggcggcataccacgtggtaaggaaaaccagggcaaacacgccgactgcgctgaggaggagactggcccaggggaagagaaaggggaagtgctccaactgctcgctggatgccagaccccgttggatgagccaggcgaagagtgtggccagcgggagaccgaacagcagggtccgtcccccgtagaagaggcactcaaaccgcagcatgcggtggaattctccctccgccatgcccaccgagcggagcatggccagctcccgccgccgcagcttaatattggtggaaatggtgttgaacacattggctgcggcgatcaggaagaggagcagaacaaagacataggtgaacacgtccaccacgaaggtggcgtcctggaactgggccgccgcctcatacaggttgtacatggtatactggccggcaaagcccgcctcctgcaggatggcctccagttccgacacggtctgggcgggggtggcagagcggaaggtgaggcccaggctggtgggtgcgtccagcagatcaaactgcgccttttgctgatagggtgccaccgccaacagcacataaggggcagactgcgcggtctgtgtcgggagggggtcctctggataggtgtccacaaagacagcctggatggtccggctgcccgacgctgtggagagggagaggggcagggtggaggcggaaaaaaggtcgatggttcccgtggactggaatttccccttggcaaccacaagcatactgtcctgctgggtcatctgctctgcctgggcaggcgtcagctgcgccagaaaggcatggtagaggctgtcctcaatgaactgtacctccagcgtcaggggaagggtctcctcctgggctgtgccggtagccgcccggtaggcggcagagaggtctctgcccgccacaggacaggagaaggtggacacggcttgatagaagctctcggttacaccggcggcagcagacagacggggatagagggtatgtaggccgtcctctgggatggcctgggtggacaggcagaggtcatagtcaaaatccaccgtgtattggtccgccaggcgtttgagggtggtgctgaaggttgtgcctgcgacaaacaggacgatgctcaaggtcagtgagaggacaacgctgcggtagcgttttcggttccgccggaagttcttgtgggccagcatgccctccaggccatacaggcgctggagcaggggggcggcgttcagcgccttggcgtcctccttgatctcctccgtctgccgaagccataccataatgggcttggacagggccttcctggcgggaagcgcggcggaaaagagaacggttgccagacagattgccgcggctgcggccagggcgggaagggagagggaaagggtgaggggggccgagctgtgcagaatcgcactgaatttttgggagactacgggaagcagaagccctgtgccgccgatcccggccaggatgcccaggggaatgcccacggcactcaagcagagcccctcaaagcggaccgagcttcgcagctgcttctctgtggcccctacggaggccagcagcccaaactgctgcatgcgcttgctgagggagatctgaaaggagttatagatcaggaaaaacgcccccaccatgacaatggccagcaggctgccgcagacagagaccaagagggtttgaaatacagggctctccgatgcccccagaaagcgcagcacgggctcattgtacaaagcctggccgctgtacccggtgtgggcggcgtagtcctgcgcctggcgggggtgatacagggtgacgaacagacggagggaggtagcttgccctgggggggccgctgttgtgagcagggtgtatcccggggcgtcgtggggttccagggtgggccgttcgcaggtccccaccacagtgtaggttttctctgtggtggagaccagggtttcctctcccgggcggtagggatcggcctggctgagggagatgcccccggcctgccggctgcccacagaaagggtcagggtatcccccacggaaagggagacaccccctttgacggccagatgggagggtaccagcacctctccgtcgttctccggcagcctgccggagagcaggcggatcgggagcgtatcccaggaagcggccggcaaaccggcgagaaagagatacggcttttcggggctttggaccccctccagggtggcataccccaggttttccagcacggcggtgtgggcaacctgagggtcctgggcttgggcctggacaaaggcggtgtccacggcatcgaaggagacgtgccaatccccgtacttattctcggcactgatgaccaggaagtggagcagagaggtcccgaaggcggccacaacggtcatcagggcggcggccagggcaatgcccacgatggtgaccagggtgcgggcggggcttcgtttcaggctttgcagggccacgtggtgaaagacgttcatgggcggaccacccgcctttcatcccggaccacccggccgtcggcgatggtgaggatgcggtcagcctggagggcgatggaggcgtcgtgggtgaccagcagcagcgtctggtggtatttgcggtggctctccttcagcaggcgaaggatttcctggctgttctggctgtccaggctgccggtgggctcatccgccagcatgacagcgggagaattcatcagcgcccggccgatggccacccgctgctgctgcccgccggagagctggttgggcaggtggcctctgcggtcctggaggcccaggagggtcagcagctcctccagccgttcctggttgaccttcctgtgatccatcaggatgggcagggtgatgttctccaccacgttcagggtggggatgaggttgtgaaactggtagatcattcccacctgccgccggcggaaaatggccagctgctgtctgttttgggcgtacacgtcctgcccgttgaggaaaaccgtcccgctggtcgggatgtctaccccggcaatgatgtgaagcagcgtggatttgccggagccggaggagccgatgatggcggtaaattcccccttcgcaatggtcagagagacgtggtccagggcggtcacttgattgtcccctttgccgtaagttttgcacagattttggacttccagaaattccatactgtggacctcctttgctggaatctgtccctatcatagcgcggttgcctgacaatcctgtgacagtttggtgagagatccgtcacttagggaaccgaatggtaaaaaccgcgccgccctgggggtggttgtccgcggtgatctgcccgccctgctgggtgatgatggttttgcagagggacaggccaatgccgtaccctgtggtgttgcctgtacccgtgccccggtaaaagcggtgaaacaaatggggcaggtccgccggggcaaagccggggccgctgtcgtggagggtgagctgggtgaacaggagggtgtcctcgcagcggatctggaggcagccgtggtcctgcatggagtccagggcgtttttcaggaggttttgcagggcctctgtgagccagtgcctgtctcccatccaggtggcccctggtgaaaggtcggtttccagggtgatgctgtgcagctcaaaggagaggaggaaggggcgcagggcggcgcggaccaagtcgtccacggccacgggggcccgctgaaagaccaccatgtccgcgtccagccgggactgcttgagaagcgtattgagcagccagtccatctggcggaacaggacctgggtttcccgcagcagggtgcggcgttcctggggctccttggtggttttgagcagggagagggtcagattggcggcggtgaggggggtgcgaagctggtgggcgatgtccgccagggcatccgccaggtgccgtttctcccggcgcagggcggcgttttgttcccggagacgaagggtcatcttggtgagctcgctgtgcaggatggagagctccccctcctcggcgtcctgaatggacagggtgtcggcgttgtggagaacacggtctacctcctccgccaactgggcaatccggcggtagcgggcccgggtaaaccccaaaaacacgccgcccagagcagcggaagagaccagagacaggaaaccggccgccgggtggagggcaaagcctccgacggcggagagcgcggcgatgacagcacaggcgagggccagctgccgcagttccttatttcgaaccatgtccgcctcccagccggtagcctgtgccgcggacggtcaaaatgatctgcggggcgctgggctctggctcaatcttctcccgcagccgtttgatgtaaacggtcagggtgttgttgttcacaaattcccccgccgcgtcccacagctcgtccagcagccggtcccgggtgagaatcatgttggggttattgaggaagatcagcagtaggcggtactccagaggggagagaaacacctcctgcccctgcttttgcaccatgccgctggcggtgtccaccgtcaggccatggagggaaaagaccgagggggcgcggccggatttccgcagggcggcggtgatccgcgccaggagctcctgtgggcggaagggcttggtgatatagtcatcgccccccaggcacagcccagtgacgacgctgtcctcgtctgccgaggcggtgaggaagagcacggggatcgcctgggcctgcttgatcgcggtgcagacggcaaagccgtttccatcgggcagggagatatccaccagggccaggtccaggggggtctcctccagacaggctacggcggcacgctgggtggcggcatggaccacggtgaagccctccgcctgaagcaggcgggtgagatgcctggcaagggcctgctcatcctccaccaaaagaattcgtttcatggagaggcaccatcctttctggacaggtagtctctcttatgatacttcctctggggagagaaaacaagcggcgacacctttttctcccgccggcataggatgaaccggagggaaggaggcggtttcatggattggatggaccgagaacgtaatatttgggtggtgggcggagacctgcgccagcgggcgttggcaagattgctccgggaagatggacacaccgttcatattgccgcgctggaaggcgagggcctggcgccggagccgctgggtcctgggctggcgctggctcactgcgtgatcctccccctgccggtaacccagcgggaggagattttacacaccccgcttagcgaggaagaggtcaccctgtcccaggtgctggattacatggaggcgggacagatcctctgcgggggtctggtgtccccggcggtgagagcggcgggggagcagcggggcctgcgggtctttgattactatgcccgggaggagtgtatggtggccaacgcggtgcccacggcagagggcgcggtccaggtggccatggaggaactcccctttaccctgcacagcgcccgggttctcatcctgggatttgggcgggtgggaaagttgactgcccatcggatgggagccctgggggccaaggtgacggtgtccgcgcaggggtatgaggacctggcctgggcggcagcctacggccacgagacaggccggctggaaaccctctcctgtgagctgggcgggtttgacctgattgtcaacaccatcccagcccaggtgctggaccgccggcggctgcagtgggtgaacccaggggcctttctgctggacctggcatcggcgccggggggcgtggaccgggcagcggccaaggaactgggcctgcgggtccttcaggcgccggggctgcccggacggacggcccctgtcactgcggcagcggccatccgggattctgtttatcacattctttgggaattggaggcgtgagaaccatgggggatgcacgggtgggatttgccctcaccggatcattttgtaccttagagaaggccatccgggccatggaggagaccgcaagggaataccccaatatggtcccgatcctgtcggaaaccacgggggccacagacacccggtttggccgggcggcggacttccgacaggcggcggaggaaatctgcggccatggcgcggtggagtcagtgcgggaggcggagcccatcgggcccaaacagctgctggatgtgctggtcatcgccccctgcacaggcaataccctggccaaattggccaacggcattgccgatacctcagtgaccatggcggccaaggcgcacctgcggaacggccggcctgtggtggtggcggtgtccaccaacgacgggctgggcggggcggcccgaaacatcggggaactcctgtgccggaagcattactattttgtccccttccgccaggatgacccggtgggaaagcccacttctctggtggcggatatgaccaaggtgaccgaaacggtgaccgccgccctccggggagaacagctacagcccctgctcctggggccggcggaccagtgaagcaaagcccggcagggattgacctgccgggctttgctgtgggggttctggggaagcactctacggtccgtaggttgccatggggccggggttggggtatcatgggcccagaaacaccaaggaggaggaagaagaaaccatggcgcattatgtaacagggcctgccatcaaggccctgcgggagaggaaggggctgacccaaaaacagctggcggaacagattctggtcagtgacaaagcggtttccaagtgggagacgggaaagggcttgccggacctctctctgctggagcccctggccaaggccctgggggtctcggtggcggaactgctgtccggggagtaccggaccaacgccaatcgggccggcaatctgctgcgcagtcagtggtatgtctgtcctgtctgcggcaatgtggtctatgccctggggcaggggagttttcactgctgtggggtggcgcttccgccggcggaagcggaggaggcggaaggggagcacgccatcaccttggagcaggtggaggatgactattacgttaccttggaccatcccatgtccaagggacatttcctctcattcatggcctacctgaccacggaccgggtgctgctccaaaagacctatccggagcaggcggcggcggttcgcttcccccgtctgggaccgggacaaatcctggcgtactgcaaccgccatgggctgtttcggaagaaaatttcataacatttgtgagaaagactaccccggccgctggagcatagctccggcggccggggtggtctttgaaaaattctatggacaatgcggggaaagaggggaagagaggatgtagaattgtcacccaataaaataatttagttgacgaatggagggggctgtggtatccttgtccccatgagccggagaatggcgagtgacacaagggagggatggttttgcaccgggaaaagaccaggacaatggtgttgtgcgccatgtttgtggtgctgattgcggcgggggcgtggatcaagattcccgttccggtggttccgtttaccctgcagtatttgtttaccatgctggcggggattctgttggggggaaggcgcggggcgctggcggtctgcgcttacctggcgctgggattggcagggctgccgatctttgcccagggaggcgggctgagctacctgcttcagcccagctttggttacctcatcggatttgccgcaggcgcctttgtcacagggacaatggcccgaagcgggccggtgaccttccggcggctgctggcagccaatttagtggggcttggggttgtctacctgtttgggatgctctattactacggcatctgtcaggcgctgggcacccccattgggttttggccgctgtttctgtatggatttgtgctggccgtccccggggatttggtgctgtgtgtggtgggggctgttttgggcatgcgcctgcttcccggcatagcaaaggagagaaaagcatgacggtaacagagactttgggacgaaaggtccttgccggggggcagctgaccaagaaagaggccatgaccttgtatgggcagccgctggaggaactgtgcaccatggccgacacggtgcgggcgcggttccacgcccaggcgttttcactttgcaccattgtcaatgggaagagcggccgctgcacggagaactgccgcttttgcgcccagtctgcccactatcacacagaggcggcggtgtacccgctgtgtgaccaggaggagattttggcccaggccaagcggtggcaggcccaaggggtacctcgctttgggattgtcactgcgggcaggcgcctgtccggccgggaggtggaggagatgtgccggaccatccggcgggtgcgccgggagacggagatttccctctgcgtttcctttggccttttgagggaagaggaataccgggcactgaaggaggcgggggtggagcgggtacacaacaacctggagacctcccggtgctattttccccaggtctgcaccacccacacctttgaggacaagctgaccgccatccgcgcggcccaggccgcgggcctgacggtgtgcagcggggggattgtggggatgggggagaccccggaggaccggattgacatggccctgaccctgcgggagctgggaatttccagcgtgcccctcaatctgctccagggcatacccgggacgccgctggcccagcaggagaggctatcgcaggaggaactgcgccgcattgtggcggtataccgtctggtgctgccgggcgcggtgatccgcctggccggaggccgggggctgttgtcggaccggggaaggggctgttttcaatccggggcaaacggggtgatctctggggacatgctgaccactgcggggattactgtggagacggaccgaaacctgctggaagaactgggatacgaggtgaagtgagaccatggcgaagaaactgtttgtcacagggacagggaccgatgtgggaaaaacctacgtgaccgggctgatcctgaaaaagctgcatcagagcggggaaacggcggcctactataaggcggccatgagtgggaacgaccgggggcccgacggcaccttgtatcccggggacgcactgcgggtcaaggagctctccggcattccccagccggtggaggagatgtgcccctatgtctacgagcaggcggtctcaccccatctggccgcccggtgggaggggagaccggtgcaggcggaggtggtctatgccgggtttgcacggctctgcgcggcctattcctgggtcaccatggaagggtccggaggcattctctgtcccatccgcctggaggagccccccatctggctgccggatctggtccaggggctggggctgggctgcctactggtggcagaggcggggctgggcaccatcaaccaggttggcctgacggcggcttacctgcaccggcgggggattcccttacagggcatcgtgttgaaccgctttcagccggggaacccgatgcacgaggacaaccgggccctgtgtgagctggtgtccggggcgcgggtggtggcctgtgtcccggaaggggccgcggcactggactgcaccgtggaggaactgaaagcactgtatggatgaggagaggagagaaacgcgatgatttggtatccctaccagcagatgaaaaccatgcagacaccctatgagattgtcgatgcggagggggtctatctgtacacccgggagcgcaggatgattgactccgtctcctcctggtggagcgtgatccacggctacaagcatccggccttgaaccaggtgctggtggaccaggcggggcggttttcccatgttatgctgggtggcctgacccatgcgccggcccagcagctggcggaaaagctggggcaatggcttccgggggaactggcgtacagcttcttttccgactccggcagtgtggcagtggaggtggctctgaaaatggctctgcaatattttatgaaccggggacagacccagcgcaccatgattctggctctggagcacgcctaccacggggacaccttcaagaccatggaggccggggacgacgcagattaccactttgtcctccaggcctacggacccagccggcatgtggtgcacattcccacggagattccggcgctggaggaggcctttctgacctaccatgaccgcctgaactgtcttctggtggagcctctcctccagggggccggagggatgcggatgtatgatgtgtcctttctccagcgggcccgggccctgtgcgaccagtatggggtgctgctgatctttgacgaggtggccaccggctttggccggacgggaaaccgatttgtggcggacctggtccagccggacattctggtgctgggcaaggcgctgaccggaggatatctggggcatgcggtgacggtggccagccggaaggtgtacgagggcttttatgacgactgtccagagcacgccctgatgcacgggcccaccttcatgggcaatgccctggcctgccgcctggcgctccagtccatcgcgctgtttgaggagcaggattacctggcgaagattcgccgcatggaacagatcacccggcgggaactggcgggattctcccatccgagcattcgggagatccgcatcatgggcggctgtgtctgcatagaggtgtttgacccggcggtgctgcggggataccagcagtttgcctatgagcggggggtgttcagcaggccgttcttgcagtatctctatgctatggtgccgtacatcattgaggaagaggagctggtcacggtgctgcgtacgatgaaggcgtggtttctccgataaaaagagaccagcggcgtctgtttcggtggggaaatggacgccgctgtttttttctggccgaaggagacttgattacagttcgtgtcgaaaaaaggtggtaagatagaaccatccaaacagacagacgccagagaaaggagaccacacatgggatttctggattttttctttcaaacggacatcaatgccggcctggcacagtaccaggcggaccccaagggagttttgctggatgtgcggacccgggaggagtacacccacggccacattcccggcagtcaaaatctgcccttgcaggaggtgacccggatcgggacgatggtgcccgatcagagtacccccctctatgttcactgttacagcggcgcccgcagcggacgggcggtgaccgcactgagacggatgggatattcccatgtgagcaacattggtggaatccgggattaccggggaaagacggaaggaggaaactgagcgatgaaagtcatcatcattggcggggtggccggcggcgccacggcggcggctcggattcgccggttggacgagaaggcggagattgtcatcctggagcgttcggggtttgtctcctatgccaactgcggcctgccctactatatcggcggggtcatcacggacccggaggaactgaccctgcagacgccccaggggttttggaaccgcttccgggtggacgtgcgggtgcgccacgaggccaccgccattgacccggcgggcaagcaggtcacggtcaagaacttagagacgggggaggttacggtggagggctatgacaagcttctcctggccccgggggccgcccccacccggcccccgctgcctgggctggacagtccccggctgttttccctgcggacagtggaggacacgttccggattcggtcgtttgtggagcggaaccggcccaaaaccgcggtgctggccggcgggggcttcatcagcctggagatggcggaaaatttggcggagatgggagtggaggtcacgattttgcagcggattccccagctgatgaacccgctggactatgatatggccaccttcctccacagccacctgcgccgcaagggaatgcatctgcggctgaacactgcggtggccggcttccggcaggagggggagaccatctctgccttggtggaggggggagaggccattcctgcggacctggccatcctggccatcggggtgacaccggagaatgccctggcgaagcaagccggcttggccctgggaagccggggcgggattgtggtcaaccagcggatggagacctccgtccctgacatctacgctgtgggggacgcggtggagattccacacctggtgaccggggagaacaccctgatctccttggcgggaccggccaataagcagggccgggtggcggcggacaacatctgcggcggagacagccgctacttaggcgcccaggggtcctccgttgtgaaagtgtgtgagctgacggtggccgccacaggcctgaatgaaaaggcggcccaggcggcgggcctgtcctatgagaagatcgtactgtccccgctgtcccacgccgggtattatccgggaggaaaactcatgaccatgaaggtcctctatgagaaggggagccagcgcctgctgggggctcagattgtaggccatgagggggtggacaagcggattgacgtgctggccacggccatgcaggccgggctgccggtcactgccctgaaagacctggacctggcctatgccccgccctacgcctcagccaaggacccggtgaatctggtgggattcatggcggaaaacctggagcagggggtggtgaagcagttccactgggaggacgtggctgggctgccccgggacggcagcgtaaccctgctggacgcccggacccccggggagtacagcggcggctgcgcggagggctttgtgaatgtcccgctggatgagctgcgggaccatctgggggagattgccccgggcaaacccgtctacgtgatgtgccagagcggcctgcgcagctatctggcctgccggattctggcccaggatgggtatgactgctataacttctccggcggctaccgcttctatgagagcgtcctgctggaccggtggacccggcagaatgcctatccctgcggcgtggagcggccctgaacagcaaacacccccgttgggtttcctgcccggcgggggtgtttgccctctttacatcctggcgggaagtgggtatagtaggagggaacgatttttggcaagggggcggggcacgtggacgacgcggtgtggaagcagacctggggggaggctctgaatcagcagcaggcggcggcggtccaggctgccgacgggccggtgctcctgctggctgtgccgggcagcgggaaaaccacggtgctcatccaccgcctgggctatctgatggactgccgggggattcccccggagcggattctcacagtgacctacacggtggcggccacccgggatatgcgcgcccggtttgcccggacctttggagaggaccgggccagccggctggagtttcgcaccatcaatggcctttccgcccggatcattcagtattacgagcgggccatgggccgacgggcttttcagctggtcaccgacgaggggacactctcctccctggtgggggaactgttccgggcgtgcactgggacctttgccacagagagcaccatcaaggggctgcggaccgccatcacctacggaaagaaccggcagatgtcccgggaggagatggaggcgttgtccaccggggaactgcctgtggcccaggtttatcaggcctattgccgggtgctccggcagcggggctggatggactatgacgatcagatggtgtacgcggcgcagattctccggcggcatggggagattctggcctactttcaggaaaaatacacccatctctgtgtggatgaggcccaggatacctcccgcattcagcataccattctccgtctgctggcgggaaggcggcgaaacctctttttggtgggggatgaggaccagagcatctatgggtttcgggcggcggaacctggggctctgctgcggtttgagcgggattaccccggcgggcgggtccttttcctggagaagaattaccgctccacccagaccattgtgacggcggcggatgggtttatccgccagaatcacaaccggcgggacaagcacatgaccgcagcccggggcccgggacctgccctggaggaactatgggtctatgaccgggcggcgcagtatgcctatctggcccgtctggcccgggactgcccacaggagaccgctgttttataccgaaacaatgagagcgccctgccggtgctggacctgctggaccggcagggcattgcctgccggtgccggcagatggacggaacctttttcacccaccgggtggtccgggatatggcggacttttttacctttgcggtcaacccggcggatggagcgtgctttctgcggatgtactacaagctgcgggcggggatcaccaagggcgccgcgcaatgggcggttcagacggtcgtggcgggggagagcctgctggatgtgctgtcccagtgtcccggcctgtcccagtggagcaggggccaatgccgggccctctccgtccactttgcccggctgcgggaggagcggggggactgggccgtggaccggctccgccacgccatggggtatggggagtacctgaaggagcggggcggcgatctgggtaagctggatattttagaggcactgggacgccatgtgcccaatttgggggcccttctggaccgcctggaggaactgcggacgctggtgcggcaggagagacaggggcctgcacaggggctgatcctctccaccattcacgccagcaaggggttggaataccaacgggtgatcctgatggatgtggcggacggactactgcccttggtggaggcgccggtggggaggaaccctgacccggcggcggtggaggcctatgaggaggagcgccggctcttctatgtggggatgacccgagccaaggagacactggcggtgtttcgctttcaaaagcccggcctggccagcgccttttcggaggccctctttcccccaaaagccaagtcccagccggtccgggcccgtccgaagccggcggaggacagtcgggcggaaggggcacccgacggaacagggtatttccccggcgtttccgtgacccaccggacctttggcagcgggaaagtggtcagccggcagggggacattgccaccatcctgtttgaggggggacaggagaagcgcatcgccctctccgtggcgctccggcggcggcagctgtggaggagccgggagaaaaccggataacctgagaacaagccctgcaaaagcagggcttgtttcaatcggatagaatgttttccttggagggtggcggcagaacctcccagtgaaatgtttctccctccaaggtcagccagcggaagagcccgtcctcatagagcaggcagctgtgaggggacccgccccggggcagagagaccgagccgggattggcgcagaacagatctcccacccactgccaggagggaatgtgggtgtgcccggacaaaaggacctgggcggccccgatggggggcggattgtgggggccataccgatggccatgggtcaaaaagacggacaggccctcccaggaaacggtggcggaaccggcgtacatgggaaacgccggccccagggcgcccgcgccgcggtcacagtttccctctacccacagaatctcccgggccagggggcggagcagctggatgacctgatgggggtcgtattcatactggggagcataggacccggaatagaccaagtcccccagcaggataagctgctgggcgccttcctgctgatagcgttccaacagctgccggcagaaccgggcggaaccatggagatcggacgcgatgagtcgcttcatggggaatcacctcgcagcttagtataccgaatttgccgccaaagagcaagcagaggaaaaagaccggaaatccaagatttttctctgttccctggcgcagggacatggtataatgaacccgtccgcgaaaaccaaacaccacggaggtggcttttatgatagaagacgcaaaacgatccattgcctttctttgtccagtctgccggcagccggtgatcttggagaggacggtgtttcagctggcggcatccggcagccggctgccctgtccctgcgggaaatccgcccttaccgtctccctgatgggggaccaggtccgcctgacggtgccctgcctgttttgtgagcaggagcataccgtgtcctgctccacagcggcgttcctccaggagaagacgctggccttttcctgcgccaattccgggctggactgctgctatgtgggggaagaggcgtcggtctttgccgccatgcggcggctggaggagacggtggatgtgctggagtcagaggcgggcgcccagggaacctttctcaacgacctggtgatggaggaaatcctgggagaactgcgggacattggccggcggggcggcatctcctgtacctgcggatgcagggagtggaagctgaagatcaattacagttcggtggagctgttctgcgcccagtgcggcggtgcgctgaaactccctgcggcgaccatgtcggacattgaggacctatgttgtaagccgacgcttaccattcggggcgggaaaccgccggaagatgccaagtgagaaaataaaaaaacgctcccaacctgggcgcacatccaggcacctgcggcataagatggactgagatcgcaagacggtctccatctctgacaggaggtaattgtctatgtgttgtaacaacggttggggtggtaacagctgcctgtggatcattctgatcctgatcatcatcttctgctgcggctgtggttcgaacagcggctgtgggaataactgcgggtgtggctgcggctgtggctgcggcaacaactgtggttgcgggaataattgcggctgcgactgcggcaacaactgcggctgcggctgctaagacacgtaccatagcctgcgcacgttcctgcgtcaccggcagagagcagccccgggatattccggggctgctctccctggccggggaaggaaaaaattttgaaaaaatgaaaaataagacttgcattttgtctctccgtgtgctattatctaaaagctgtcagttgacatgcggcagtagctcagttggatagagtaactggctacgaaccagtaggtcgggggttcgagtccctcctgccgtaccaagcgccttcaatttttggattgagggcgcttgttgtttttatacgttaaaaagtacgccgtggacaacggcacagaggtccacggcgttttttatcagggttttgttgcggcggcgcggggttctgcaggcaaagtatggtgcagagagccctgtaaaagacgaaagaattctgcttccgtgagaaggcagaggttggacttcccctcagcaagaatggccctggccttttcctccttgttgctgacggtggcggttcctcctggtccatcgtattgccgtcccaccacaagaaaatcggtttttcgggagactgcggttttgatgaccgcccccacgttgaccgcccgctgcatggcctcccgccggtcgatggagagttccccggtgaagaccaccgccttctgatagagcgggtgcttcgggtcgaagaagctcacctggggccggatttctttgggccggatgggaggacggtacgcaggcgaaacccgtggcttacgccgctgggacgggggctggggggcgacaggaagggccagatcggccacctcctgaatgcggatatggggctgggagaaacagaattcccctaagttgagacagtgatttgcctggatgcaggcgatggcgatctgggcgcaggccacagcgtcgcattccgcgttatggtggtgggtgaggggaatggccagggcttgggcgcaggcggccaggttcttccggccggggaccaagtcccgggccatggcaatgctgtcgatgtacttaaaatcggcgtattgccggacgtaggggtcgccgtaggccgccagagaggccttgatgacggacatatcaaaccgggcattgtgcgcgatgagggctttgccggccaggaggggatgcagctcctgccagacggtgagaaaatccggggcgtgttccgtgtcctccgggtaaattccgtggacatgaatgttgccctggtcatatctgttgcctggcggctggatcaggtggtgggtggtggcgaccaccctcagccccaccacaaaggccaggcccaccgcgcaggcactgttggggtcgctggtggctgtctcaaaatcaatggcgacaaagtccacatgttggttggcggaaagggggagcgactgtttgtcgcgaacatccatgggggatcactccgttcgtcttctgtgctgggatttgcagggggaaccgggaggaacacaagcccctccgcagatcctttcttattatagtatcctggtttgacttgtcaagctgagggagattggatttaggagcacggcgcggaatgctgacaggatgacagaaaaagcggtagacttcatggcaaaaatttgatatcatgacaaaaaaggacccgatttgacccaaaaatgccagaggagggcggagccatgcgagaaagaatccgacggaacgtgggccttgggatggcggtcattttgctggtttcctctctgggggtgccgccggcgtccgcggggacggtgcgggagggaaagtccctggcggaggcggagatggacgtccgctccgggcctgtggagtacaacgggagtgagcagaagccaaaggtttcgattcatttggacggtgtgcctttgcgggagggggtcgattaccggctgtcctatgcagacaatctggatgctgggaccgctgtggtgatggcaacagggaccggcgcgtaccacggcagccgggaggcaaagtttaccattctgcccagaacagtatctgcgcaggcgcttcaaatcgaagcgggctgtcagaaggaatatgatggaacaacgaaggcttccccaacggtttccgtccaggtgctgccgggggaccaggtggaggtgcgctgtacagcggcctatgacacctgtttcgtgggcagggaaaaaacggtcacggtgtctggactgcactttggtggcccggatggggacaattacaggctggagacgtcggacctggtactaaagaccacgggacaaatcaccccccaactgccggacttccaaaagtctgctgcattggccaaggggcattccctggacctgcgaacccttttcacggacgcctggaagggggaggcacggtttcagctgactggcgaggccctgggctgtaccttgcaggggacaaccctcacagcggggcagacacttgggaccgtcaagctgcaggtgacgatgactggctgggatgaaaacggagacggaatagacgagtactccggggacagcggcattgactacctgactgtgacggtggtggataaggaaagccagccgcctgggaacggcggcggggtggggcagcctggattttccctccagggtcccactgcggtgacctacgggcagagcatctccttccaaaccactggcggggccggcaccggaaaggtgaccttctgggtggagccccgcagcgggcggggagcggccaccatagacagcaacggggttcttcaagggacccagacgggaagcgtgctggtatacgccaagaaagacggagacgaccgctatgaaagcatccaggcagaccccatagaggtgaccattcgcccggcaaagctgaccattcaggttcacaacaaaaccgccgctgtgggcgatccggttccagccctgacccaggcggattacacggtctccggtttggtggggcgggacaccctggccaaggcccccaccctctcctacggtgctgcccccaacctctccctgccgggggtggtccccattcaggcggccggcgcagtcgccccggcgggggacaactatgatcccaacatcacctatgtgccaggcaccctgaccatccgggaggttccggtctatcccatcaccgttgccgcgatggtgaacggagcggtggccacggactgccaggcggcggagccggggaccacggtgaccctcacggtgcgtcctgcggagggattccggctggaaaagctgaccgccgccagcggggggcgcgccctttccctgcgaaaaacagcggagagggtgtataccttttccatgccggagggggcggtgacggtgaccgcgcagtttgtccaggagacaccggaacagggccccttcccctttacggacgtgccagagacagcctggtactatgacagtgtggtctatgtctacacgcacggtctgatgaacggcacaggtcccacaacctttcagcccaatgcacccaccacccggggcatggttgtgaccattctctatcgcatggagggaagccccgaggcggccagctggtccccctttggagatgtagaccccaacgcctactatgccgcgccggtggcctgggcggcgtggaacggcattgtcaatgggtatagtgccactacctttggtccccaggaccgggtaacccgggaacagttggcagcaatcctgtaccgttacgccgagtataaaggatgtgaggtctctcagcggggagacctgacgcagtttgtggatgccggacagatccatacctacgccagggaagccctctcctgggccaaccggatggaactgatccagggcaagggcaaaggcattctggatcccagaggactggcagcccgagcgcaggtggccgccatgctccagcggttccaggaaaaaattctggcttgagaaagcgctttgccggacggggcccccgtccggcaaagcgccgaagggacaggggagaaaaactttttgcaaaaaatgaaaaattctccttgacaaattcaaaaacgatgctataataaattttgctcgcgtgagttgcccaagttaaaaacgcgacatgccatagcgggattgtgtaagggtagcacgacagactctgactctgtttgtgagggttcgaatccttctcccgctgccaaagaaagcgacctaaagattgttttaggtcgctttctttatttttgtgattcaacttacagagagatgggtagaaaactacttccgattcaaattgagaggaccgggtgtccgtgtcccgcgtgaaacaaaacgctgtgtccggatggtcaaaaaatacttgcagtgtttcccggaggatcgatccgttgcgctgatagatattcctttatggatgctcaatcttttttctccaggggctccggctcttccgccgcccccggcttgcgggtatgataggcgagactttcatctgttatcctttcaacatccccagattctaccctgtgaaacaaattcgcttgcgctatgagctctttggtaaataaagctgccttcagagcgcaatccatttttgcgttttgagccagtctcagggtgtggtatatgagttgtctcacaattctttcatctgcttgcacactaagtgccccgcaccagagagggaaaacgctaaaatccagatttgcctcgctgagtctggcccctcccaggtttgtccctctgaggttcgcccctcccaggtttgcgcctctgaggtccgcccctctgaggtctgcctcactgagatttgcccaaccaaggttggcctttctgaggtttgcccatccgagggttgtctctctgaggtctgcttctctgaggtttgctcctctaaggtcggcctcaccgaggtttgcgcctctgaagtctgcctctctgaggtttgcccctttaaggtccgcctcgccgaggtctgcccctctgaggtctgctcgttttcccccttcgttgtgcaaccaaagcgtatgctctgtcaaaatcttttcgagatcagttttgttcatcatggattctcctttttgacccgattcatctggtaagactggcgcaagcgttaattttaatgcgtgctgacctccccgccgcaggccagacaccctgcaccatccatcccgttatcaatgtgttctgggtttccagatgcccggacaatcttgagcaaggtcactatggcagccacgtcctccggctctaacttgcacatggcccccagaggcaacacacttcgtactgaggtaagtataccagaattctgcaatcaaataaaaattgttttcgggacttctatggtcctcttccgatgggggaacctcctttctaactaaattcctctcttgccccctccttctgtccgtgatagaatcacaggagaagggaggtgcaaacatggatttttctcttatggacgatctcaaccattttttcgatgtgtttaatacccggacagaaaattccctgaaaaagaatttgcctcccgagtcggccgatattgcgtccaaggctgtttcggaggaagtaaaattacttcgtgaggttgttctcttctggatagaagaacatctcaaccgttgacaatcttcatttcatcaaaaaactctgtggacaaacggctggcgtctatggcttctttgattgtcacagagctggctgccaccagctctgtgatttttttgcaagctttttggtcttgtcatttggagcggtaagccgatggggatttataaaaataagagcaggctgatcgccatgacggccatgccgcagatcaggccgtaaatggagagatgatgctccccgtactcccgtgccgaggggagcagctcatccagagagataaacaccataatgcccgccacgccggcaaagagaatgccgaagaccagatcgctcataatgggcatgaggagcagccacccaatgagggcgcccacaggctcggccaggccggagaggaaggagtaccgaaaggccttgcccttggagcctgtggcgtgataaatgggaaccgagaccgcgatgccctctggaatgttgtgaatggcgatggccaccacaatggggatggcgatgctggggtcctgcagggcggagacaaaggtggccagtccctcgggaaagttatggatggcgatggccagggcggtcatcacccccatgcgcatcagcttggttgtgtggccggtgtccgcttccaaagacttgacctcatggggattttcctcggagggaatgcacttgtcaatgagagcgatcaggagcatcccgccgaaaaaggcgatgaccgtgctccagctgccccatttctcccccagttccgcctggagcgcatcctgggcctgggaaaaaatctcgatcatggagacataaatcatgacgccagcggaaaagcccaggctgacggacaagaattttttgttggtatggtgggtcaaaaatgcgatgcagcttccaatcccagtgctcagcccggccaggagggtgagaaaaaaagcgtggagaaccgcgtgatccataggatacctcctttgatgatttaagttagcgtttgctaacttaaaatacgataccacgtcttgtgccgtttgtcaaaggaaaaaccgcccgccccgggacgctgcggtctgaggcggacggcttgaggaggtttttatagctttttgtactgtcggtagaagagggtggctgtggtgctgacggcgatgaaatcggccacaggttcggccaaaaacacggcaaacaccttgtcggccaggaaatatgggagaatgtagatcagggggatcagcaggatcaccttgcgcaggagggccagaaagacagaggttttggcgttgcccaaggcgatgaaggtctgctggcaggagatctgaatgccatggagcagagagaccgccatgtagattcggatggcccagcgggtaaagtccgccaactgcgggtcactggtaaagatggagatgaacagctgggggacaaacatggacaaaaaccagatgagcccggcaaagaccatacagcaggccaacagcagacgaaaggcctccttgacccggtcccgctggttggccccgaagttaaagccgatgatgggctgggccccctgggtaagcccctgaagcggaagcatgcagaattgcatgacactggccaggatggtcatggcccccacggcgatgtctcctccatagcggagcaggctggtgttaaagcagatgttcaggatgctctcggtaaactgcatgataaagggagcgatgcccaaggcgatgcaggggaggatgaccgagccccgcagacgggcgtaccggagctgcagccgcagtgtggttgttttcccggtgaggaagcggagaatccaggcgcaggaaatcccctgggagagaatggtggccagggcggcgccctgcacgcccattcccagggcgaagatgaaaatagggtccagaataatgttgcaggctgcgccgatggtcacggtgagcattccggttctggcaaagccctgggcgttgatgaaagcgttgagacccagagcaagctggacgaacagggtacccagggagtatattttcatgtagtcccaggcgtaggagatggtgttgctgctggcgccgaaaatcatcagaatgtcctggccgaaacactggatcaccactgtgagaaccagggcggtgatcaccagcatggaggcgcagttgcccagaatgcgctcggcctgctggggctctcccttgcccatcatgatggaggcacggggcgcgccccccatgctcaccagggcagcaaaggcggaaatgcacatgatcagcggcagggtcacccccacgccggtcagcgcgttggggccgacatcgggaatgtggccgatgtacatccggtccaccatattgtagagcaggttgatgagctgggccagaatggccggcagggccagctggaagagaaggcggctgattttgtcctggcccagattggcgccttgcgaatgttgtagctgcaatggaatccctccgatgtggtcaaatgcgataacatctattataacacaaaacatgtggagctgacaccctggattacacgcccttgacgagacaggaaatctgtgatacactgccctcgatcactcgccgccgggcgggtgctgcgtttgtttctgtaccattaggccgtagaaggtacagaaagaaacgcattttttattgatgggaaaaggaggaaggcgtgatggcgtggatttgcctgttggcggccggatgcctggagatggtctgggtgactgcgatgaagctgtcggatggttttaccagggttggatattccgttctgactgtggcggctatggctgccagcgtctggctcttggcccaggcggtgaagaccttgcccatggggacagcgtacgccgtctggacaggaattggcgccctgggtgcggtggtgctgggaattgtgatcttcaaagagccagccaccgcggcccggatgtttttcgcggccctgctgctcgtcggcatcattggtctgaaagcaacggcccattgagagagaaaacgcccgcatcagcgggcattttcttggtaggcttttccccaggcttccatggcgtccagaacaggccggaggctgcgccccaggtcggtgagggtgtactccacgcgggggggaacctccgcgtagacggtgcgggtgagcagtccgctggcctccatctgccgcagctgggcggtgaggaccttctgggtgacggtgccgatggactttttcagctccccaaagcgtttggtgcccggcatcaggtctcgcaggatcagaaccttccatttgtcgctgatcagggtcaaggtggtttccaccggacaggctgggcacgcggctgacagagcagggctttgcataccagatcctccttgctttcatggtatctttttggaaagtacagaaaaatattacacttacaatagaaaagatagctgcttccttattataaaggaagcgcggggggaatgcaagcgcccggcaagggattaggtaggatggggggtacacagctgaatggaattgcgttgtcaaaagggtgccgccccctgtccgggagggtctctcccagacagggggcggcgaaaagaaagaaaaaatatggaatcaatggtgagaggctggcgttttcgtggtccgccgccgggcggctttcaccaccagggaggacagagccagcagagccagggcgttgggaaggaccatgagctgattaaacaggtcggacagggaccacaccaggtcattggacagacacgagcccaagaagatgaacaccaccccaagcaccgagtagacggcagtggctcgcttgccgaagagataggccacgttgagcttgccaaagaagttccagctgaggatggtggaaaacgcgaagaaaaggaggcacacagcgacgaaaatactgccaagcccttccccaaagacgctggaaaaggccagctgcgccatgttggattggtcaatgccctctgccgccccgccggccaaggggccgttgccggcatacagggtggagatgaccaccaacgcggtcatggtaagaaccaggaaggtgtcgatgaataccccgatcatggcgaccacaccctgctcatgcggggttttgaccttggccatggcgtgggcatggggggtggagcccataccggcctcgttggaaaacagcccccgcttgacgccctggctgatggcggtctttaaggcgtaccccaagccgccgcccagaatggcgttggggaaaaaggcgtacttgaagatcatgccgaaggtctccggcaggtagggcagccgcagaagcagaagaaccagccccccaaggaggtagagcaccgccatgatgggcaccagcttctccgtcacagaggccacccgctgcaccccgcccagaaagacaaaggcagaggccacggccaccacggcgcctatgatccaaggggggatgccgaaagcgttgccgcaggtctgaccgatggagttggactgaaccatacagccgataaagcccagggccaaggtgatggccaccgcaaagaaccccgccaggaaagtgccgaacttgttctgaaaagcccgcttaatgtagtaaacagggccgccggagacggtgccgtccgcatggaccacccgagtctcctgggccagaacggcctcggcgtaaatggtggacatcccgaaaaaagcgatgatccacatccagaagatggcaccgggcccccccaccaggatggcgctgcaggagccgatgatattgcctgtgcccacctgggcggcaatggcggtggtcagggcctgaaaggaactcaggccgcccttctgccggcccccgcgcatggagaagccgccgaaaacccggcgcatgccctccccaaagcagcggacctggacaaagcgggtgcgaagggagaaaaagacccccgtccccaccagaaggaccaccaggatgtagtcggaaaggtaaaagttaatggtttgcacaatgtgcagcagtgtttccatgggactgcctcctcaagacttgaaatgaaaagagcctgccggtccaaaggcccagcggctctgaagaaaagacagtccgaatccttcttccggcggacagacgacctccgcagaggggatgctcggctctgtccttttacctgagagattcggcttcctgggaagccttgcaccttcggtactcaaaatattgagattctccagagatccctcctccttcagtctcctttccctggggaaaggattctcaaggtctcatcgggcgatatgcggttgtacagcactgcgctttttaggatagcatggcgcaagaaaaattgcaacccaagggggttacaaaatccttgtctaaaaaatgaaggattactatgcaaaatagagaaattaaaggaaaaagcccgcctgtcagagggattctgacgggcgggctgctggttttcttgcaaaaaaaggaaggaaattatgcgtcgtagttgccgtttccgttgttccacttccagtccctgatctccggcaggtcctgtccgtgttcggcaatatactgcttgtgctccaccagcttgtcctgcaactgctggatgaggaaagcgccccgggtgcccagcttctccggcagcagatggatgacatccatggtcaggtggaaacggtccaggttgttgagcacccgcatgtcgaagggggtggtgatggtaccctcttcgatatagccccggacgtggagattcttgttcttccggcggtaggtgagctcatggatcagagaggggtagccgtggaaggtgaagaggatgggcttgtcctgggtaaagagcatgtcatactgggagtcggacaggccgtgggggtgctgggtgttggactggaggcgcatcaggtccaccacgttgatgacccgaaccttcagatcggggaaatggtggcggaggatggtgaccgtggccagggtctccagcgtgggggtgtcaccacagcaggccagtaccacgtcaggttcctgcccctggtcattggaggcccactgccagatgccgatgccctgggtgcagtgcttcaccgcctgctccatggtcagccattgagggcggggatgcttggaggtgaccagcacattcacatagttccggctggcaatgcagtggttgaagcaggagagcaggcagttggcgtccgggggcagatacatccgcaccacatcggccttcttgttggccacatgatccaggaagccggggtcctggtgggtgaagccgttgtgatcctgctgccagacgttggaggagaggatatagttcaaggaggcgatgtcctgccgccagggcagctcgttgcaggttttcagccacttggcgtgctgggaaaacatggagtccacaatccggatgaaggcctcatagctgttgaaaaagccgtggcgtccggtgagcagatagccctccagccagccctcgcacatgtgctcggagagcatggagtccatcacccggccgctgtgtcccaggtactcgtcgccctctgccaggtcggcgttccagacccggctggtcgtctcaaacatgggggtcagacggttggatttgctctcgtcagggccaaagacccggaagtttttggcgtctgcgttgtcccggatcacatcccggacaaaggaccctaagaccagcatgtcctgggcctccacactgccgggggaggggacatcaatgccgtatgcccggaagtcggggcgcttaagctcccggaggagcttgccgccgttggcgtgggggttggcccccatccggcggtcccccttgggggccagggcctgcagctccggccgcagcttgccttcgtcggtgaagagctcctcgggcttgtagcttctcagccagctctccagcagctggaggtggtggggctgggacatgtcgatgggcacctggtgggcccggaaggagccctcgatggtggcgccgtccacctctttggggccggtccagcccttgggggagcgcaggacgatcatgggccaggtggggcggctgtcgtccccggtggtccgggcgttggcctggatgcgtttgatctcccggatggcccagtccagggcggcggccatggtctggtgcatggtcttgggatcatccccctccacaaagcggggctcccagccgcagccccggaagaagctctccagctccccgtgggagatgcgggagagaatggtgggattgtggatcttaaacccgttcagatggaggatggggagcaccgcgccgtccccgatgggattgaggaatttgttcccgtgccaggcggtggccaggggaccggtctctgcctcaccgtcccccactacgcaggcggcgatgaggtcggggttgtccagcaccgcaccgaaggcgtgggacagggagtacccaagctctccgccctcgtggatggagcccggtgtctccggggctacatggctggggataccgccggggaaggagaactgcttgaagagtttttgcattccctccaaatcctggctgatgttgggatagatttcgctgtaacttccctccagataggtctgggccaccatggcgttgccgccgtggccggggccggagaggtagatcatgtccaggtcgtacttgttgatgatccggttcaggtgtgtatagatgaagttctgaccggggacggtgccccagtggccgacgatctttttcttgatatgagcaggctcgaggggctgcttcagcagggggttgtccagaaggtacagctggcaggcggacagatagttggaagcccgccagtaggcgtccagcttttccagctgggccggggtcagggcggctttccgagacatccgggcagccgtttttgcgatgggtttgttgagtcccttcggttttctcggcatagaaaaaacctccttttcgtagtctaccctttattataaacgtttttggggaagaatcaacaataaagtccccatggtaaaaataaaaatgggttccagtgaaaggaaaagaggagcacaacaaaaacgttacagcctgttttagacagctgtagtgttaatggacaaagagaagttgtgatcacaagattccccagtctattacagtaacttgagggggaaagaaagtagataactcgcgcacgtaaaagacttctacctgatccccaagagaaagacgaacctcatttcctgactttgcagagagcaactctgtgcgggaaagccaaacctcatccgtttttttgcgaaggggatcggattctgcgggggtcagaaccacccaattgtcttctatgcgaagtacggtgcctgttaatctttgatcatccagttcccagttatagatgtcgatttctactcgagtatctgttatttgtttgatgggatgggacataggataggaaccggagatgcgatcaccaactttgggggttagaggtgagaattctccatccagatgaggaaaaaactgaatttcagaataagactggatcaacgtgggttctattgtggaatctgttgtatccaattgtactacagcttgttcaggagtaagggaaaggagcgtcccagaaaaatatccttcatcactgtcaatgccaggatttggtggcgtgcaggtgcaagcgcaaagtggaaggcataggaggaagaagaaaacaagcttcaaccaatacatcataaaaaacctcctataatgatagtgttttatattgtataacataataataacatagaattttaaaaaaacaactacttaaaaatattgacatataaagaaaagtatgattatatacaaaatatgagaaaaatctcaaagagcagagtatcagagtgaaaagtgaggagaacttatgaagaaactattatcatgtattgttgcgtgtgctatgatgataagcattttaggaataaatgcttatgcagcggagcgagagattcaatcagaggcaccgatgattacagaggaagtggcacagattattgcatcgtattttctgagagactatcaagatgaagcaggatgttgctgggacactaacactgcaattgttaacagtgtgataatgtacaatctggaggaagaaatttcggcttattcgtttgagttagcgacaagtggggtagagagtgggtatattgtagtatcggcttatccggatgttgagaatgtgatacttgagttttcggatactgctacgccagtatatgagccttttaacctgagtgttggtgaaaagattatatatacaggaggattaaactactttaaggagtctgtagatgggacattctttgcagtgaatggaaaaactcttcaaaagaatcaaatagaaacccccttagaaagtataagaagtgaaaagtatctgcccgcttcttttagagattatgaatatcctattaaggatcctatcgcttgggctaataaatattatgggggtccattctatgctaaatcctggaagaactctttcgaggattactgcgaattttggaggacatccgattttaaaacagtcaatggaactacatattcaagtcactgtggtccgacagcgattacaaatttaatcaggatggttggaaaatatcgaaatcattcaaaggtaacttccacatccggcaaggctatatttaaaacagttgcggactatggaaagtcaaaaggatattatacaagcaaaggaacaccacatgcaacaacagcaacttacataaaggattctttccaaaaatatgggatttcgacgagtgtcaaaaaaaacgttgcatatagtgggacaatcgttaatgcaataaatgcatataaaccgatctatttaacagtaacagggcactcttattatggtacacatgctgtagctgcgtatgcttatactcaattagtaagcgaaaaaacgggaagtgctaaaatctttgtcaagattgccgacgggtttgaaaaaacaggaagatatctttgtgcagatattttgtcaagcgaaaatatgtatgtcattaccattggcaatttaagttaacaactctgttatcataagaaccaaaaagccccctgcccggggtggactgctccataaaaaacgtacaatagacaaaaagccccctgatgtaggaaaataaaagtactacatcagggggaattgttatgtcaggcaaaaaaggaatgattcggtatagtgaagaaataaaagaacaggtacgcaaagaagttcaggcaggccaaagtcaaagagaaatcagccgcagatatggaatcagcggttatacggtacagagctggtgcggcctcaggcccgagacaaagctgaggcaggcggcacctttacgcaaaggccgaccgggcaaaataaagacaatagaggattatgaaaaggaaaataaacgtctgaagatggagaacgaattgctgcgggattttctgcgatccacagaaaggaagtgagcgcgaaggcaaagtacgcggtgatttaccgtcatcgagaacagtatccagtactcgtcatgtgccaattctttgcagtgtccagaagcggctattacagctttgtaaagcggatgaagcatcctgaaaagaatgcttcccttgcccagacaatccggcagcaacaagtcaaatgctttcatacctacggctaccgacggatgtggcaatggctggaacgaaatgtggggatccaccacaatccgaaaaccatcctccatgtcatgaagaaatatggcttgctggctgaaattcgccgccgcaggaagtggcagcagatgggccagcagctgcacaaataccagaatcttctcaaccggaattttcacgctgaggcaccgaaccacaaatgggtgactgatatttcctatattcaaaccaaacagggcgtattatatctgtccatggtccgggatctttatgacaacagcattgtggcttataagaccgcaacacagcagacggtgcacctggtgctggataccatccgccaggcaatgcttaaggagaaaaagagggtcgctgcagaactccacctccacagcgaccaagggttccagtacacctcccaattacactggtcatgggtagctggttcttttgaggaggaggcgtaggttctaatagatgttacaggctaaattctttcccgtagatcagggttccgtgaatgggacctgggttttcccacaagcagattgccatgagatggtcggaagggacccccttgggggcttcgatgtgaaaccgcgccgctggggcgtatccgaaccttgtataataagcccggcttcccaggaccagtacatacgaaaagcccaggcgcttggcgacggcatgcccgtccaggatgagggcccttccaatgccctgccgctggaattggggtttgacggacagcggggccagggcaagcaccgtggtgctgcccacatgggcttttgtcaataaaatatggcctacgatctcgccctgaacctcggcgacacgggacaaggcgggaacaaaggaaggccccgttcttaaagcggcgactaaatctgcctcatttccgtcagagtgctccgctgtcgcgaaggagtccgcaataaggtgatggaccgtctcatagtcctttggaagttcttgtctaagaatcatttttgtattccctcttttccgttctgcaggggggacagcgaagggctgtgatggaaaaaggcggccaatcccaaggattgaccgcctctgtcctgtttcagttgtgcaccacatgggtggatgatgagaggacggcggccgactggcccgcctttttctcctccgccgcccgccgcttggcgttggccagcatgagcttgatgcggttttcctggttgatcttggtggcgccggggtcgtaatccacggcgacaatgttggagtcagggtagtcgtctttcaggacccggatcatgcccttgcccacaatgtggttgggcaggcagccgaagggctgggcacagacgatgttgggggtgccggagtggatgagctccagcatctcggcggtgaggagccacccctcgcccattttgcacccgtcgttgaggtagccgtaaatcaactgatggagctcagcaaaggtgccgggggcccggaagccggagtttttcagggcgccgatcatgtccagctggcatttctccacatatcccatgaagaatttgcacagggcctgcttggcccggctgccgccaaacatctccacgtcggagacccggttgtaaatcttgaagatcagaaagtctgtcagaccggggaccaccggttcagccccttcgtccaggagaaactgctccagctggttgttgcccagggaggagaacttgatgtagatttcccccaccacgcccacccggaccttctcctcgccggtcacgggaatggacttgaaatccgcgcagatctcctcaaagatgccccgcatctttttccgggacataccctctccccggtcgaagcggttgagcagctcgctggtccagaattccaccttggcggtggtgtccccggcgctgacctcatagggccgcacctggttggccacgttcatgatgaggtccccgtacatcatgccgtagatcagccggcggatgagccccacggtccagtgaaagccggggttcttctccaggccaaaggagagggagaggacggggatatagtccagccccgccttttccagggccttgcggagcatgtggatgtagttggaggcccggcagcccccgccggtctgggtgatgagcagggccactttatgggggtcatagcctccgttctgaatggcgtcgatcatctggccgatgaccagcagtgcgggatagcaggcgtcgttgtgtacgtattttaagccgctgtccaccacggaccggccgtcgttgttgagaatggccacgtggtagccggtgcgttccaggagcttggcgaagaagccaaagtgtactggcagcatctgggggatgaggatggtgtactccttgcgcatctcctgggtaaacagcaggcggccagtctcgtcgtattccaattttgccatgggatcattggcctcctttctggttccgggcgtcccgggcatccagggcggccattaggctgcggatgcggattttcacggcgcccaggttggaaatgtcgtcgattttcagctgggtatacagctctccggcctcctccagaatggagcggagttcatcggtggtgatggcgtccaccccgcagccgaaggagaccagttggatgaaggccatgtcgggctgggtgcagacataccgggccgcgttgtacatccgggcgtggtaggtccactggttgagcacccggcggggctgtttgtccatgtgctggaacaccgcgtcctcagtgatgaggacaaagccgaaggaggtgatcaggtcgttgatgccgtggttgatctccgggtccatgtggtagggccgcccggccaccaccaaaattttccggccggtctcccgggcaaaggagatgtattcctcacccttcttctgcaccagccggcggaagtcctcgtaggcggcgtaggccttgcggatggccttgacagaggcccgcttgggaatcccaaactcggtctccagcagctgggcgcccttcttctcaaaatccttgggccggtgcaggcccaggttgggatggaggtatttgatgtcctccagggcggggatgtttacccccagcaggtcgggatagtaggccaccacgggacagttatagtggttgtccgacaaatgctcgtcgaagttataggacatacaggggtagaaaatggtgtcgatgccctcctccagcagggccatgatgtggccgtgaaggagcttggcagggtaacagaccgtatcagaggggatggtctgctgccccttgaggtacaggctccgggtggactccggggagaggaccacctcaaagttcaaagtggtgaacagggtgaaccagaaggggaggttctcatacatgttcagcccaaagggaatgccgatttttccccgggagccgtccccctcgcccttgccctggagggagcgaagatactggtacttgaatttcagcaggtcgggaatgtccactttctcctggcccaggggccgggaacagcggttgccagagatgaatttccgaccgccgtcaaagcggttgatggtcagggaacagtggttggtgcagagcttacaggtggcgggccgggcctcatgggtgaaggaggccagggcctcggcggacagcagggtggactgggtcagaccggcgtccttggcggccagggccgcgccataggcccccatcatgccggagatggtggggcgggtgacctcccggccaatctccagctcgaaggagcgcagcaccgcgtcgttgagaaaggtgccgccctggaccacaatgtgctggcccagatcatcggcgctggcggcccgaatgaccttgtagatggcgttctttaccacggagatggacagccccgcggagatgtcctccacagaggccccgtccttctgggcctgcttgacagaggagttcataaagaccgtgcaccgggaccccaagttcaccggatgccgggcgaacagccccatcttggagaagtcggcaatggtgtagcccagggccttggcgaaggtttcaatgaaagaaccacagccggaggagcaggcctcgttgaggaggatggagtccaccgcgccgttgcggatcttgaagcatttcatatcctggccgccgatgtcgatgataaagtccacatcaggggtaaagtgccgggcggcgttgagatgggccacggtttccaccaggcccaggtcgcaggagaaggcgtttttgatgaggtcttctccgtagccggtgaccgcggcgccctggatggtcacccggccgccgcactgggcataaatttcccgcagctggggcagaacgatgctgacggggtttccttggttggagtgataaaaagagtagagaagattgcagtccgggtcaatgagcaccattttggtggtggtggacccggcgtcaatgcctaagtaagccggcccggtgtaggtggccaggtccaccgtggggacggccatggcctggtgccgggcggaaaacgcctcgtagtcggcctgggaggtaaacagcgggtccatggtgtccaccggggtagagaccgtggccgcgtgctccagcaggtccaggagttcctcgaagggccggggctggctgtcctcggtgcacagggcggcgccgatggcggcgaagcagtcgccgtcttccgggaagatggcgtggtcctggtctaaatgcagggtctccacaaaccgttggcgcaggccggccaggaagtgaaggggaccgcccagaaagacaatggtgcccttgagctcccggccctgggtcaggccggccaccgtttggtccaccaccgcctgaaagatggaggcggccacgtcctccttgcgcccgccctggttgaggatgggctggatgtcgcttttggcaaagaccccgcaccgggaggcgatggggtaaattttttcatgccgcagggacagttcgtccagctcatccacggatacgttcagcagagtggccatctggtcgatgaaggctccggtgcccccggcgcaggagccgttcatccgctcctccagggtattgccgaagaaaatgattttggcgtcctctccccccagctcaatcacggcgtcggtaccgggaatgaactcccgtaccgcggcggcggtggcgtaaacctcctggacaaaatccaggcccgcggccttggccacgccaagtcccgcggagccggtaatgagcagttgaacctgttgtccccccagaaggccccggagtccccgcagggtctcacaggtgcgctcccgggttttggaatagtgacgctcataggagcggaagagcagtttattttgtgcatccagcaccacgaccttaacggtggtggagccgatgtcgattccgatacgcaatgccatgatctcacctcgaaatggaacgtgcgtttgcagcctctttttatatatatttaatgtgcgttccctattataacgtacactttgtcgaaaaacaacagaaaacttgtgccagaggtgagagagaatcacaaggaaaaattagaaaaatgccccaagggactcaggaaaggggggagaggaccagctgaccgcccttttcctccaggtacagggtttctcccggggcgatgtcctcccggagcagcagctccgccgcggggttttccacctggttccgaatcagccggcggaggggacgggcgccgtaccgggggtccagccccttttgggccagcagccggatggcctggtccgaggggagaaagtccaccccagtggcggccaggcgctgggcgaagccggacaggagtttccgggcaatggtgtccatctctcccgcgcccagggggcggaagcggacgatctcatccagccggttgagaaactccggccggaagacctggcgaagttcccgctggagagcggcggtctctgccgcgtcggaggcctctcccgtggaaaagcccaagggcgtgccggcggagagccgttccccgcccacgttggaggtcatcacaatgacggtgttgcggaagtccgcccgcttgccgtgggcgtcggtgagcaccccgtcctccatgatctggagcagaaggctccacacgtcggggtgggctttctccagctcgtcgaacaggagaaccgagtagggatgccgccggaccgattcggtgagctggccgccatcctcatgtcccacataaccagggggagagccggtgaggcggctcatggtgtgcttttcggagaactccgtcatgtcgaaccggagcagggcctcctccgtgccgaagagcacctgggccaaggccttgcacagctcggtctttcccacgccggtggggcccaggaagaggaaggcgcccaccgggcggtcaggctccttgagccctgcccggccccggcggatggcccgggccacggcggccaccgcctcctcctggccggtgacccggcggcgcaggtcgttctccaggtccaaaagacgctgcttttccgacttggtcaggcaggtgaggggaatcccggtccactgggagaccgtctgggccacgtcctgggcggtgaccacgggatctttctgcccggcctgccagcggaagcgttccagttccaactcccggcggaagtcggactcggcgtctcggtactgggcggctttctcgtagtcctggccggcaatggcgtcgtcccgttcccgggcggcggactgtacccgccgctccagggccttgagctccgccgggggctccagggcctgcagccgggcctgggaggccgcctcgtccagcaggtcgatggccttgtcgggcaggcgccggtccgggagataccgcaccgagagagagacggcggcctccaaggcggcaggttcaaaggtcaggccatggtggtggcagtagcggggggtgagggtgtgcagaatctccagggtggtctcctggctgggctcctccacccgaaccggctggaaccgccgctccagggcggcgtctttttcgatgaaccggcggtactcctccgtggtggtggcgccgatgagctgaatgccgccccgggccagggcgggtttgatgatgttggccgcgtcaatggccccctcggcgctgccggcgccgatgatggtgtgcagctcatccaggaagaggatgacgttccccgcccgggcgacctcgcccagaatgtttttcatgcgctcctcaaattccccccggtacttggttccggcgatgacggagggcaggtccagggccagcagccgtttctggcggagggcgtcggggacctgccccagcgccattttctgggccagaccctcggccacggcggttttgcccaccccgggctcccccaggaggacggggttgtttttcccccggcggatgaggatttggatgacccggcgaatctcctcctcccggccggtgacggggtcatagccgccgcggccggcggtctggaccatgtcccgggcgtgctggtccagcagccgggtggcgggggaggaggcgggcggcgcgtagtccgcctctccccgggcgcggggatagtaggacccgctcccgcccagggagagggcggtctgccggtagagctggttggggtggaggccggcctgaaccaacagcttgatcccgcctccggtcccctgccggagcaggcccagcagcagatggcggctgcccacctggtcgtggctcaggcgctgggcctcggccacggcggcctccacaatgcgttccaggcggggggtcaggggccggcggcaggccaggggcgtgccggtgcccagggcggtgaccaacaggttttgcagattccgccgggtgagaccctgggcggagagaatgcgggcggcggtgctccgggattcctggagcagacccagcagcaggtgttcgctgcctacgtaatcatgtcccaggcgctgggacagggccccggcggctcctaagctgccctgggcgtgggcggtgaaggttacggttttgatggggaaccctcctctctgggccctggggtgttctccccctggggcggcgaaatgacggggatgcttcggttttcgtggctggcggagcagggggctccttccagggccggggtcagggtgccggcggccgggggattcgagatgttttgcatagagaaaatccttccaaggtgttttttagggccaaagtccataaaaatcatgcccgaaatctataaaaataaccaaaaaatttctatgattttagaattgcattttttagaaaatgtgatacaatgtagcctgccaagaaaaaattattggaggtacctaactatgtacgctatcaatcccgaactgtgcaccttctgcaagaaatgtatggaagaatgtcccagcggcgccatcactgagggctccgtggatggcaaggaagtttgcgttgtgaacgcggattgcatcgactgcggcggctgcgaggacgcttgcgagaccgagcccaaggcaatcggctacaaggagtaatttttatcccccaaccgaaagaaaagacgagcgtaccggaggcagattcggcacgctcgttttttatagggaaaaggtggaaccatgtttttttccacaggaagccttggaatctggcgctttctgggggagggagagggccggttttggttgagattttctcccggttatgttataatctataaaatataccagaatgtctccgctggaagaggaaggagtcccttccagcgtgtttttgttggggaaaggagcgcctatgaaaattgttgtgctggccggaggactgagcccggagagaaatgtctcgctgtcctcgggcaccatgatcgcccatgccctgcgggggctggggcaccaggcggccctggtggatatgtacttcggcctggaggcatacacgggccctgtggcggactattttgacgcccccctcaccgaccagtggaagcaggtggaccccaaagcaccggacctggcggagattcgggccgcccggaagtggcagagccccagccagtttggccagggcgtgctggagctctgccagatggcggacatcgtctttctggctctccacgggacctgcggggaggacggacgggtacaggccgcctttgatctcatgggcattccctacacgggggcgggttatctgggttccggcctggccatggacaaggacctgaccaagcgtctgattgcccacttaggggtgcataccccccagtggcagcgggtgagctacaccgaacaggaggtggaggacctggccgcggccacccaggtgccctgcgtggtgaagccggtggccagcggttcttccatcggcgtgtccatcgcccacaccaggcaggagctccacggggccctgatggagggactccgcttcggcggccagtgcgtgctggagcagtatgtggccggccgggagattcaggtggccattctggccggacaggcgctgccctccattgagattatccccaaagagggattttatgattatgaaaacaagtatcagcccggcgcggcagaggaggtctgccccgcccccatcccccccgcgtgggaacagcgggtggggcaggcggccctgacggtttaccacgccctggggctgtcggtctattcccgggctgacttcattgtggaccaggaggggaccccctggttcctggagatcaacaccctgccggggatgacccccaccagcctggtgccccaggaggccgcggcggtgggcattgactatgccagcctgtgccagcggatcattgaggagtctctccgggtgcggaagggctgagagaccaacagaaaaaaggagaacgcgcaatggaacctatgacagtcagggagcttttgaccgccaccggcggaaggctcttgggagaggaagctgtggcggagaggaccatcacaggcgtggagacagacagccgggccgtccacgagggagaccttttcgtggccctgcggggagagcggacagacgggcaccggtatattgccagtgcgctggagaccggcgccgccggctgcctgaccgaggaggtcccccaagtgctgctgcctggaaagttctatatccaggtggaggacaccatgctggccattggccaggtggccagggcgtatagagagaagtttcccatccccgtcatcggcatcactggcagcgtaggcaaaaccaccaccaaggacatggtggcctcggtattggggcagaagttccgggttttgaaaacggagggaaacttcaacaacgagctgggtcttcccctgaccctgttccgtctgacggcccagcaccagatctgtgtgctggagatggggatgaatcacttcggggagatcgactatctgacccagattgccccccctgatgtggcggtgatcaccaacatcggcgacgcccacattgaaaacctgggcagccgggcgggcattttgcaggcgaagaaggaaattttccaccggatgacgccggaggggatggcagtcctcaacggggacgacgccatgctccgccctctggagggagaactctctccccaggtggtgttctgcggggcggaccgaccggccccctatgcggcgaaggaaatccgacagctggggtccaaggggctgcgctgccgggtgattaccccgaagaacgacttttcggtgaccgtgcccgcgttgggcggccacatgatctacccggtgctcatggcctgcgccattggggagcggttcggcatgaccggggaggagatgaaggcggggattgaggcctttgtccccaccaagatgcggatgaatgtgattcaccagggggatatcaccattctggacgacgcttacaacgccaacccccagtccatgcgggcggccctggaaatcctctcccagaccgagggcgcctatcgggcggcggtattgggggatatgtttgagctgggggacctgggcccggaactccaccggagcatgggggagtgcgccggcgcgctgggcaacattgacggcctgctggccgtgggggagctggcctggaatatctatgacgcggctcaccagtccggtatcacccaggcgctgtatgccagggaccggacggcggccaaagagcttctgcccaacctggtccggccgggggcggtgatcctggttaaagcctcccggggcatggcctttgaggagctcactcgggaaatccagcgcctggcccccaaggcataaaaaggccgggtccgaagacccggccaaactcaggaaggttctgctctttcccaagaagtttgggaaagaatttaagccattaagcatcaaagtggacgatcatctttcggggggcatgctttacctgttcttccaaggtctcctcataaggagcacaggcgatgccccggtcggtgatcatgccggtgatgagaaaggcggggaccacgtcataggcgggggtccatccctgggcctgtccgcagtccagaccctctgtcacggcggcgggatcgccttcctcctgcccgaaaacagagccgttttccgcggtcaggtcaatgtcgtcggcatggagcacggcgtagaagggaaccgagtggaagtagcaggcgatggccagttcataggttcccaccggagctttcagatccccgtttttcgcagccagaattccgtcggccagcaccaaatgggccccttggcgggccaggaaggtggcggcggcgtggtcggggatgagggtgcaggggacgttttccttggacagctcctgggccagcagcgtgccggcggccagggaggggcggccctcgcagagggtgacctgctccagcacatcccgcttccagccccggcgggcgatgcccagggccccgcagggagaggcggagtggaaggctccccggtcggttcggaggagaaggcgggtcccctcccccatgaggtcggtgccgttgcggcagatgttccggtcggcgatgacctgctgccggtcataggtgacagcggtggccagcagagtggtcagttggtccacgtttttggtataggcttctggcgggtgctccataaaatccagggcggcggccagctcccgggagccggggcggctggccaggagcagggccttggcctggtccagtttctcctgaaactggggggtctgctggagttcctggtgggccatggcggccagacagtagccgtagaccccagccaccgcagcgatcttctcctccaaaatggcgccggaggagagggcttgggcggtctcctccacggtggagcaggtgatccagtgctcctgctgcgggtaggccgcctggtccaaaagggacaggacgccgtcctgccactgaagtgaaatcatacgtaatgcctcctattctgggtgttccccgccagagcgggaaacaccggctgcttggcgttatcatatcatacttccgggcacagcgccactcccaatggaaaaaacttgggggatggggctgattgggcccgaaaacagaggaacaggattcatgattgacattgcggtacgagacctaaagaaagaatatgaggtgggccagccggtgctggatgggctcacctttcaggtggacaccggcgagcgggtgggcatcctgggcagaaacggggcgggaaagaccacccttttccgtatcctcaccggccaggaggaagccgacagcggcgaggtgatcctctccccgggcaaacgcctggggctgatctcccagattcccgtctatcccgccgggtatacggtggaggatgtgctgcgcacagcctttgatgacctgaaggccatggaggccgagctccatcagatttcagaccagctgggcagcggggacaaggacctgctggcccggtatgaccggctgcaggcggcctatgaggcggggggcggctatgagatcgagacccggctggagaaaatctgcgccggtctgggcattgagcgggccttccgggacaaaaactttgccgatctctccgggggagagaaaacccggatcaacctggcccgtttgatcctggtggacacggagatcctgctgctggacgagcccaccaaccacctggacctgaatgccacggtttggctggaggactacatcagccattataaggggaccgttttggtgatctcccacgaccggtattttttggacagaaccatctcccgggtggtggagctgaagaacggccgggcggagttttacgccggcaactactccttctacgcggtggagaaggaacggcggtacttagagcagctgcgccagtacaaaaaagagcaggcagagatccaacgcctgtcggagacggcgcggatcatgcacgagcacaacaccgagcacttgaacaagcgggccttttccattgaaaaacggattgcccggctgaaccagaccgcccgtccagaggagcggaagaaattaaaggccaagtttggccaggcggagtttcacgccgacgatcttctttccctgcgggaggtgaataaggccttcggcagccaggttctctttgaccatgtgaccctccgggtggaggatggggaccgcatcgccctgctgggggacaatggggcgggaaagtccaccctgctgaagatcatcctgggggaggagccccaggacggtggcacggtgaagcaggggctcaccgtaaaggtgggttacctgccccagcagattcgattttcccacccggagcgcagcctctacgacaccatgctctacgaggcggggtgcaatgcccagcaggcccgggaccgtctggggaaattcctgttccagggggaggatgtgtttaagcccgtctccgtgctctccggcggggagcagagccgtctgcggctgtgcatgctcatggatgagaaggtgaacttcctgattttggacgagcccaccaaccatctggacctggactcccgggagtggatcgaggaggcggtggaggaattctccgggacccttctctttgtctcccacgaccggtacttcattgaccggtttgccaaccggatttggaccctggaaggggggaaaatccaggatttccggggggattacacggcctatcaggcctatcgggagcggcaaaaggcgctgactccgtcccccaagaaagaggagaaagcaaaaaaggagaaacccaaacggtccgggggcaccaaacagctgaaaaaggagctggccgccgcggagaagcggatggaaaagctggatcagttgctggaggccctcaatgtccaaaaggaggctgcggcctccgactaccaaaagctccaggagctgctccagcaggaggcggcgtacaacgcggagtacgatgccctgatggagacctgggaaaccctgtccgaggccattgcggcagaggaagggacatgacccctgcacccgatgaacgatagaaaggagaaaacacagtatgtctgagaaagaaaccaaccgccgtcccgaggcgtccaccgaggacaagatgcaggagctcttccgcctgatggacgagaaagcggcccagggaaccctggtggagaccgaggaggatgtctctgcccagaaggagaaggtggataccaccccgctgtctgagagtgagaccgcggcctttgagtacaacatgatgatgatgcagtatgaggccatgctcctggattatcagcgccgggaggcagaggaacaggcccagaaaaaggcggagcaggaagcgcgggagcaggggtcgtaatgtgggaacagctgaaccaggccgcccttcggctggaggagctggagacccagctggcccagccggagacctatgagaacccggacctggtggcggccctgaaccgggagcaaaaggagctgacccctctggtggagaccttccatcattaccaaggggcccagcgggagctggcggggcttacagacctgctctccgacccggagtgccgccagctggcccgggcggagtacgaccaggtgaaggcgcagctggaccagctggagcagaccctccgccagatgcttctgcccaaggaccctatggacggaaagaacgtctttctggagatccgtgcgggggtggggggagaggaggcggccctttttgcggcggacctctaccgaatgtacgccatgtacggggagaagcagggctggaagctggagctggacaacgtcagccaaacggaactggggggcatcaaggaactgtcctgcctggtggagggggagagcgcctatgccaagctcaagcatgagagcggcgtccaccgggtccagcgggtgccggaaaccgagtccgggggacgcatccacacctccacctgcactgtggcggtccttcctcaggtggacgaggtggagtttcagctgaacccggcggacctgcggattgacaccttccgggcctccggggccggggggcagcacatcaacaagacggagtccgccatccgggtgacccacctgcccaccggaaccgtggtggagtgccaggaccagcggagccagtataagaacaaggaccgggccctgtccatcctccgggcccgcctgtatgagcaggcgatccaggagcaggcccaggctgtggctggccagcgccggagccaggtggggtccggcatgcggaatgagcggattcggacctacaatttcccccagggccgggtgacagaccatcgaatcggcctgaccctctataagctggacgcggtgatgaatggcgagctggaggagctggtggagggcctgagcctggccgagcagagggagagactgaaaaggagtgaagacggatgaacagccggaaaaccatacgttacaccatggaggatgtggccccagcggtggccatgctgcagaagggcgggctggtggccctgcccacggagacggtgtacggcctggccgtgaacgcggagaacagcgccgcggtgtgggttctctatgaggtcaagcagcgggagcgggaaaaggccctctcggtcctggtgacgggtatggagatggtggagaattactgccagaacatcccgccccaggcttatgccctggcggagcactactggccggggcccctgaccatgattttagaggacaaaggggtggtctctgccctggtcaatgacgggtcggggaccctgggggtccgctgcccggaccacccgctgacccaggccattctccgccaggccggcgtggccctggcggccccctccgccaacccctcggaccagcccagccccaaaaccgcccaggaggtgctggactattttgacgggcacattgaggggatcgtggacggcggcccctgccgggtgggggtggagtctaccatcgtggacctcaccgggccggcgccccagatcctccgggaggggggcatccccggtcaggaactcctggactttttgaaaggactggggtaagccatgaaagtcattggaatcacaggccccaccggcgcgggaaagaccaccgcgctgaacgccctgcgaagcttaggagggcagatcattgacgccgatgccgtgtaccacgatctgacccggtcctctcccgccctgcgggcggagctggaggcccggtttggcccggtgtacaacggggaaaccctggaccggaagaagctgggcgcggtggtctttcaggaccagaaggccctggcggacctgaacgccatcacccataaatatgtggcccaggaaaccgcccgccgcattgcggcggcccgtcaggcgggggttcccgcagtgggcattgacgccatcgccctgctggagagccctctggcggcctactgtgaccgtaccctggccatcaccgcgccggaggaactccgggtgaagcggatcatggcccgggagggaatttccgaggactatgcccggatgcgggtggcggcccagaagcccagtgcctggttccaggcgcactgtgatgataccttggagagcaccgagaccgacacggtggagacctttgcccagcgggctcgggcacttttccaacagatgttagaggagagcaaataatggacgagaaaaaagaaccgacgctgctccagcagcggaaaaaagacctcttcttcgctcccaccaacggttatgaccgtctggccccgggggaggaggaggacatccaggcctattgcgccggctataagacctttttggatgagggcaagaccgagcgggagtgcgtggactatgccatcggcctggcggaagccgccgggttccgccccctggtccggggggagaaactccggcccggggacaaggtgtaccggaacaaccggggcaagtccctcctgctggcggtgatcggccaggagagcctgaaccagggggcggtgatcggggcggcccacatcgactccccccgcctggacctgaagcagaatcctctgtatgaggagaaggagatggcctactgcaaaacccactattatggggggatcaagaagtatcagtggaccaccattcccctggccctccacggagtggtggtgcgccgggacggcaccgtggtgccggtgcgcattggagaggcgccgggagacccccagttcaccgtgggagacctgctgccccatctggccggcgaccaggcaaagaagaccatggggtccatcgtctccgccgagcagctgaacctctttgtgggcagccgcccctttggcaccgaagaggggagtgaccgggtgaagctggccatgctggagattctccaggagaaatacggcatggtggaggaggacttcctgtccgccgagctcatggcggtgccggcggccaaggcagtggacatcggcctggaccgttcggtgatcggcgcctatggacaggatgaccgggtgtgtgcctacgcctgcctccaggccctgctggagctggagggagcgccccggctgactggcgtatgtgtgctggcggacaaggaggagatcggctccctgggggtcaccggtatgcagtcagcggcctttgatatctttatgagcgatctgtgcgacagccagggggccgccctgaaggcctgctacgagaatgccttctgcctctccgcagacgtgacagcggcctatgatcccaactttgcagaggcctatgaggtgcgcaacagcgcgtttctcaactacggtgtctgcctcagtaagtacacgggggcccggggcaagtccggggcctctgacgcctccgcggaggtggtgggaaaggtccggcggatttttgaagagaaccaggtgatctggcagctggcggaactgggcaagacggaccagggcggcggcggcaccgtggcctgctacatggccaaccgaaacattgacaccatcgacgccggggtgcccgtgctctccatgcacgcgccctttgagaccacggccaagctggactgctacatgacctacaaggccatgaaggccctgtacacccactgagagagaaagaggtagatccatttgagtgtcctttcatccattttcctggggctggttcagggcgtggcggagtttttgcccatctccagttccggccacctgtctctgttccagaacttcttcgggctggtgtccgcggaggggagcctgttttttgacgtgctcctccatttgggcaccctgattgctgtctttgtctactactggaaggacattgtggcgttggtgaaggagtttttccatctcatcgcctgcgtgttctcccgggagaaacggaggcagatgaagcgactgccccccaacgggcggctgatcctgatgatcattgtggctacccttcccctgtttgtcatcctgcccatcaaggataaggtggaagggctgtacggcaacaccatttttgtgggctgcgccctggcggtgaccggctgcatcctcttcttctcagaccggatggcccggggcaagaaggggcccaagtctgccaccatgctggatgctctgctggtgggcgtgggccaggcggtggcggtggtgcccggcctctcccggtcggggaccaccatctcggcggggatgatgcgggggtttcaccggcggttcgcggtgcggttttccttcctgctgtccatcccagcggtgctgggggccaatattctgagcattggagaggctgtgcgggaggggattgacgtgtccctgctgccggcctacattgtgggcaccctggtggcggccgtgtccggctattttgccattcgtttggtgaatctgctggctgacaaaggcaagtttggcaacttcgcttactactgctggggcatcggcgccgcagcggtggtggccagcctgatctttcgctgatccataacccaaagcaaggagggaagtatggcttccacgcaaaagaaaacggcaaacacgaaaaaacagaccacggggaaaaagcccaacggcacccggaaaaagcccccggcctatgttccggacctgatggcccgggggattggcgcggcggtgtgcctcttcctggcccttatggtggtgctgggaatggttggcatacacgcggtggtccccgatctgctgtgccgcggcatccgcggcctcgttggctatggcttttggctgaccgccctggcgctgttctgggcggcgggcctgctgctgcttcggcgggaaaggcgggctaccctgcggctctggtgcctgggcctgctgccggtggtgggcggtgcgttcctccatgtgctgctctcgccccggcagccttccctggggattgatctggcaagccggctctggaacgatggggtctatggctttggcggcggtgtgatcagcggcgggctggcggtgtttggcaccatgggcttcagccgggtgggggcaggggtgatctttgccctggcctttctggcactgctggcgggcgcgggccatctgaccccgccgaaggttttgcgggcactgagccgtctgcgggagcaccgggcacagcggcgctatgaggacgaggcctactatgaggaggaggactacgaggactacggcgatccaagggaggaagcgcagagggaagcccccctctctcagggcggtttttggcccatcaaccggcggaaacgggcgcctgacctgcccttggatgacctgcccgccgccaagcagcgaaccggcaccccgccccaggagaaggggaaaaagccggccccggcggcgcccgccgcggcgcaggtgctgcgggaagaggaggaaaagcccccccttttccagccggaaagccatgtaaagcggccggatgaggttttggaagagctgacccaggaggcggaagcgccggcctggaagctggcggaggacgcgccggtatggcagccccccggggagccaaagcccccgacacgggcccaacgccaggcggccattgagaaggaggcccaggaggtcacccagaccattgcccggagcctggaggaggacgcccccagagcttatgtctatccctctctggacctgctgacccagcccagcggcgacagtgcccgggcggcccatgaggaactggaggggaccctggaccggctgtccagcgtgctcaactccttcggcattgacggccatgtgaccggggcggtgcaggggccctcagtgacccggtatgaggtggcgctggaacagggggtacggctgaataagctcaccaacctctctgacgatgtggccctggcgctgggggtctccagcgtgcggattgccccagtgccggggaaaatctctgtggtgggcattgaggtgcccaacaaagttgtcatcccggtacccattcgggaggtgctggattccccggctttccgccggcacaagtccagtgtggccttctccgtgggcaaggacatcggcggcaactatatcgtgggggactgctccaagctgccccacatgctcattgccggcaccacagggtctggtaagtcggtgtgcattaactccctgctcatcagtatgctctataaatccaccccggaggaactccgcctgattatggtggaccccaagatggtggagctggggggatacaacggcatcccccatctgctgatccctgtggtgaccgaccccaagaaggccgccggcgccctccaatgggcggtgacggagatgatgaagcggtaccgcctgtttgcggaggccggggtgcgggagctctcctcctacaaccagtgggccaagggacaggagggggtggacaccatgcccaaggtggtcatcgtcattgacgagctggccgacctgatgctggtggcggccaaggaggtggaggagtccatctgccgggtggctcagatgggccgtgccgccggcatgcacctggtcattgccacccagcgcccctcggcggacgtcatcaccggcctgatgaaggccaacatcccctcccggatcgccttcgcggtggcctcctccctggagtctcggatcatcctggacaacaccggggcggaaaagctggtgggcaagggggatatgctctggtttcccctgggttccggcaagcctctgcgggtccagggctgcttcatctctgatgaggaggtggcggcggtggtggacagcgtcaagcagaatgccgctgccgagtatgacgatgaggtgatggcgcagatcgagcagcacgtcaccgaatcggagaaaaaaggcaagtccgccggcggcgccttccccgccggcgaggcgggggaggaggagcaggatgagctcttccccgccggtgtggatgtgattttggacctgggacaggcttcggtctccctgctccagcgccggctgaagctgggctatgcccgggcggcccgtctgatggaccagatggaggagaaggggatcgtgggaccctctgagggctccaagccccggcagattctcatcaccaaggaccagtgggtccagatgcagagcggcggagaccccacgcccccggaggcggctccccctgtggaggaggaaatcctaacctttgatcccgtcccgccccactatgaggaatgaccaagcgccgtgaaccaggcaggttcacggcgcttttggcggaatgcctggggaaaaagttgattttttggaagaaaagcatgccctaccgattgaaaaaaaagggataactgctataatgttctatatactctgtttagtacttgcaaagatgaggtctgtaccatgtgctttgacgatccgatctatctggaccggggctcctttgaggaccttatggttgataccgatcagcacaggatctgttggatgtaccacgacatactgtcccaccccaggatcgcctggctgtttgacaaatatgccggaaaaggaacacccatccgcgaagcatggacaactatggcctgggtggctgcggggtaccaggaggacagcttttaccttttatttaagtggtatgaggatttctacgacccgccccagcgcagtgatctctattttgtggaacgggaaggacccgatggtgagattcgggtccgttttttgaaccgggattttcagaacaagctggaacggagagagctggcctggtgcgagagcttccccgtccgcgtcagccagaacgccagctatttttttggcgacagcaagtttgacgccaatccggtgggacggattctccagctgctgggccgaaacgccggacgggagctggagtgttttgactggtattttggccggcgcagcgacggggagaagtcccggctgtgtgccaccattgcggcctatttccgcagtgtgcaggccattcgggagatccttttcagcctggtggccagcgacggcaagacgccggagggaagccgccacatgcgcgccgatgatctgctggaaatcttgaagccggtctccgcccagattgatgaggaacgcctacccgccctggggaggctgttccaggacctggcggatggcttttttgacgaacccagccgcgccccctacctcagccggggggcgggccgggccttgaccgaccgcacggagaccggggaacttcgctggctgcggctgggcagacagagcggccgccggctcctccgggagctgtacagccgctgcgccccccggagtgtgtgggatgtgttccaccggtggcagggggaggtttactacaccgttctccgccgcccgctgtcccaggatttgccccggggggtctaccttctctcccggtttgaggaccagaccggcctggatgtcaccggcctgttctggctggagaatgtcactgtgggggtggcgcatctgtgcaagggggagttttttgaggaactgctggacctcctcctctcccggcccacccgggaggccgcgctgcctgccgcccggcccagggaggagaccatggtcagcggatacagctacctgcttcaggaggcctttgaacaatacggccggggcatgggctgaggccgccggaaaaaggaggagagcctttgaaaaccgcagtcgttacagacggaaaataccgcgcctccctggccgcggtccgggcgctgggagaggcgggctttcgggtggttgtgacccagacccgggcagaggccactgtcacgccggcctcctttgtctcccgctttgccgcggagacccggtggattcccggctcctgccgggaggcggactacggcacccgcctgcgggagctgctggaggcctatgaccaccctgttctcttctgtaccggggcggacaccctcaacctggtcagcagccggcgggaggagctggcccgggcggcggactttctggtggcgccgcagccggtgctggatgccctgaacgacaaggagaccgtccaccggcgggcggtggaactggggcttccagtcccccgggaatatgacgaaatgcccgaccggtttcccgtggtcatcaagccccactgcggggagaaggcgggccttaaggccagggaccggtatcagatcgcccgggacccaggcgagtatgcccggcagtacgcggccatgcgccgctatgacccgtcccccattgtgcaggaaaaggtagaggggccgggagagggggtcaacctgcttctggatcaaagcagccggctggtgtgcgccttctgccaccggcggctgcgggagtatccggttacggggggaccgtccacctgctgcgtcagcttttatgaggagaccatgatccgtcaggcctaccagctgctggcctcctttggctttgtgggcatggccatggtggagttcaaggggggacgggtgctggaggtgaacccacgggtgtgggggagctttcccatgagcacctgctgcggcagcccctttaccgccctgtatgcccgggcggcccagggggagaccctctcctacatgccggaggactaccaagtgggggtgaagatgcgctaccttttccatgatggcgcggccaccctgggctatctccggcagggggactggcggcgggccctggctggggtggcggacttcttccgcaccccggaggccctgtaccgcaaggacgacaagggggcctatcgggcctacctccgcaacagcctgaaaggcagatgatatgagactgacactggatttgcacctccactcccaggcctccccggacggacggatgacggtggaggagattgccgccgccgcccgggccagagggctgcacggggtggcggtctgtgaccacgacgtggtctacacagggcccacggaggtggacggcgttctgctgattccgggggtggagttctccacggaacacggccaccttctgggcctgtttgtccgccagcccatggtctataccacctgggaggagaccacccaggccgtccgccggctggggggactgacggtgctggcccatccctttcagcaccggaaggaggaggggaaactggtgcctctggttccctatctggatgggatggagacctggaatggccgggccaaccggaagaatccccaggccaacgcccaggccgcggcctttgccaaggactatgggctgatccccacagcgggaagcgatgcccatctggcccaggagattggcaacgggaccatcaccgtggaggctgcggacaggaccctccccgccattcggacggcgctcctggacggaaagggctggattaccggggaggaaggctcctccctctgcgttgcccggagccaatataccaagttgaaaaagacccatgccccccctctgcgctatggaaggtgggcggcgttcgccctgaaatgtgcctgggaggatctcagaagaacgcggaggaaaggagaataatggcatgtccttaatcgtaaaagtgggaaaggcgggcaagcgcgttgtcaagaagttcttgcctgaggagaagcaccatgtgagctacacccggcggatagaacgggtgaagaccagggagcgggtggtggccatgaccttcgacgatggtcccatggacctgccctccagccccgataaatttgacggaaaggccctgaccgacatcctcctggacacgctgggggagtatggagcccagggcaccttcgacgtggtgggggacaccagtgaaaactatcctgacacagctggcaaaagcggccaggcggactggggcggcgtgcggtatgaccactacccggacatcaaccaggacgagcggggcggcgcggtgcacaaccagcggctgctccgccggatgctggacgaggggcaccaggtgaccaaccacgggtaccgccacgtcctgtttgggaaaaagccctttgtctacggcaaacgggaccatttccacggcttggaccaggtggtgtccgacctgacccgtctgcacaccctgctgaaggagacctacggttatgagatgaccatggcccgcccgccccactatgtggataagatcgaggggggctttaccagctacgatgcctatgaccagatgggatacctctatctggccgctgcctttgacggggcgggttggctgccgctgcaccacggctcggcccaggagagcctgcgggcggaggtggaggccatggtggaccccatgcggaaggtgctggaggcggaccccgacggattggccggtcaaatcattttccagaaagacggctacaacatgtgccgccggaccccggtggcctttggcttaaaaaagcagctggagctgctgaagaagtatggttatcaggtggtcaccgtccagcggctcatggagtacagcccctttgccgatgtgggccgggaagaccccggctttgaaaagctggtccgcctccagaagacccgggggattgtctactcagacaaccggctgcggctggacgcccctatgacctggggggaactggcgatgctgctggccccccggggggaggccattgaccgccggattcagaaaatccgggagaccggcacagcccagcacgccaactggggcgccatggactggtgcgccgagcaggggattctgaagtacgccatggacccggatggggcggtgagcagcctgcccagcgcatattttgccccggccaagggctttacccgccggcaggtctacgaggcctttcgggagtgagccgcagggccggggcggagacagaaagacggaacgtgacaggagggatcgcaatggagtttatcaagctgagcctggaggaagaactggcggtggtcaccattgaccgccccaaaagcctgaacgccctgaacagtcaggtctatcgggagatcattgccaccctgcggcaggtggaggccatggaccaggttaaggtggttatcctcaccggggcaggggagaaggcctttgccgcgggggcagacattgcccagatggtccacgaggacgccgtggcgggccgccgcctgtcggggctgtgccatgaggcggcaaacctgctggagtccatgcggcaggtgaccattgctgcggtcaacgggtttgccctggggggcggctgtgagctgaccctggcctgtgaccttcgcattgctgccgaccacgcccggttcgccctgcccgaggtcaccttgggcatcattcccggcggcggcggcacccagcgtctggcgcggatcatcggagtgggacgggccaaggagctgatcttcaccggggaccagattgacgcccaggaggcctaccgcctggggctggccaaccatgtggtgccccgggacgaattgatggagacctgccgggccctgggaaagaagattgcctcccgggccagctatgccgtttttctggccaagaccgccatcaattccagccaggaaattgacctgaaaaacggcgcggagcgggagaaggatttgctgggcctggccttcgccacccgggataaacaggagggaatggaggcgtttttggcccgccggcccccgcgttttcaggatttttaagggcagaaaaaaagttgcccaatttggaaccccttgagaatcaaggactttttgaaaaattttggaccgatcccccagggatcggtccttatttttgtgaatggtaacgaaatcgtgtcttaaaattaacaaattggttacaaaaataaacgaagcagtgacaaagagtataaaaatgggtaacaattagaaacaaaaatttggacaatcctgctaaagcggcggcggatttttaccggtttcctccgattccgggaatttgccaaggggggcggccttcgtgtataatgccccctgcaagcgccgccggggccgagagagagaaggacccggcagcacgaagaagccaggagagcacgccggagcgccgccggacacgggcgcttgaagagcggcggcgggggtgctttccgtgacgacaggagtttatgatgaaaaagtttttgattgcaaccctactgtgtatggcgctgaccgtgaccatggtccctatggcctttgctgcggacagcaactataccgaatgcatggctgcgattcaggagcagcgcaccatccaggaccaggcccatcagacggccgagtccctgcgcaagaaggggtattccgacagcagcgcctatgtgcaggcggccaaaagcacctggaacgaggcgcagaaggccattgcgggctatcagaagctggcccagtacagcgacgaagatatccgcatcctgaccaccaccgtcttccatgaggcgggccacaccacggagcagctgcggcagtatgtggcccaggtggtgctcaaccgggtggaggacagccggttccccgacacggtgaagggggtcatcacccagcccggccagtattccaccaagtatgccacagtggaggcggccaacgccatccaggccacggacagtaagaatggtacctactattatggcatctgtgaggattctgtgaaggcggccatgatgggccaggtggagatgcccagcaacgtgctctaccaggccaacttctcccagggtaagggcgtgtggaagtccgtctacttcaacagcggatggtatgccagcaccagctatttctgctacggctaaaagttacaagaaatgacaaattcataacgacaagatacaagccccctggattcctccagggggcttgtatcttggaacagcggggggatcagtctggaggaagaatctccaggatgtggccgtcggggtcttggatgaagtagatgccgttggccagttcatcaaagatcagccccatggcttggtgcttggccttcaggccctggaagtcctgggacacgagggccacatggggggtgtcatcccccaggcggtagggctcggtccgctggagctcccggcagagctccagctggaacggggtgacgccgtcgcccaggaagaccaggtgccagccccggtcctccatggtcagctcccgctggggcgtgagtcccagggtctcccggtaaaaggcgacgctgcgcgccaagtccagaacccggacgcaggcatggctcagtgtgggcatgggaaggtccctccttgcgtaagatagattctttttcattgtagcacaggctcgcgcccagggcaaattttttgaaaaaggggaaattcccctatgcaaaagggggaaaatggggtatgataagggcaactatgaaggagattcccccttcggcggaaggggagccatagaatcacgatccaaagggagggtaacccatgaaactgacctttttcggcgcggccaaagccgtcaccggcagctgccactgtgtagaggtgcgggggaagaagattctcattgactgcggcctgcagcagggccgggatgagcgggacaatgccgtgtttgatttttcccccaactatatcgactatgtgattgtcacccatgcccacattgaccactcggggcggattccgttgctgatcaaagaggggtttcaagggcagatttttaccacacgtctcaccggccagctgctgtcggtgatgcttcaggactcggcccacattcaggagcaggatgcccagtggaaaaaccaaaagggaaagcgggcgggccggcccccggtggagcccctttatactgtggccgatgcggcccaagtggccgagcatttggtcaccgcggagtatggacagatcatagaactctttgaaggggtcaagatccgctttgtggatgcgggacacctgctgggctctgccagcgtggagatgtggatggaggagggcggcgtggagaagaagatcgtcttctccggggacattggcaacgtcaaccagccgatcatccgggacccttcctgggtccatggagctgactatgtggtcatggagagcacctacggcgaccggaatcatgcaccggtggcgtcctatacagcggagctggccaagatcatcgacgacacgttttccaaggggggcaatgtgatcattccctccttcgctgtggggcgcacccaggagctgctgtatttcatgcgggagatgaagaaggaggggctggtaaagagcaacccggacttcaccgtctgcgtggactcccccctggccaacgaggccacgaagatcttctccggggacctgcggggctacctggacgaggaggccctggaggtggtgaaggaaggggagcgcctgttcaccttccccggcctcatgatgaccgagagcagcgaggagtccaagctgctcaacctggataagagctcgaaggtcatcatctccgcctccggcatgtgcgacgccgggcggattcgtcaccacttgaagcacaacctgtggcgggaggagtgtgccattgtctttgtgggctaccagggagaggggactttgggccgccacctgctggagggggccaagcaggtccgcctctttggggaggagattgcggtcaacgcctccatctataatttccagggtctttcctctcatgccgaccgggaccacctgctccagtggattgaccaggtgaaggacccggcgccccagcagatttttgtggtccacggggatgcccaggtgacagagatttttgccaacaccttgcgggagaagggcctgccggctcacgcgcctttgtatgaggaggtctttgacctggccagaaacgtgatgctggccgccggggtggagatcgcccccaagaagaccagctttgcctccaccggccggccctccacggcgtaccacgagctggagctggccgccatggatctgctgtccatcatccgggccagcaagggcggcgccaacaaggacctgaagaagatggcagcacagctcagggcagttacagagaaatggaaggacgcctgagcgggcgcagtgtttggacagacgggccgttccctttgggtggacggtccgtctgtgtatcccggcgggtttgccgggcagaggacggggaggtccccaagagaaaggaagagagatgaaacagattctaatgattggcaccggtggaaccatcgcttcggagatgaccgaggcggggctggtccccgggatgtcaggggcggagtttttgcagtatattccctccgtggaaaagctttgccaggtggactgcctccaggtgtgcaacattgactccaccaatatgacccccagccactggctggccattgcccaggcggtggagacccattatgagacctatgacggctttgtgatctgccatgggacggataccttggcctatactgccgcagccctgagctacctcattcaggacagccccaagcccattgtcctcacaggcagccagaagcccattcacatggacatcaccgactccaagaccaacctgctggacagttttactgtggcctgtgacgggcggctacccggggtgacagtggtgttcggcggggcggtgatcctgggaacccgggcccggaagacctattccaagagctttggcgccttctccagcatcaactaccctgtcctgggggtggtgcaggaggggcgtctggtgccgtacatcctgcccccggccggcccggccccccggtttttccacgccttgaaccagcgggtttccctggtgaagctgatccccggcctgtcgccggcctatctggcctttgccctggcggagagcgatggggttttggtggagagtttcggcgtgggcggcgtcccggcgggggaccaggggcagttttatgacctgatccgccaggcggtggaccagggaaagatcgtggtggtgaccacccaggtgcagaacgagggcagcgacctggcggtgtacaatgtgggtcaccgcctcaagcgggacctgggggtgctggagtcctatgacatgaccattgaggccgctgtggccaagctcatgtgggccctggcccagacccgggacagcagagcggtggcggccctcttttacacccctgtggcacaggacatcctcagccggccagaatagcaacgtccccggtcagaaagaccggggacattttctttgcctgtgctggggtctatggcggcgggaggggggacacctgctgcccccgggtaagatagggaggcggcgtggtctccgccccatgggggcgggggtccaggcggtggtagttgggggcgggagcggtccggagggaggaaaaggggatgggcagcccggcagaagtgtagaaatcgggggtgtcctggagctggaaatggagatggggctctgaactgttgcccgagtttccgcaggcggcgacaggctgtccctggcggaccgattccccctgccggaccaagaggctgccgggtttcagatgggccaggagggaatactcccggggactgtgctggagaagcagatagttgccccggaggtctttggcggcgcatactgcctttcgcggggaacagaccgggctgtccggggcgccatccactgcggcgattacgatcccgtgggcgggggagaggatgggctgtccatagcagtagaaggaggagaggcgctcctccggcccctgaaaggagttcccctgggcgtctgcgatgagaaagtcgtaggcataccgctggctgggaagctcccaggtgtgggaggtagcctgggtgatcccgccgttgaggacggtccagctgccctggaaagggagccggtaggacaccgtcgtatggaatgtctccggggcaggaagggtcccgtgataccggttggtggccgcgacaatgccgtggagctgacggaagaagacggcccaccgctgaaagagggtcacagggtcttttccaggcagaccagctggaccccgggaatgccgttgaaggcgcaggggacgatggaaacctcccgatagcccaaattgcgatagagggcccgggcgctggcgttgcgctcgttggtgtccatgcggaggtagcggcagccgtgttccagggcataggactcataaaagtccacgaagcgggagccgtagccccgccccttggcctgggggtccaccaccagggtgtggagtaccatgacctgttccgggggggcgtcctgggtccaggcggcctcggcgtactcggggacctgctcctggttgatcttggcggtggccaccaggcggccgttttcctcggccacgaacatatcccccgcctggatggcgtccagggcggtctgccgggtgggatagaccccccggacccagcccacggtggcccgtccggcctcctcttcggtgtggatgtggtcgtaaatggcggcaatttgctccagatcgcttagggtagcttgtcgaaacatggggtccatcctttctctcggtttgattgttgttcattgtagcatcccggaggacctttttcaatggcggggtggttggttttcagaggggaaggtgagactttgacttgatgctccggcggggatgtgctacactgaggcaatcaatccagcagggaggtcagcagaatatgcgaattgtcgtgctccatggacagagccataagggctccacctatcatctggcaaagctcttttgcgacaaactggggggagaggtgacggagtttttcctcccccgggattttggcgctttctgcgtggggtgcagccagtgcttttccaagtcggaacagctgtgcccccacgctgaccagctccggccgattacagaggcgttggatgctgcggatgtcatcgtcctggccagcccggtctatgtttaccacgtcaccggcccgatgaaggcgctgctggaccactacggttaccggtggatggtccaccgcccccaggaggggatgtttttcaagcaggcggtgtgcctgtccactgcggcgggggccggaacgcggcgcaccaaccaggacctggcagacagcgccttcttctgggggattgccaagattcaccggtatggcagaaatgtccgggcagtctcctgggagcaggtcagccaggcgcggaaagaccggatggcgcgggagctgtctaccctggccaaacgggtggagcgtggggtgggaaaggtgcggcccggcctgcggacaaaggcgttttttaccctaattcggtggatgcagaagcggggctggaacgaagcagaccaggtatactggcgggaaaaaggctggacagggcgcgcccgtccctggaggaaagcctgactctgccgggggcgagaggggaggtccttgcgcctaatgatggacaaatggatggattcgtgttacaataacacggattatatgcaattctcgccctctggcggggaagtatgacaatggagatgcgaaacggtgcgaaaagaaattatgggggtgacctttgacgatgtcaccctggaagaggcggtggccgccggggaggcactggcggcagggccgggcttttcctatgtggtaacccccaacccggaaattgtagcgatggcccgtcagacggagacgtatcgggagattctcaacggggccggcttggttctgcctgacgggatcggcgtggtccacgcggcgaagattctgggtacccccctgaaggggcgggtgccagggatcgacttcgcctccgccctggtggagagactggcccggagcgggctgcgcctgtttctgctgggggccaagcccggcgtggcggagcaggcgggggaaaacctgaaaaagcggtacccggaccttctcctctgcggcacccatgacggatacttccagacggacggcccggtggtggaccagattcgggccgcccgggcggacgtggtctttgtctgcctgggggcgcccaagcaggagcggtggatggcccagtacggcccggagacgggggcccacctgatggtggggctgggcggtgtgctggatgtgtatgccggccatgtgaaacgggcgccggaaatctggcagaagctggggctggagtggtgttaccgcctgctccatcagcccagccggctgggccggatggccaagctccccctgtttctgctggaggccgcccgggaaaagggaaagcggggaaagccatgaagcgggggcgcttgattgtcattgagggcaccgatggctcgggcaagtccacccagtttgcccggctgtgccgccgggcagagcacgagggcattgcctttcagcggctggtgtttccccagtatcaggaggagtcctccgccctgctgcggatgtatctcaacggagagtttgggcgaaagcccggcgatgtgaacgcctacgcggcctccagcttctacgcggtggaccggtatgcctcctggaagaaggtatggcaggggtactacgaggcaggggggctggtgctggcggaccggtacaccacctccaacgcggtccatcagtccagcaaggtccccccggaggagcggccggcgttcttccagtggctgtttgactttgaatatggccggctgggcctgccggaaccggacctggtgctctacctggacatgcccacggagcgggcggtggacatgctccgccagcgggagagggacacccacacacagggggacatccatgagaccgacagcgcctatctggccacctgccggcaggccgccctggaggcggccgagcgatatggctggaccaagattccctgcctggatcaggagggacggctccggcggattgacgagattcaccaggatatctggcaggcggtgcgccccctgctggagacaaaggagagataaacgatgggaacagaagtttctaaggtgaaacagattcttcggggacagatgcggcaggcgctggcggagctcagcgaccaggagagagcctggtcggacggagagctcatccagcggtttttggaccaccccaagctggcccaggcccagacggtgatgctctactacggtgtggggcacgaaattcggaccgaggggctcatccagaccctgctggaccagggcaagaccgtttgcctgcccaagtgcctgccggaaaaccagatggaggcccgggccatcaccagcctggaggacctggcccccgaccggtatgccatccccgcccccaaggacacctgcccggtggtggagcgggagaagctggacctgattttagtgcccggcctgtgctttgacagccggggcagccgcctggggcagggcgggggctactatgatcgctatctggaagactatgacggggtgaccatcggcttgtgccgggaggactttttccaggtcaacctgccccgggagcccctggacgcctgggtgcgctttgttctcaccgaggagggccaggtctggcccatgggaacatccgctaaataaacaaagaaacccgcggggctggcccatggccccgccctgaggaggtagcatatggaacgagataccagaagacgacgcccggaagagccggaacgacgacccgcgccccagcggagacggcggaataagcggtcccctctgtccaactccatgctctatattgtgatggtctgcgcggtttccattgttttggctgcggtgggctggtctctggccaacgacatgctggcgctgaacaaagacaaggtcaccgccaccatcgtggtggacgacgagaatgactttggcagtgtggtggaccagctgaaggacaatgatatcatcaaatataagggcctcttccgcctcttctccgccctgtcggggggaagcgacaagattgcccagggcagctacttggtggacacggacatggactaccgggccattttgaacagcttggggtctggctcctccagccgggtagaggtgtcggttaccattcaggagggtctcaccgtccggcagatctttgagctgctggagaaggagggggtctccaccgtggagaagctcaacgacatggcggccaaccacgactatgccttctccttcctggaggacatccccctgggagaccccaaccgtctggaaggctatctcttcccggacacctacaacttctacatgggggaggaccccaagtatgttatcaataagatgctggtgaactttgacagcaaggtggatgacagcatgcggcagaagattgcggacaaggggtacaccatccaggagctcctcacggtggcctccatgatcgaaaaggagaccgacggcacggaccggaccaccatcgcctcggtcatctacaaccgtctgaacaaccccggcgcggggacaacgggacacctgaacattgatgccaccatccagtacgtgctgccggagggggaaattgtctcggaagaagactattacacggtggaaagcccctataacacctacctgaacaagggacttccccccggccccattgccaaccccggcctggagtccattatggcggcgctgaaccccgagagcaccaattattactattacgccctgggagatgatggggtccaccacttcttcacctcgtacagtgagcaccaggccttcctgaacagctgatggccatggagagaaagctggaattgctgtcccccgcgggggactgggagcggctggagatggccgtggcctatggggcggacgcagtctatctggcgggggacaccttcggcatgcgctccttcgcgggaaacttttccccggaggagctccgccgggcggcggacctgtgccgccgccggggggtggccctccacgtgacctgcaacaccatgccccgaaaccaggaggtggaccggctgccccagtggctggcgtggctggaggactgcggcgtcaccgccgtgatcctggctgatgtgggggtgctggccctggccaagcggtatgccccgtcggttaagattcacatcagcacccaggccagcattgtgagctatcaggcggcccgggcctggcacgatttgggggccgaccgggtgatcctggcccgggagctgaccttggaggagatcgcggaaatccgggccaagaccccggcgtccctggagatcgagacctttgcccatggcgccatgtgcgtgtcctactcgggccggtgcctgctgtccaactacatgacggggcgggacgccaaccggggggcctgcgcccagccctgccggtaccagtatgccctggtggaggagaagcgtccgggggagtactttcccgtctatgaggatgaaaagggcacctacattatgaactcccgggacatgtgcatgattgaccacctgcctgacctgatcgcggcgggggtggactcggtgaagattgagggccgagccaagtcggcctattacgcggccattgtcaccggggcctaccggcactgcattgacgacgtgctggcagggcgccccctggaccccgtctggcgggcggaggtggagaaggtcagccaccggcactactccacgggctttttctacggccagcccggccaattcacccaggacgcccggtatatccgggactggcaggtggtggcggaggtcgtatcctgtgaccagacgggcctggccaccgcctccctgcggaacaagtttgcccagggggacgccattgagctggtggggcccgatgtgcggccggtggcttttacggcccccatgatggcggacgagaccggcgctcccctggaagagccccggcatccgcagatgaaatttcagattcagctgccctgttacgccccgccccactcgttcctgcgggcctgccgggagaactcgtaatcgggccgaacagacacaaaacccacccctggccaggcgcagcgcgcctcgccggcggtgggtttttccaaagggagaagaagggagcgggaaatgaagcggtatctatccagttttactttgccgtccaagaccgaccaggagtttgcgctgggaaaagcggtcaaccgcaggacttgttaccagaatgtttacccttttggcgtctttggggcgtgggaggaaacccgtctggagatggaacccatcaccatcctctatggcggcaacgggtctgggaaaaccaccttgctcaacctgatgggggacgcactggggttggagcggcggagtgtctataaccgggcggcgtttttccagaattttgtggacctctgccagtgggagggggagcgccagatgccggcgggcagcgcggtgctcaccagcgacgacgtgttcgacgaccttctggacctgcggagcctcaatgagggcatcgacctggatcggcaagccctgctgcgggaatacaaggaccttcggtcccagggctttcagctgcgctccctggacgactatggacacttgaaaaaggtcatctccgcccagcggaacacgggctcagcctttgtgcgccaggagctggggggagagctgcggggcaaatccaatggggagaccgccctggcatatttcaccagccgggtgacggaagggcggctttatctgctggatgaaccggagaacagcctctctgcggactaccaacaggcgctggcgaggtttttggaggactccgcccggttttaccgctgccagctggtcattgccacccactctcccttcctgctggccctcaaaggggccgcggtttatgatttggatgcccagcccccctgccgccgcccttggcgggaactgccggcgatgcagacctgggccgcgtttttccgggcccatcagggggagtgggaggacgataaggaggagaaccatgaaacgcgatgaactggaacaatgcctcaggggatggaaggtccgcctgcgggattccgcccacgacgtggaggagattcagagaaggttttacgccagcaagggggcggccgcagtgcgaagcctggagaagaacggctttgccgcccattacgcggccagccggggggaggcggctgccctgctcctctccctgatcccggacggggctgtggtgggggtgggggactcccacacgatctatgccttggacttagatgagaaactggcggccaagggctgtcaggccatccccagtatggcggccctcaccggcaccagctatgactgcaatccccccggccattaccgggcccccacccgggaggaggcccgacggattttggccgcctacctcacggcggatgtcttcctcctgggggccaacgccatcaccatgacaggagagatcgtcaatgtggatggcgtgggcagccgggtggtggggggcatctatgggcccgaccggattgttgtggtggcgggaatcaataagctggtccctgacgagcgggcggcccgggagcggattgcctttgtggcggcccccatgaacaacctgaagtatgatcgggcctgcgcctgcgtcaaaacggggcgctgtcccagctgcgatgcgcccaaccgcatctgcaatgtcaccaccatcctacacaaaaagcccatgcggtcggattaccatgtgatcctgattggggagagcctgggcttttgaggggcgtgcttttggcgcttccatagaaataggaaacgcaaacaccggctggttggccggtgtttgcgttgggtgggggccagcggtcagggcagccccagggcggagagaagggagaagagggcagtgagggtgaaaaatgcgcagatggcggaaaagatgccaaaacttatgctcttttgcttgactgcatagtagacaaactgagaaaagacactgccgaaaaagagaaggctcaaggcgtagtccccgatatcgtccaggggaacaaagagttttaagaggcaatagagaatgagaaagacacagtgggagaacctggcgctttccaatttggtaagcctgccgcgctcatcctccatcacattttctgcccggcttttcgtaagaatttcatctcggttcatgggaggacctccgttttgacaagtttacttggtatacctattatagcataccaagtaaacttgtcaacctattttgcgaagttttctgtgcagaatacgggaagccaggcgtgggcggcaggggaggccgtggagcggaaacggagggggctacgggcccagaaaattgcgctcagggagcgctgagcaggatgtccaggtctttgagagagacatccattttccgggcgatctcctccggcgtcataccggcggcctggaagcggcggatgaccagtttcatggactctcccacctcgatgaggtggccgtccaggtcgtagaaccggatcacccgctggccccagggatgttccaccaccccgcccagggtttgcaggtggggataggcccgcagcttttggaggaatccatccaggtcctccgtttcaaaggccagctccatgttgttgggctgggggtgaatctgcgcccgggagagtcccgtcagccagtggaagtcctgctgaagggagagcccgcaggtaaaggtgagattcctgccgtagtcctggtagagctccaggccgaaaaggtcctcataaaaggcccgggctgcgtggatctccgccacggagaggacggtggtgaatgctttcatagggtacctcctgctgtgtgttttccccattttacagggaagccggggaaatggcaacctgaatttccgtgaggaactccgcctcctggacggtgtcccggttgtcgatctcatagagctcaaagggggttcccgccagggtcaggccatgggaggcggcgtaggccaggacctcctggaccctggagcggttctgctggtagctgccctggtagaaataggacaggtagaccccggcgggcagcacaaagtcgtagtcggccgcgtcctcctccagcacggagaagacggcgtcgtagacattgggaatgccctgcatcagttcatccatggccagaaacgccccgaaggtctggttgccgaagtcccggattttgtcctcatgctttcggtggagctttttcatcacgaagtccatctcctcatcccgggtgatgtgggcgctgaactggacgcaggggcgctgggggagggtgcggagggtgatggcgccggggacaatgctccgggcctccgtcagggcggcaatccgcctttggagcaggcgggccttggtttgcagctcctggatttgggcctggaccagggcctgctcctggcgcagcagcgccagggtgtggtccacggtctgcccttccaaatagtctttgatctgctgcatggaaaaatccagccggcgcaggtcccggatgacgttgagcttgtacatgtccttcaaattatataagcggtagccgttggtatcccggcgcggtttgaggatccccagtttctcgtagtagcgcagggagtccacaccgatgccatatagccgtgcgatctcgttgattttatagtaatccttcacaaaaaacacctgcttaatttatttgaaatgatggatggaatggccttgactctggtattataccagagtttatactcaaaataaagagagcccttcccagggatttgattgagtaaaaccgaaagcgaggcgcatcgttatgtcaaaaaaggaacaagtgattcaggagctgaaccgggtgatttctttgatccatacggatattcaggcgatttctcccgcagagaaaaaacagatggtagaggagaccgtggagcatttcaaccactatgtgagccccggctggctggcctaccgcaagtcggtttcttcggactctgaggcgggggccgtgttggagtggcaggacgaaggcgcctactgctatggcctcaatggggaacagtttattgactgcctgggcggcttcggcatctacacctgcggccacagaaacccggagattctggacgtggtgaaagcccagctggaccatcaggccctccactcccaggaactgctggaccccctgcggggctacctggccaaggccatggcggacatcacccccggggagctgcagtactgcttcttcaccaacggcggcgccgaggcggtggagatggccctgaagctggcccggatcgccaccggcggccggtggtatatctccaccgtgggggccttccacggcaagtccatgggcgcggtgtccatgggcggcaaggggacctaccgcaccccgtacacccccatgatccagcaggtgcagcacgtggagtacggcgtagccgaggacatccgcaaggccataagaaacctccaggctgtgggcgaaaaggtggccgcggtgattttagagcccatccagggggaggccgggatcattgtgccccccgagggctacctccaggaggtccgggagatctgtgacgagaccggcgtggtgctgatctttgacgagatccagacgggcatgggccgcaccggcaccatgtggcggtgccaggcggaaggggtcacacccgacatcatgacctatggcaaggcctttggcggcggcattatgcccatcaccggcatcatctgcaagcccaagctgtgggtccaggagatcattgacaacccctggctgctgggctcccccacctttggcggcaaccccgtgtgctgtgccgcggcccttgccaccatcaagtatatgctggaacatgatatccccggtgtctgcaagcggaaaggggaggtcctgaaagccggtctggaggccctggccaagaagtatcccaagatcatccaggcggttcgtggccttggcctgatgctggcggtggagttccacaccagcgagatgggctatgcgtgcgccaagggcatgtttgcccggaaggtactcaccgccgggaccttggtcaacgccaaaaccattcggtttgagcccgcggcagtcatctccgagcaggacatccaggatgtgctctcccgcatggatgaggccctggcggacacccagaaggcgtttggcctggaataacggaatacggcgtcctctcctctggggaaaagaggaaaggcaccagaaggcccggcggcgcaccgcgccgccgggcccccttgacaaagaggaggggagagcgcccagggaaaatttccagccgggagcccttgacaggggaaaaatccgtgataaaatgaaaaagcgataggatatctggcgatgaggaagcccatgtgccatggccgcccaagcgagaggggaagcggtgagagccccttggcccagcccggcacagcgccacttccgagccgcccgggaggaccgggccgggccattcccgttacaggatgaaccaagaggcagaaggccgccaggcgttctgtgaattagggtggtaccgcgaagtagtttactccgtccctgaacagggagggagtttttttattttatttttctgagacatcggaggtatgtttatgcataagtactacggtttgaacgagctgcgggagatgttcctgactttttttgagtccaagggccacctccgcctgcccagttttcccctggtgccggagaacgacccgtccctgctgctgatcaacgccggcatggcccccatgaagccctggttcaagggggaggaggagcccccccggaagcgggtgtgcacctgccagaagtgcatccgcaccggcgacattgagaacatcggccacaccgcccgccacggcacctactttgagatgctggggaacttctcctttggggattacttcaagcacgacgccattcagtggacctgggagttcctcaccgaccccaagtgggtgggtctggaggcggaccggctctatccttcggtctacctggaggacgacgaggcattcaacatttggcgggatgtggtggggattcccgaggatcggatctaccgcatgggcaaggaggacaacttctgggagcacggctccggcccctgcggcccctgctccgaggtctactatgaccggggggaggctttcggctgcggcagccctgactgcaagcccggctgtgactgcgaccggtatatggaggtctggaacaacgtctttacccagtttgacaacgatggggagggccactacaccgaactggcccagaagaacattgacacgggcatgggcctggagcggctggctgtggtgtgccagaatgtaaactccctgttcgatgtggacacggtgatgaacatcaccaacaaggtctctgacatcaccggcgcccattacggggacagcgaggccagcgacgtgtccctgcggatcatcaccgaccacattcgctcggccacctttatgatctgcgatggggtgctgccctccaacgaggggcggggctatgtgctgcgccggctcctccgccgggcggcccgccacggcaagctgctgggggtgaatgagcccttcctgtatcagatcatcgacaccgtcatccatgagaatgagggggagtacaaggacctgcggcagaagcaggactatatcaccaaagtcatccgcaccgaggaggagaactttgccaaaaccatcgacgggggcatgaagattttctccgagctgctggccgagcacaaggccaagggggagacccagtttgccggcagcgacgcctttaagctctatgacacctacggcttcccggtggacctcaccgaggagatggtccgggacgaggggatgaccctggaccgggcgggctttgaccaggagatggaggcccagcgggtccgggcccggaaggcccgagaggccctgggggacctgggctggtccggtgtggagtttggcaaggaggtgcccgccacggtctttgatggctatgcccagaccaccctcaccggagccaaggtgctggccattgtggcggaggacaccctggtggatgagatcattcccggggtggaggccattgtggtgctggaccgcaccaccttctatgcggagatgggcggccaggtggccgaccatggcaccctggccaagagcggccccgagggcggtctgttccaggtgaccgacgtgcagaagaacaagggcggcaaatacatgcactatggcaagctcacccaggggagcctgaaggtgggcgatgtggtcaccactgcggtggacccggtgcgccgggcggccattatgcgggcccacaccgccacccatctgctggacaaggccctgcgcaccgtgctgggggaccatgtccaccaggccggctccctggtggagcccgaccggctgcgttttgacttcacccacttctccgccctgaccgcggaggagctggcccaggtcagtgccatggtcaacgaggccattctggagggctacgacgtggtcaccgaggaactgcccattgagcaggccaagaagaaaggggccattgctctctttggcgagaagtacggcgacgtggtccgggtggtggacatgggtgagggctactccgtggagttctgcggcggcacccacctgtccaacaccgccaaggtgggggtcttccacgtgagcagcgagttctccgtggcctccggggtgcgccggattgaggccaccaccggcaaactctccctggaggttatgaaccggaatcaggagctgctctttgaggcggcggcggccatgaaggccaagcccggcgagctccgggaaaaggccaaggcggccatggcggagatcaagcagctccaccaggtgatcgaaaaatttgaggcggaggcctccctgggccaggcccgccagttcctgatggcggccaaggatgtgggagaactgaaggtgcttaccgcccaccgcccagggatggatggaaacgccctgcggcagatgggggatttcctccgggacaaggagcccaatgtggtggcggtactggcctccaccaacgaggagaagatcaccttcctggctgtttgcggcaagcaggccattgccaagggcatcaaggcgggggacctggtgaaaagtgtctgcgccctctgcggcggcaagggcggcggcaagccggacagcgccatgggcggcggcaaggacccgctgaagctggacgacgctctggcctcggtggacgactttgtggccgtgaagctgggcctgtgagggggcggaaccatgctgcttgactttgccaaaattccagtggagcctgtggccaatatgcggggcggccaggggactgtgctgctgcagaaaacggtccagggaccggtcaaggtgatgcggggggtactgcctcccggcgcgaccattggaatgcattcccatgagaccaattgtgaagtgatctatattctatcgggcaccggccaggtcctctgtgacggggtgcaggagccgctgggccctggcgcttgtcactactgccccaagggccatgggcacagtctccaaaacacaggcccccttcccttggagttctttgccgtggtgcccgaggcgccataaccccgatattcatagaaaggagcgcgataccatgagcgactgtttgttttgtaaaatcgccgggggagaaattccctcccaaaaggtctatgaggacgaactggtctatgccttttatgacattgatccccaggcgcccacccatttcctggtgattcccaaggcccacattgcatcctgcggggagattacggcggaaaattccgccgtggtggcccactgctttgaggtgatttccaaggtcaccaaggacctgggcattgcccagttccgggtggtctccaactgtggagagcaggcggggcagagcgtgttccacctgcacttccacgtgctggcgggacgggacatgacctggccgccgggatgaaaaacaggagcgccccagctttgccggggcgctctccaatcagaatagggtttgccgaacctggacagcggaaggctgggaaaaggtttgcgggggcgccctggcccaactggtgccagggtgtctctttttcagagtgaagtgtggggaaaattgcaactatatggtggcaatattgcggggaaaagcgacaaaatagtagccttttcttgaggtgttgcacgatgtattttcctcggattgaagacctgcgcattgacagtgacaggaaacagtatgaagttgcggcatacctccacttgaaccgggaggtgtaccggcgctacgagaaaggcgagcgggagattcccgtgtgggcggtgattcagctggcccggctgtatggaaccagcacggactatatcctgggcttgtcagaccggcgatgattctattgtggtttaccgcaggggtggtgcccgctgtcctgctgggggtgtatctgccctggagtgcctgggtgctgccggtgggcttgggcagcctggcggcgggatttttgttcaaagggctgaaaaaatggccccctctgcgccggttcctctttggggccggggcgatcttggtgtggctggcggtgtacagcgcgctctttcacgccccggcacaggacttggagcaccgcaccatccaaatggaggccgtggtgacccagtggccggaggagaccgactacggggttcgggtgccggtccgggcgggggagagggaaggccggaaggtgtccgcgctgttttatggaccggcggacctggcggacctgcgcccgggggaccggatatcctgcgtggcccgctgtaccccggcggaggagctggggggagaggagagcctgtactacccctcccagggcattctgcttcggatgaagggatatggccaggtaatggtgacccggggggagagtagttcagtccgatatgccctgaccattctggccggggagatccgggccatgctggaccagctgtatccccccagggaggctgggtttctccatgcccttctcacaggggataagaccggcctggaggagaccgaccggaacaacctcaaccgcgtagggctggggcatgtggtggtggtttctggccttcatgtgacctttttgatggggtttttgacgttgtttctggacccaaagaaaaagggacaactggggcttcttctgctgatcctggtgctcttctgcctgatgacgggcaacggcccggggacggtgcgggccaccgtcctctgtgccatggccctgctggcccagcagctggggcgggactaccacagcctcaccggcctgtgcgcggcactgttggtgcttctggcggccaacccttatgcggcggccaacgcgggtctgcagttctccttcctgtccaccttgggcattctgctctttggacagcggtggagcaaggcctggctggcacaggtccccaaaagggcccggcggtgggccgccccctttttcggggtggccgcgatcagtctgggggccatggtgtttaccgtgccgctgtctgcggggtattttgggcggttttccctcatcgcccccctgaccaatctcatgaccagctgggcggttaccctggcctttgtgggcggggcactgtccgtggcggtgggggcggtggtgttcccgctggggcagggcttggcggcgctggtgggatttcccatccgctttttcctgggctgcgcggcccaggccagccggctgggcctggcctcggtggacctggaccgggggtactacgccctgtgggccctgtttgtctatggcgtttttctgctgtatttgttggcgccggtgcctggaaagcgcccggttgtgccggtgtgcgcctgcgtggtgaccctgtgcctgtccgcgctgctcactgccaagacggttcagcggcaggacctggccctgacggtgctggatgtgggccaggggcagagcgtggtggtgacctcggggcatgcccgggccctgatcgactgcggcggaacccgggacccgggggacaccgcggccacctatttgcagtcgttggggcggagtgagctggacctgctcattctcacccattttcacgcggaccacgctggcggggtgctggagctcatggaccgggtgaaggtccgggccctggcggtccccgacgtggaccgggacaacccgctccggcaggagattacagcccgggcggcggcggaaaatattcccgtttactatgtgacggagaccagccaagtgaccctgggccgggcggagatcaccttatatccgccagtgacagcggggaaggacgccaatgagcaatgcctgtccgtcctctgcgccaggaagggatgggaggcgctgctgaccggggatatgccggcggcggccgaggccaagctggtggcccgggagaacctgccggaagtggaggtcctggtggcgggacaccacggctccaagcagtcaaccagtcaagccctgctggaagcggttgccccggagacggtggtgatctccgtggggcagaatacctacggacatcccgcgccggagacccttgcccggctgtcggcggcgggggcccaggtgtaccgcaccgaccggcagggcgggatcaccgtgtatgcccagagtggggaggaaacgtgatggcaaaaaaatatgagaaaaatccggggcaggaggcttaccggcagttcaagaaggcacttgcccaggggaccttgggctctctgtacatctttcatggggaggaggcctatctccgggactactatttggaccagatgaaggccaaactgattcccgccgggatggagagcttcaactaccatctcctgccgggcaagaccctcaccgcccagcagctggcggagacggtggatgccctgcccatgatgagccagcgcaccttggtggtggtcagcgactatgacctcttcaaagcccccgaggccgagcggaacgccatgacccagattctctccgatctgccggagtactgctgtctggtctttgtctatgacacggtgccctacaaacgggatgcccgcatgaaaaaattgtccggggttatccgggacaaaggggcggaggtggccttcgtccggcagggacagagtgatctggtggactggattgtccgccggttccgggccttgggccacgacattgacacggcggacgcccaatacctgatcttcctctgcggtgacctgatgaacggcctgatttccgagatcggaaagatcggggcgtacgcccagaatcgccgggtcacccggcaggacattgacgcggtggccatccccgtcattgacgcggtggtgttccagatgaccgatgccctcacccgaaaggaaatggaccgggccttttccgtgctccatgatctgctgcgcctccagcaggccccgattatgattttagcggtgctgggcaagcacttccggcagctctacacagcccgggtggccctggagtctggagaggggagccggtggctcatggaactgtgggggatgcggtcggcctatccggcggacaagctgatggaaggggcccgccgccatgggctggactggtgccgccaggccatgcgccggtgcgcggagaccgacctggctatgaagtcggtgtctggggccgacgccaaggaactgctggtctccctggtgctggagctggcggcaggagggacagcatgctgaaaattcgggaggccattgtggtggagggccgatatgacaaaaacaccctgtcccagctggtggacacggtgattttagagacgtcgggctttgggatttttaaggaccgggagaccctggcgctgctgcggaggatcggggcgaaacgggggctcattctgctcaccgacagcgacggcgcgggatttgtgatccgcaattacttgaaaggcaccctccctccggaacaggtcaaacatgcatatatcccagaccgcttcggaaaggaaaagcgaaaacgccggccggggaaggagggaaagcttggtgtggaggggatgtctcccacggtactggagaccgccctgcgccgggcgggggcgaccattttgggggaagagaccgccccgtccgctcctctgctgaccaaggcggatctgtttgcctgcggcctgtccgggggggcgggaagcagggaaaaacggcaggctctgctgcgtaagctgggtctgcccgcccacctgtcccccaatgccatgctgccggtgctctccgcgctgtatgaccggcagaccctgctggaggagatgcgaaagctgtgacgtaagttacacaatttgacgaaaaaactacaaaatatatggggaaaaggggtttacaaaacaccagatgtggtgtaaaataaacctgcttagatggacaagcttttgttggtctaagatcaatttttaacgaccatgcgctttcccggaaggcgcggatgatggaggaatacagttatgagcaagtatgtctgcagtgtttgtggttatgtgcatgagggcgatcagccccccaaggaatgtccccagtgcaaggcgcctgccagcaagtttgtggagcagggccccgagatgagctgggccgcggagcacgtggtgggcgtggcccagggtgcgcccgaggatattatggaggacctgcgggccaatttcaacggggagtgcaccgaggtcggcatgtacctggccatgagccgggtggcgtatcgggaaggctatcccgagatcggggagtattggcgccgggcggcctttgaggaggccgagcatgccgccaagtttgccgagctgctgggcgaggtggtcaccgactccaccaagaagaacctggagatgcgtgtggaggctgagaacggcgccaccgccggcaaggtggatctggccacacgggccaagaagctgaacctggacgccatccacgacaccgtgcatgagatggcccgggacgaggcccgtcacggcaaggcgttcgagggcctgctgaagcgttacttcggcaagtaatttctaccgttttgagggtgggcagagatgcccgccctcttttttgctggaaaaaggtgaaaccttctatctgcattttcccgcgaaatataataaagtggattttggaaaaggccggggcaatggagcccggcctttttctgctgtgcctttggagcttgtggtacgggagagacagggccgggctatctgttgtcgaggcctgtgccggccgctatccccgctgtatgaggtgggctatgatgctctggatgagctgtaagtctctctcactgagcaggtccaatccggaaaccacgtgtttcttcaggttggggttgcccatggacggatcgaagaactcagcgggcgtgatctgaaaatagtcacagatggcgaagagttctgtcaaggagggcaacgatttaccggagctgatgttattgatatatcccctgctgtgaccaaggtcatagctcatttggtactctgagattccctttgccatacgaagctgtgtaatccgttcccgaacgaaattgatatccacccaatcgcctcccctcgtaacaaggatagccggggaggaggggagaagatacctttttgagacttgaattctcttgattcgcccgcgtaaagatgttattatagttttgtagatgtcgaaaatggaaaaataacgtcttaaaaacgcttattctgaaaaaacgggaggtggaatgggcctccggggagaaacgcgagcgtaggggaggaaaatatgagacggttcctgacaggctggctggtgtgtgcgctgttgtgcacgctctgcgcctgcgaaaacgcagcggggcaggccgatttgcagtccatacagaaagcggatgtgagggagctgtatgaggcgctctattccgacgttgcggaagcagaggatacctatgtggggaagtcctatgcgtttctgggcgcggtcaagtccctttcctccgggcatggagtgatcgcattgaaggattttagggatcatgttacatacggcaatggaatccgagcccatttttccaaacagaccctgggagagctgcgctgtgatgagatggtttggattgctgggacgatagcgggcttttcctgtgaggatggtacgatccttttagatcctgcctactatatagaaaccccggtgttcacggtgacagggcggatcagcgcgttggcgcgggatcaggcggggcggccttacgttttgttggagcaggctgaggtctcggagcttggagaggagatgacagtggcggtgtttctgccggaggaggcatgtggggcttggaaggaaggggatcagatgcaggtcaccggggccatgagctggaaaggggccccgggggtggcgctgtccgacgggtatttctaccgtgctgtactggcggagaaatgaccgcaataaacgccctggctttttggaggagccagggcgtttgcgcttaaaaggcagcgggccttctcagtgggaacaggagataagaccggctctctcggcgcaagcaaagcggcagagcaaaagggcccgggtgtcttccagggtctccacgcagttggacaagagggtgtggaagtatacctgttccttggacagggaggggaggggcgccgggactggggcaggcgagctcccttgctccagggcctgaagtgtcttctgaagggacgaaaatagggtgcggagctccccgcgctgttctgggagaaagcggcctgggtggtcgtggacgtagcttgccagcagctccagctcggtgctgagcttacgctgaagggggagcagatggagaaggagggtgtgggccgctgtactggggcttcccgccaggagggtctccatttcttgggtgagcatattgctccgaatcagatactggcgaaaggagtgccggctgctgttggaggagagcatttcctgcagttccgccagcatccgggcgtctgtttccaacagggtttggaggctgtcccgcacttggccaggttcggtgatgggaaagaggaagcggttggcggtccaggcggtcaccgccgccatggccacataggccagccgaaggccgatggccaggcggatatccaccagaagaatggccaggatcatgccatagcaggtgccataggtggacatggacgtggaggtgagcggcacgtagtacatcaggcaggtcatcagcgccaccagaaagacataggccggcagactgtggaagagggagagaaggagggcggtcatcagcagccccagcagattccccaggacccgattattgatgcgggccgcgctctcctctgcgtagggcatcagcatcagaaagacggtcatggggtaccagtaggcaaagggccactgggtgagatacacgaaggtgaacgagaggcagagcaccaccgccagccgaatggcgaaccggctttgaaagcggtggaattggaaaagaccgtccagagttttccgttcctcagacagcaggggccagtgggtcatggcctggtccatgggggtgtgcgccatctcctccaaggcatcaaccagaagggcgagcgcctctgccatggcctccgttccggcgggggaggaaagggcgcaggtgtcctgaagaaactggagcctgcggaggagctgctggctgtgcggcgggtccagcttggtctccaaagcggcaagcagacagctcagctggcgaaggtaggaggcgtcctggggagccagcgtctgtccggcggggaaaaagtgggcgaggcaataggccattcgctggaagaaaaggagaaacaggtaattgatttttccatatcctgtggccaggaaccgggtattccgggaggtgtagaccacgtggctcatatgggcgcagagggtggccagtgtctgggctaagccgtcgtcaggggtccccagcgcccggttttccagctgggtggccagggttttcattccctttcgtactgtgccatagtggcgccgccgtttggcccgcctggcatagcagtagaaggccgcagcgaaaaccaaaaggccgtagaacagagcgaaaaaccgggtgaggatggcggagccggaaacaggcagcatctctaaaaagacgaattccatgacgtagatatagtaggccttgggagtaaaccggtcgctgagggagtagacaagaccgagaggaaccgccaggttgcccaggatacagaggggcagattcacccagcagactattgccgcgccacagaggacagtcatccgcaggctgatccgcagtacgtctctcaggcgaaaggcctgctggtatttgaaaatatacaagagggagatcacagtggggatcgtaatgttgacagccccaaacagataccacatggacaggatcaaaaagacagagagtgcgatgatatgccgggtctctttcagacgagccaggatggcggcccaacggcgggaaatctcgctgcggtgcaggttcatgaggacatcttccttcgttgtttggtcaggggaacaaggataaaatctggcgtttcagcattgcttcctcaggggagagagggagcccttttttgcggagcaagcagggctcccagaaaaagtcctcccggagggggatggcagtgcagtcaaactgtgcagtgacggagttggggtactgcactgccagccccacgcagcctgtctgttggcagcgccggtatatgttcatcatatagcccgtctcgtgaagggtcaggttgggaatgcgacggctggccaaaatctgccgcagcctgggggtggccttgtagtgctgccccagaaggtacaggtgctggccagccagatcatcaaaggtgacctgagcgcggcaggccaacggatggtcctgccggcagatcagatacaggggataccgggccagaggggtgacctcaaagcgggtatggtccaccggctccacaccgatgcccatggagacgctgccctccagcaccatttcgtcgcagagatcgtcataggtgtcaatcagcgtgatgttttgctgctccagactggtcaaaccgtcctgggcggcaaagagaatgccggaggtaattcccagacgcaggggttttccggcctgtctgcccgcctcaatctcttccaacagaagctggtactcccgacagaggggttctgcatgttttttcagaagcttcccctcttccgtcagcttgatgccctgggccccccgatagaaaaggggaacgcccagttctgtttccagactgtggacaaggcggctgaccccttgctggctcatgtataaccttctcccggcttgggacaggctgtcgcaggtgcagatctgcaggaagcagacaagtttacgcagttccataattatcaccgggtccatgatagcacagcggctccctgcaggtaaagacagagcgggctgagtcgccccagcatttttggaaggagccaccggttttgattgtggaagagcggggggagaagggagccgaaggcctgttgacaaaagaggatggataacgtattctgaatggacaacaaagaaagcgtgatttgggctttcagagaaaaaggagaaacgcatgatggaaaacaatgcacccggcaggggaaaattgaaggtgacaggcattatctataccgttctgggtgccctgtccattttggggtccttgcttattttgggggccggcggcctgctgcttgccagtgataacgatgtgggtctggtcctgggggccgcggccggcgtgttcagcgtcctcggcgcggtcagtggggtgttctacctggtgatcggcatcctgggcatccgaaactgcggccggccggagaactgcggggccaactttgtgcttggggtgattgtgctggtgctggtggtgatcgggctggtggtcaatgtggccgtgtccggccccaccggtgcggcgtacagtgtggtgggactggtgctgtccatcctctacctccagggcgccaagcagaatcgggacgcatggaaagcggcccaatcatgaaaccgttgcatggaaaaccgtgtgcccggcttgggacacggtttttctttccccggggagaggcgttgattttttggggaaaggttggtacaatactttagtatgcgatgctgctgattcagcggggcagtaccccgcggcaaaggatgtgacgggatgaaactgctggtgattgacgggaattccattgtgaaccgggccttttttggaatgcaccccctgaacaacagggaggggtttcccacccatgccatttttggatttttgaatatcctgcggcggatggaggaagaagtggaccctgacggggtgtgtgtgacctttgaccggaaggagcccaccttccggcacctggcctacgcagactacaaggcccagcggaagggaatgcccgaggagctggcggtgcagatgccggtgctgaaagaggtgctggatgccatgaacatcccctgctatgagctggccggctgggaggcggatgacctgatcggcaccatctcccgccggtgcgaggccgctggttgggactgccgggtggccacgggggacaaggactccctgcagttggtcacggaccatacctacgtggaactggttaccacccgcatgggaaagaccaccacccaggagatggaccccggcgcgtttcgggcggcctacggctttgccccggcccagatggtggacctgaaggccctgatgggagattcctcggacaacgtccccggggttccgggggtgggggagaaaaccgctctgaccctgctccatgaaaacggcaccctaacagagatatatgcccgtctggaggcgggcaccctggaggccaagcccggggtgaaaaagaagctggaggcgggcaagcagagcgcctttcagtcctacgacctgtgcaccatccgctgcgatgcgcccctggattttgtccccgaacaggcgctgcgccggccggcgaacagggggctgctgcgggagctctttctccgcctgggttttcagaagctgatggagcagatggggctggaccaggaagaggccgtgcagggttcccaggcggcggtccgccaggcggagaccgtggagcaggtgaccgaggaggcccgctggcgggacctgctggcccagtggcggggacagacggtggcggtgctgacgctgccggacctgtccgctctggtggtgtgctgggaccagggggaacaggcggcgctgtttcgggaggagaccctgcctacgtacggttcttttttgcgggaattcttctgcccggagattgttaagctgggctaccatataaaagatgtgatgagccgggggctggaccgggggtggcaggcccagggctttgtgtttgacggggccatcgcggcctatctcctggcccccaccgacggaagctatgagctggacaagttgggcgcccagtatttccagaaaaccttaccccctgccaaggaatatctgggggcgaaggtctggaaggacgcggcgggggcccaggcggccgggcaggtcatggccagccatgccgccctgctgtttgccctgtatgcgctgcttccggagaagctggcggcgtttggactgacgaaggtgtatgaggacattgagctccccctgtgtccggtgctggcggagatggagcaggcggggatgctggtggacgagcaggccctggcccagtttggggcggggctcaccgccggcattgccgccctccaggaggagatttgggcccaggcgggggaggaatttaatctgaactccacccagcagctgggccgggttctctttgagcagctgggcttgcccccggtgaaaaagaccaagacagggtactccaccagcgccgaggtgctggagaaactccgcccccatcaccccattatcgacttgattctggagtaccgccaactgaccaagctcaactccacctatgtggaagggctgtccaaggtcattgccggggacgggcggattcacacctgctttcaaaacaccgtcaccgccaccggacggctgtcctccacggaacccaacctccagaacatccctgtgcgcaccgagctgggggcgcagattcggaagatgttcattgcccggccgggatgggttttggtggatgcggattactcccagattgagctccgcctcctggcccacatggcgggggatgagaagatgattgagagcttccgctccggggaggatatccacgcccgcacggcctctcaggtctttggtctgccggtggaggagatcactggggagctacgccgccgggccaaggcggtgaactttggcatcgtctatgggatctccgggttctccctggcccaggacatcggggtgagccgccaggaggccagcgactatatggaaaagtatctggagaccttctccggggtgcgggcctatatggaccgggtcaaggagcaggccaagaaggctggttacgtggccaccctcctgggccgccgccggtggctgccggagctgaagtcctccaactacaatctgcggtcctttggggagcgggtggccctgaacatgcccatccaggggacggcggcggatgtgatgaagctggccatgatccgggtggctgcccggctgaaggcggagggcctgcgggcccggctggttctccaggtccacgacgaactgattgtggagtgtccccaggaggagacagagcaagtgaaggccctgctgacccaggaaatggagggggccggccaattttccgtccccctggtggctgaggctggcgcgggccacagctgggcccaggccaagggctgagccgaggaaggaacaccggtcctctcccaagtgtgggggaggcgaagattgggaggaaacgatacgatggaatatcagctggtcccgatggaccgttcccatctgtccggggtggcggagctggagcgcctgtgcttctctacaccctggaatgagaccatgttggaggaagagctcttcaaccccacggcttcgttcattgtggccgagggggcggagggggaggtgttgggatacgccggcctccatgtggtgctggatgagggatatattgacaatgtggcggtgcgtccatcctgccgccggcaggggattggagaccggctgctggatgtgttttgccgctttgggcaggcccacctggcctttctgaccttggaggtccggccctccaaccaggcggcggtggccctgtattgcaagcatggctttcaggaggcgggacggcgaaaggactattaccaagatcccacagaggacgcccttttgctgacccggacgttcgtccgatgaccctgcgggatttgaccctgcaggagctccaccacctccaccggcatgagctgcgggaggcctttccgccggaggaattgaagccctttgccgccatgaaaaagctctaccgggccggggtctatcaccccgtgggggcctgggagggggagacgctggtgggatacgccctgctgtgggaggccccccagagaaagtatgtcctgattgactacttgggggtgaccgccgcccgccggaacggcggcctgggggcggagctcctccggctgctgcgggagaagtttcggtcttgggatgggatcatcgtggagtccgaggccccggaagggggccaaagtgatggcatacgccagcggcgcatgaacttttaccgccggaatggctatacctttttgcggtatgactgcatgctcttcggcgtgcattaccgggtgtgcctgtgctcccccaacggaaaggggagcgaggaggcgaccatggcggcccaccaggcgctgtacggcagtcagtttcccgggtgggcctaccggcggtttattcagatcccccgggacccggatgcccccctccagcccaaggagtcctgggcggagcagagggggctgccggggctggaagaggatgagaaaggacgagagcaatgattattttggcagtggaatcctcctgtgatgagaccgcggtggccctggtgcgggacggtcggaccgtgctggccgactgcatcgcctcctcggtggagatgcaccggatctatggcggggtggtgccggagattgcctcccggaagcacattgaggtgattgcccagctggcggaccaggccctggagcaggcggggctgagccggggagacatcgacgcggtggcggtgacctacgccccgggcctcattggcgcggtgctggtgggggtgagctttgccaagtcggtggcctatgccctgggggttcccctcatcccggtgcaccatgtgcggggacacatcgcagccaattacctggcccaccccgacctggagcccccctttgtctgcctgtgcgtgtctgggggcacctctctgctggtggatgtgaaagggtacacggagatggaaattttaggcgccacccgggacgatgcagcgggggagtgctttgacaaaatcgcccgggtgatgggcctgggctaccccggcggagcccccttggaccgggcggcccagggaggcaatgacaaggccttttccttgccacgggtgcacatacaggacgcccccctggacatgtccttttccggtctaaagaccgccatgctgaacctgatccacaatgcccagcaaaaaggggaggaactgcctgtggcggatttggcggcctccttttccgccgcagtgagtgaggagctggttccccggaccatggccgcagcccaggcgaagggctacggcaaggtggcggtggtgggcggcgtggccgccaactcccgtatccgccgggatttggagcaggcctgccaggctgcgggctgtaccctgtatctcccgccgttgaagctctgcggggacaacggcagcatgattggcagccagggctattatgaatatctggcggggacccgggccggcacggacttaaacgcctatgccaaccgagaaatttcccggccttatgggacggggacagccccggttttccccagccctgtggaaaagtcggtggaaagtgtgcataactctttgtagaattttttgccgttttcagaaaaagaaggggcggaatccttggaaaatggggattccgccctggtatacaactggtatagcaaaaaggggttgacgaaaggggacttctgtgataaaataatttctaccatttgctactgtagcgtagttggtagcgcaattgattcgtaatcaataggtcgccggttcgagtccggccagtagctccaagagcggtgcgttcagatagaacgcaccgctttttgtgtggggctccatggactgggacgttacccttgacaacgctgctggctgtggactataataaaagaacaattgaatggggagctggcgcatgccggctgagaaagggcgtaatgccgccctgacccaggaacctgatccggataatgccggcgtaggaacccctcagaaggacccttccaggcatggtgcttggggggctttttttgtggcttcctcaccaaccaacaggaggaatgaaggaatgcgtaatcgaaaactgcaaatgctttgtgaaggggccattttggtggctctggcccagattctcagtatgctcaagctgtgggagatgccctggggcgggtccatcactttggggatgctgcccatttttctctttgccgtgcgctgggggacccgttgggggctggtggcgggctttgcctacggcctgcttcaggtgatgtttgacgggggctttgccatcagctggcagtccattctgggggattacctggtggcctttaccgtgctgggcctggcgggcctgggaagaggcagggaaaaggggattttcctggggacggtcctggggggcgcggcccggtttgtggtccactgggtggtgggcgccacggtctgggccatgtacatgcccgatgccttttttggaatgaccatgacctctccctggctgtactccctgctgtacaacggcttttacatgctcatcgacaccctgctgtgcctggtgatctttgccctcctcttccggcccatgcatcagtatctcacgggcgcggacttgcggaaaacaacggaataataagaagaaaccgcctgcggagccttccgcaggcggtttcttgcagggagagacgccttctgttacaggtctccgttggcggggaaaggctgccgggtggcgggatgccggtgccggtactgagagggggtgagtcccatctgctttcgaaagcgtttgccgaagtagctggcgtcgccaaagccgcaggcctccgccacctgggccaccgggagatcagaggtgagcagcaggtgcagggcgtactccagccggcgctgggtgaggtattccatgggagacaggcccaggacccggcggaagcagctcaggcaggtgttccggctgacgctggccgcctgggccacttggtccagggtgagcttttcccgaaagtgggtctggaggaaggcgatcatctgcttggcccggacctggtccgtgcgctgggcggcggtgaggtcgtggcggggaagctgctgagcgtgctcggcgatggcctgccacacctggcacatcaggcggtggatgtgcagctcataggcccccgtctccgtctggctcagggcgtaggactggcggagcaggtccagcatttgccgctgccaggggacctgaggggagaggcacaggctgcggagcccctggctgcccaggaagggggccacgtatttttggtaaatgacgctctgaggcggcgccaggaaggcggcgtccatgatgaccgagaacatctccgcgtccggggtgtgggaggcgggctgggccatgtggaggatgttggcgtttttgaagatgccctggccggcggtgagggtgtggtgctcgttttccacgtagtactccatggtgccccgggtgatgacgttgaactccagctccggatgccagtgccagtggatgccggcccggtcaaactggtccatgatgtccaggtaaaaccgaatggggtattccggcgccccccggagctccagggccatcagggtgtggtccgtcaggatttccgtgacttgcatagcggtctcctttgtgaaaaagtaccagaatattgggaaattatccgatgtgatttttccaaatggatgctatgatactatcacagaaccccccggcccgcaaggaaaatcatctgggggaggaaagggaggcctgcggcatgggaagcctgcattttgaaatcggaaaaaagttcaccctcaccaagacctttgccgagagtgatgtgtacctctttgccgggatcattggagatttgttccccgcccatgtgaacgaggagtactgcaaacggatgccctatgggacccgcctggtccacggctgcctcaccttcagcctgtgctccaccgtcagcggcatggcgggggtggacagcggccatgacattctggccatgggatatgaccaggtgaaattcctgaagcccgtctttttcggggacaccatcaccgccacctattggatcaccgaggtcaacgaggcccgccggaaaaccaccggccagtgcgtcatgaccaaccagcgaggggagacggtgctcacctgcctgcactacatgaaggtcattgatccggtggaggaggggaagggaccatgaacaagtggcagaaggcctatctccggggcgcgtatcggggcaagtctcccggggccctctaccgagagcgcctgggcacggtccaggatgccctggactggatcgacgacggggactgcctgacctggtccacccacggcagtgagcccaaggtgttcctggaacacctgcacaccatcgccccccggctggagaaggggattgactgctggaacaccatcagccggtacgactaccctgtgacccgggacccggcgctggcggggcgctttcgccaccatacctttttctttgaccggtggtccgtggccgcccgggggagcgggctgtactcctatttcccggtgaaccagcacaactatgggcaggaggtccggcggtgcctgccccccaacgtctttgtggcccaggtctcccccatggaccggcacggctatgtccacctgagctgcgacctgattatgaccttggagcacgtctaccgggcggacaagattatttttgaggtcaatgcccgggcccctatggtctggggggagagtgccctgccgatctctatggcggatgtggtgtatgaggtggatgagcccatcttccagctccaggacccgcccatcggggagagggaggagaccattgccggctatgtctccgacctgatgagggacggggactgtatccagctgggattcgggggcatccccaacgccattggctttcacctgatggagaagcatgatctgggcatccacacagagcagatcggcactgccatggcccacctgatggcctgcggggcggtgaccaaccggtgtaaaaccatcgaccggggcattacggtgggttcttttatctccggggaccatttcctctatgattttgtggaccagcatccccgcctgacggtccgtcgcagccggtacaccaatgacccctatgtgatcgcccggaacgacaatgtggtttcggtgaacgcctccctgcagattgacctcaccggccaggtgtgcgccgagtccatcggcccctaccagcactcaggcaccgggggggccacggactttgcctggggggcctaccatgccaagggcggccgggccatcctggcccagacggccaccaccaagcaggggaccctctcccggatcgtccccaccctggacccgggggccattgtctccgtttcccgcaatttaaccgatctggtggtcacggagtacggcgtggccaagctccgccagcgcacagtgcgccagcgggtggaaaacctcatcgccgtggcccacccggatttccgggcagagctgcggcggcaggccaaccggctgctgtatttctgatgtccgccggccgggagggaaaaacgtacctgaaaggaaaacagcagccatccggcatgagccggacggctgctgtcgtgttttgtgggtttctcaggccaggagggtctccagccgggcgcggatgagcttcatgagtttgccgttctccggcatctctttgagctccttggggtcgcacaggctggccaggtcctcggagaggtagccctcctcgaacacgtccaggccggcctgccccaggcagtcggcgtagcggaccagggcggcgttgccatccaactcaccccgctttttcagggcgccggcccaggcggcgatggtggccagggggttggaggacagggcctctcccttctggtgccggcggtaatggtcggtgatggtgccgtgggcggcctcatactcgaagttgccgtcagggctcaccagcacactggtcatcatgggcagggagccggaggcggcggcgatgaggtcgctcatcacgtcgccgtcgtagttcttgcaggcccagatcattcccccctcggaccggatgaccttggcggccacgtcgtcgatgagggcgtaacggtagtgaaggcccgcggcctggaacttgtcctggaactcctcctcatagaccttctggaacaggagcttgaaggtctggtcgtagtccttggagatggtatccttggaggagaaccacacgtcctggcccacctccagggcataggtgaagcagcaccgggcgaaggagaggatggagtcgtcccggttgtgcatcccctggaggacgccggggcctttgaagtcaaagatggtctgacgggagagctccttgccgccctcgtcggtgaagaccatctccgccttgccagggccggggacccgatactccacggccttgtagatgtcgccgtaggcgtggcgggcgatggtaatgggctttttccagcaggagaccacaggcttcaccttagagatgaggatgggggcacgaaagaccgtgccgtccagggccgcccggatggtggcgttgggggacttccacatctttttcaggtgatactcctccatccgctgaaggttgggggtgatggtggcgcatttcacccccacgtgccagtgtttgatggcctcggccgcctggacggtgacctggtcgtcggtggcgtcccggttgggcagacacagatcgtaatattcggtgttcaggtccacaaaggggaggatgagctcctccttgatcatggcccagagaatccgggtcatctcgtccccatcaatctccacgatggggttttgcatcttgattttctccatggcttcctcctcagccctggttctgggcggcgtagtggttcatcaggcagccggtgagcaggagctcccgttcctccccggtggtattcttcaaatagagggtgaggggggtgacggtgccgccggagagggccagggcggggaaggtatcatcccccgccagcaccttggcctttacatcggggacatagataaagtccccgggctggcaggtgaacgcgtctccctcggccagggtgaaggggagcatgccccagttgacgcagttggagcggtaccgcttggtggcaaactcatagcagatgttggcgcagccccccagcacccgctggcaggaggcggcctgttcccgggccgagccgtcgccgggcttgttggcaaagatcaccgagccgatctggaaagcggcgggggccagcgatccctgtcccagcttctccagggcttcctggacctgggcgggcagggaaccggcctgccgggcggtctccagagcctgggtgtccagggcgcgggggacgtagtcagggtcccggcgggacagggcgaaggaggccagcttcatggggttggaccggtaggaggaggtctccccggaggggatgagctcgtcggtggtggtcaccgggtcccggaggacggaggccacctgcatgagcaggttgtccgccagagccgggatggggggccattccgcgatgttggggccgaacttcagcgctgcctcaggctgggggtggccgaagccgaagtagacccggcggtcatacacctgggtgtcaaaggtccgcttgccctgcttgggcgggacgtagtccgcttctgtggcgggggtgagcaccccgtggttccgggcggtggcggcaatggaccgggcgtccatgaggaccaccccggacagctggccatcgccgggcttggagccctcccgattggggaagttccgggtggtgtggcggatggacaggccgttgttggcgggtacgtccccggcgccgaaacaggggccgcagaagcagggcttgaagagagcccccgcctggagcagggactgctgtaccccgttctggatgagctccaggttcaccggcacggaggggggatagatggacagggagaagtagccgctgcccacgtcgtggccgtccaaaatggcggcggcctcagcgatgttgtcgtacatccccccggcacagccggcgatgatcccctggtccaccacgaccttgccgtccaccagcttgtcggtgagggagaggttgaccttgcccccgaactgctcggcggcccgcttttccacctcccggaagatgtcgccggggttggccatgagctcccggatgggataggcctcggcggggtggaaggggagggcggccatgggctccaccttggacagatcaatggtgatcatgctgtcataataggcgccctcctggggatggagggcctcataggcctcgggccggccgtggatggccaggtactcctccaccgcgccgtcggtttcccagatggaggacaggcaggcggtttcggtggtcatcacgtcgatgccgatgcggtagtccatgggcaggcccgcgatgccggggccggcgaactccaggaccttgttcttcacaaagccgtttttatacacggcgccgcagagggcgatggccacgtcgtgggggcccaccccctgggcgggggagccggtgaggtagaccagcaccacctggggggaggcgatgtcataggtgtttttcagcagctgcttgacgatctccgggccgccctcgcccacccccatggtgccgatggcgccgtagcgggtgtggctgtcggaccccaggatcatccgcccgcagccggacatcatctcccgggcgtactggtggatgaccgcctggttggcggggacgaagttgccgccatacttgatggcggcggacaggccgaagacatggtcgtcctcgttgatggtgccccccacggcgcacaggctgttgtggcagttggtcatcacgtaggggacggggaactccttcaggccgctggccttggcggtctggatgatgcccacgtaggtgatgtcgtgggagatgaggctgtcaaacttcaggtggagctgaccggcctcctcccgctggttgtggcggcggaaaatctgataggccatggtcttctcccggtcagcgggagaggccacggaggcggggaccggggtccccttctgccagcggacgccggcggactgtaatgtaatcatatcgtatcgacacccttcctgggaaagtattctgggccccatattgccaggttttttatattaatatgggtacatacaagtatagcacaatccgaccgggaagcaaaggaaaaagaatcaacttttgaacttcttgcagggtgaactaaaatgcagggaaaagtgcgaaatatcgagcaaattttccaaaagaaatgacgggaaggaattttttcttgcatgagaggggcgggcgcggtataataaacagaacaaaggcagccagaaaaccaaagagaaaacccaggaaaaactgggaaattgacaccgccgaggaaaggggaaccatgctatggagaagaatgggaccgggatcctggaacaatacacaggttccctgagccaccgcattgaacaggaataccacatcggggaagagctctaccgaggggacatcaagcggggcctgagaaacagcgacggaaccggcgtgcccatcggcgtcacccgggtgggttcggtgctggggtacatgattgaggacggtgtccgcattccggtacccggccagctgtattaccggggcattgagctcaatgagatcgtggaggcccaccggcaggcggggacctttggctttgaagaggtggcctatctgctgctcatgggctatctgccctcccggggggaactggaccgtttcaatgagatcatgaaccgggcgcggaagctgcccaacggcttcaccgaggacatgattatgaaaaatcccagccggaatatcatgaacaagctggcccggagcgtgctgtccctctactcctatgatgaaaacccggacgacacctccttggacaatatcctgctccagtcggtgaagctggtgggggccttccccagcatcgtggccaacgcctactcggtgaagcgccattactttgaagggggctctctccacatccacttccccatggaggggctgtccacggcggagaactttctgcggatgatccgccccaacaccaagtacacggaggaagaggcccacctgctggacatgatgctcatggtccacgcagagcacggcggcggcaacaactccacctttgtctgccgggccctgtcctccagcgggacggatacttacagcgccatcgccggggcggtggggtccctgaagggtcctctccacggcggcgccaacgccaaggtcatggagatgttccggtatgtcaaagagaatgtgaaccccaaggacgacggctccatccgggattacctggccaagctcctgaataaggaggcgggggaccactccggcaagatctacggcctgggccacgcggtctacaccatctccgacccccgggcggtgctgctgaaaaagtacgccaagcacatggcggagatcaagggctacgctgaggacttccagctgctggagaagattgaggagatgggcattcccatgatccaggccaagacgggctcggagattcccatgtgtgccaatgtggatatgtactccggcctggtctacaccatgctgggcatccctgaggatgtgtttacccccctcttcgcctccgcccggattgccggctggtgcgccaaccggattgaagaggtggtcacctgtcatcggatcatgcgtccggcgtaccgggcggtgatcaagcgggcccactatgatcccattgaggcacggccctcccattacaacttccagctttgagacccagacagagagcgcggaccggtgtccgcgctctttttttgcggaaaaagagcgaatctgccggtttagaaactataaaacttaaaaaaattaaaaaatgtgtcaaaaaaggacaggctcagacgtttatataataaagggcgtttttctgtgggacaatcccggaggaaacataagattttcttaagacttttttcacatcctctcaatagaccttggataaaatgggaagaacacagggctgatcgggaagggtgggaaagcgaaggggggctttttctgtgaaagaatggattgctgtggcggttctgctctattcggttccgctgtttgcgctgctgctgacgtggaaaaagccgctgtggcaggccctgcggggcattgtgctcagcgaggtgctgggcatcctctgcttcttccccctctatgccctggtggggatgctgagctggcagtggttccgctggggcggcgtcagcctgcaggaaattctctccttctggaagggcggcggcgccacggcggccctgtggattggccccggggtgggggagaccgcgctggtcctgctgctgcgctgggtggtggagaccgtccggcagaggctggccctgccgggggagaaaagcgtgccatgacagaggaagtacccaaaggagaggaggcctcatggagctgagacagacaatccgaacaggcatccggaacatcaggcgggcctggtgggaaccgggactgatgctggcgctttccgccctgctggtggcggcggcctggctatggattccggcccccctggtggagaacccggtgcagacggagctgctgtatatccaagtggacagcgggacccatggcatggtccgctggaagcccaaaaccatggtggagcggcagacggcccgggccattgtggaccacatggccaccctccataagaaaaacaccctctgcccggcccataaggccctggagggccggcccaatatgtacatccactttcggacggaggacagctaccaggtggtggcgctccaggtgggcggcggccagcgcaggggggtcagctatccccgggatggcggcggcctggccctggcggcgcaggtgctccagcctcaggacctggaggcgtacgttctggcgcagatccatggggctctgtccggcgagagcctgtgaacggcgcggaccagctcgggaaggctggagaatgctggtatctattgacggatgttggaaagattggtatgctaagagcgtgagagaaacggatggatgattgacgagaatcgtttgaggaggaactatgatgaaacggaaattacttgccctgtccctaacattggtcctggccctggccttatgcgcctgcggcggaagcggcggcggaaccctggccggcggaacctggacccagcaggaagtggagctgagcgacctgcagagctatggcgcggaggacctgaaaggccccatccccgaggactggacgctgcccgaggacttcaccgtgggggacaacacccgggtggagatcaacggggacaaaattctctatggagagcgggaaggcgaatatctggacggctttaccgtggccacctatgccgacggtgcgctgagcaccatctatgagttcaaaagcggcctggtgaccagctggcagcagttcttcagccccgatggcagcaagctggtggtggcctggattcccagcgccgattccactgactggaacgtcaccttagtggacctggccaccagggaggagtccaaactggagctgccggagatgtccattcagaccgcgggccaggagggagagaaggacgcagccaaggcgccggagctggtgatggtcaagtggaaggacgacaacaacctgattgtcaccggcagcctgaaaaactttgacgacagcaccaagccggtgagctatctgtacaccctgcccgctggggagtaattcccgccgctttccccacggccctcagcagaactgtgggcgggagaacaggaggaacagtgtgttctgtttgtcctgcggggaaaccccatggcagtcagaagcgggccgcatggcagtaccctttgacggaatcaacctgaaagaaagtattttgcatccccctgggccggcataacgccggcccagggggatgctgtgtgtaggcggctgtttttggtggggacaggcaaggtcggggaggctggcgcataggcatagaaacacgacacactggggaggaggaagtcagatggaggactgggagcaggagcgagccccccggaaaatcagtcttcgggagaagacctcccgcctgctggacctgcccgctgacggcgtggcgg

SEQ ID NO: 2220 - DNA, 147419 bp, KLE1738
tgtgttctgggcgctggagaaagaaacggaccgcagcgctggtgacgctacggtccgataagataccgccaggggaagtctaccgcctcctctgcgtagtcaatgccgacgcggggccccgccacaatggagaaggggcgcagatcctcaggcggcgtggtgagtccgagatcctccagccggtcgcagacaaagagactgtctcccagcagggagcagccattctccgcccgggtgagcgccagagcctggcaaagtttgcccggcccgttgagaaaattctttctctgataggcagacagctgctcccagccgacgccatatcggttccgggccagaaaggaaagacttccccggggctgaccgccccggatcaggacggcacagggctctccctctggctcggtcacaaaattcaggcagtgatacataccataaatgagatagatataggcggtgcccggtggggcgaataaggtctccgtccggggggttcgccggtagttgtaggcgtgacaggctttgtccatccgtccaatgtaggcctcggtttcctggattcgcaccaccaggggaaggccgtcctggaaccggaccaaatactttcccagcagtgcctgggcaaccaggcgggtgtctcggtgataaaaggcttgtgtcagtttcatggtggcttgtcctccatccaaacaattttgtcgggaggggattcctccccgcacacgcaggcccgccagccgctgccggcataggtctgaaaaaacagacctgtcttcggaggggaggcgccccagtggcggcggaggccctgccctgtgtatttgcaccaggcttcctttttggtccatagaccgtagaaagcggaccaatctcccccctgatgctggaaggcgtcgtattcctctggggtcagagcataccggggaagcgtggcagcccggggacggacccactccacatcaactcccacaggggagtcagacagcgcgcacagcaccagggaaccgctgtggctccagttgatgtggaggtggggatactgcgggaaatagggctttcccaacggggtcctggccagagccggcgggggagagagctgatatccgtgggaaagggcgtaggccaataagacctggggagaaacaccctgagcgccgtagagtttcatggaaaggaccctcccttgggggacaaatttttccagggaaaacccgagaaaagcagtcggaaagacttgccaatttcaggggaattggattataataactgactgatatcagtattctggagagaaacgaggtattttttaccgcgtccagcctatattatagcggaagggaaaaggtgtgtaaacccaatggcgattgatcgaatccatgattatatcgtgcccggcaaacgggcacatttggtggggattggcggcgtgtccatgtcccccttggcggaggttcttcagggcgagggcctggtgattacgggctctgatgtgaaggagagcctggcggtggagcatctgcggtctctgggcatccccgtggtcatcggccacttgccggaaagtgtggagggaaaggacctggtcattcgcaccgccgcagtccacgacagcaatccagagattgccgctgcccatgcattggggattcccgtcttcgagcgggcccaggcctggggctcgattatgcggcggtatgagaatgccctgtgcatttccggcacccacggcaaaaccaccaccacttccatgtgcacccacattgccatggcggcccgggtggaccccacggtgatgattggcgggacccttcccattttagggactggccaccgggtgggaaagggaaagaccattattttggagtcctgcgagtattgtaactccttcctgtccttctatcccaccctggcagtgattctcaatattgaggcagaccacttggactttttcaaggatttggaggatgtggagcacgctttccgggcctttgccgatttggtcccgccggggggaacggtgctggccaacggggaggatgccaataccatgaaagctctggagggcaaggagggggtgctcaccttcggcttagagaagggaaccttccatgcggagaatctaacctgggaccatggctttccttcctttgatgtggtttggaatgggaaaccggctgtgcatgtcgcgctccaggtgccgggggagcacaatgtgaaaaacgccatcgcggcggcggcggcggcgctccttttagggatgcccagccaggccgttgcccaggggctccgggatttccggggggccggccgccggtttgagtataagggaatggtcaagggtgctgcggtctatgacgactatgcccaccatccaggagagcttaaggctctgctggagacggcggccagcttgggctatcagcgggtgatctgtgccttccaaccccatacctatacccgcaccaaggcgctgttttccgagtttgcggcggttttgcagcaggcggacgtgactttcctggcggaaatttttgccgcccgggagaaaaatgaggtgggtatttcctcccaggacctggcggccgctgtcccaggcgcccgggcggcgaagaactttgaccagctgacccagtggctgtacgacttggcccggccgggggatctgatcctcacggtgggggcaggcgatatctacacggtgggggaggaattggtccgccgggggcaaatggaatccacctaagatgcaatcgttgcggagggagccttccctccgcgatgttgtttcccattttgggatgtcatgggacgcaagaggtttggagacgatacaaaatggaaagaatgatgatacatgagatcccgggcttctcctttgggcaggtccaggaccttgctgccggaacgggctgtacggtgattctatgtcccgagggcggggtcaccggcgtggatgtccggggcggttctccgggaacccgggacaccgatgctctgaacccggtctgtaaccgggaggtggtccatgctgtggtcctcactggcggcagcgcctttgggctggatgctgccggaggtgtgatgaagaagctggaagaggtgggcgttggccgggatgtcatggtgacggtggttcccaatgtctgtgccgcggttctctttgatctgaaatttgggtctatggagattcgcccggatggagccatgggctatgtggcctgtgaggcggctttgcgggagcttccctttcaggaggggaactttggagcggggaccgggtgcaccattgggaaaatccgcggcgcgcagttttccatgaaggggggcatcggggcctgcgcctttcggcagggagacctgatggtgggggccgtggtggcctgcaacgccatgggggacgtgttggagaacggcaccatcctggccggtgcccgggacgacagcggcaggggatttgccgacagtgaggcgtggctggtggcccacggacagcgccagcgggatgtgttcagcggcaagctggtgggagaaaacacggtcattggctgtgtggtcaccaacgcggcgatgaataaggcccaggccaccaagctggcggctgtggcccaaaatggaattgcccgcggcgtccgtcccgccaacgccacctttgacggggactgcctgtttgccatgtgccatggcacggtccaggcggacccggacgcagtggggattctggcagcccgagcggtggaagaggccattgtccgtggcgtaaaggcggcggagagcctccatggccggattgcccttcgggatctgtgaagagaacaggaatcctgaattggaaaggaaggaactatgcagaaagtatctgaactgaagtatgaacgcctgtccatggaggaatttgcccaggagataaaggaagtgatccaccaggtaaagactgcggattcggcccgagcggttctggctgcccgtgaccgctgcaatcagctgatgatccggtgggagaccgcccaggcgctgtcctatatgcggtatagcatcaacacggcagatgcgttctacctggcagagaaggaatactatgatgaggtcggcccccaggcccagaactaccttttggaatatacccgggccatgctggagacgccgttccgacaggagctggaggagagtggacagatcattcccctggtgttccgctcgtttgaggtggagctgaaggccatgtccccggagattgtccaggatatgattgaggagaaccggctggtcagtcagtattctcagttgatggcaggcatggagttccccttccggggagagaacttaccccgtcccatgctgatgaagtatgccaagtcccccgaccgggcaacccggaaggaggcctatgaggttttgggaaagaccctgaaggctcacagtgaccagctggacggtatctttgaccagctggtgcatgtccgggaccggatggccaagaaaatgggctatcaaaactttgtggagctgggctactaccgcatgggacgcctgtgctatggcccggaagaggtgaagcagttccgggaaaatgttcgccgggatgtggttcccgtggttgctcggctgcggaaggagattggcaaaaagctgggggtggacaccctcatgctctatgactatgatctgattttcccccagggggacccagcacccaagggggggaaggaagcgatttttgccgcagccaaaagaatgtaccatgatatgagccgggagacgggagagttcattgattttatgctggccacagaggcctttgatgtggacgcccggaaaaacaagtggggtggcggctactgcaccagctttatggcctatcaccagcccttcatcttggccaactttaatgggaccgccggggatgtggatgtggtgacccacgaggccggccatgcctttgcagactacaccacggccaataaccggtacgttgtagagctgggcgtaggcggtatggagacggcggagacccactcgatgagcatggaattctttgcctggccttatatggcgcagttttttggagaggatgcgggccggtatgaatttatgcacctgctggacgccctttccttcctgccttacggcactatcgtggacgattttcagcggcaggtctatgaaaatcctgattggacccccgccgagcgcaaggcggcttggcggcagctggaggcagagttccgtccccacattacctttgacggaattccctacctggaggaggggacccgttggcagtatcagatgcacatttacgagacgccgttttactatattgattactgcctggcgcagacggcggccttgcagttcctgctggcctctcgtaaggattatgatgacgcatttcaccgctatgtgcgcttcctttcccaaggcggggagaaggtctttacagagcttctccaggaggctggactgcgctctccctttcaggagggggcgcttcagaccgtggcccaggagagcgaggcactgctgaacgaattggagcgtgcgctctcccaagaaacgaagtgagtggggcgcgcctcggtgataaatgagaaagacggaccgccggcggatagccggcggtccgtctttctcgttgtgagaggacaggatattgcacacaaaggacagttccgagaaatatcctctggaacaaagcttgctgttttctcaaaggggctgcttgggttgtggcgttgctttcttctccgccacaatacagagccagccttttggattttcactcattttcagattggagaaccctgcctgccggagtaagcggcggaggtcttctgaggaatagacgcgcatgccttcaatgagacttgcccatttggcccccttggcatccgctccgctggcttcattgcagagcagaaaaaggccgttgggctttaagacgcggaacacttgagcaaaagcttgcgccaagtcgggccagaaataaatggtctcaaaagcggttgccacatggaacgcgtcgtcagggaaggggaggtccatgacgtttcccaggacgatttcacaccggcccgcttctatggcggcagcgttgcattttctggattttgccacgctgacctcagagtaatcaagcccagtcacgtgcccttgggggcttcgagccaatagctttttgacgttggcgccccctccgcagccaaggtccaaacaggaggcgttctcctgtatggcgatatgctgcaagccaaacgcggacagagaggcatgaccgtggttcatcatggttaccatcagctttccgcccaatccctccggctttcgcgtattttggaaaaaggccataaacacctccaggtatatagaatgttgaggtttgcttctgctaactatttaaagtatacactgttttcctgggattgtaaagggagattcttgcctcctttctggacagggtatctcctttgtggtagtatggttgcaaagaaaagtaaatattgatttggagggaaaatgaaagaggaatacttgattcaggcttgtacgggaaaaagagtagacgtgtttaaggggcagaccattacggtgattgatgtttctggggggcaagtggctgatttctttgcggagtccctggacaacgcggaggagttcttatccactggggttacaatggactgcaatgagtcccttcgtttgaaggtaggagattttatttactctaatttatatcggccaatgttccagattgtggaggacgaggtgggaatgcatgatttgctccacccatgctgtcggcctgagatgtatgattttttctatcaaaatggaaagggacaccccaactgccacgatacgataaacagggtcctgggggaaagcagagcgatgatctgtccggtaaacttatttatgaattcgcaaattgacgaagagggaacgataaaagtaaagccccctttgtcaaaggcgggagataaaattgttttcagagctgaaatcgatgtgcgggtagggattgcggcatgcagcgtggcggaaagcccatgcaacagcggtgtatgcacatccatccaggttattgtggacagagaataatgtgtaaggccatagagaaagcggggatggaagggccgtatggcgggctccttctgggcttccccttgactttcctgggctctcgtgctaaagttaaacatattacaccacgagtttaaagctgtaaaggttaaatgatcttgaaagaccttttgtcccaacaaaaagaaaggaccgtcccactatgcctgtgactgattttttggaacgcaatgtcaaactctacggggatgaaaccgcgctggtggagctcaacccggagatgaaagagacccgccggatgacctggaaggaatacgatctgatccagcccaccaccgatgaaccctaccgacgggagatcacctggaatgtgttcaatgagaaggccaaccgctttgccaatatgcttctctcccgaggggtgaagaagggggacaaagtggcgatcctgatgtacaactgtctggagtggctccccatttattttggggtgttgaagaccggggcactggccgtcccgtttaacttccggtattctgcggaggagattcagtactgcgcggacctggcggaggttcaggtgctggtctttggcccagagttcatcggacggattgagactgtggcggacaagctcagcaagggccggctgctgatctacgtgggtgacaactgccccacgtttgccgagagctatcgagagctggcagcggactgctcttctgcgccgccccaggttctcatcacggatgatgacgatggcgcaatctatttttcctccgggaccacgggatttcccaaagcaattctacataagcaccggagcttaacccaagcagctgaaatggagcagaagcaccatcggattgagcatgatgatgtgttcttgtgtattccgccgctctaccacaccggcgccaagttccattggatgggcagcctgattgcaggcagcaaggcggtgctgctgaaagggacggccccggagattattttgaaagcggcctcagatgagcaatgcacagtggtatggcttctggttccgtgggcgcaggacattttggacgcgttggaccggggagagattcagctgtcggactacaagttggaccagtggcgtctgatgcacattggcgcccagccagtcccgccctccctgatccggcggtggcgggagtatttcccccaccatcagtatgataccaactatggcctgtccgagtccaccggcccgggctgtgtccacctgggaatagacaatattcagaaggtgggcgccatcggggtgcctggctaccgctgggaggtcaaggtggtggatgagcacgggacggaagtcccccagggtgaggtgggggaactctgtgtgaaaggcccgggcgttatgacctgttactacaataatccggaggccactgccgaggtgctgaaggatgggtggctctatactggagacatggccatgcaggatgccgacggattttatttcctggtagaccggaagaaggacgtggtggtcagcggtggggagaacatctacccggtacagattgaggatttcctccgggccaacgataagatcaaggatgtggcggtcattggtctgccggataaacggttgggagagatctgcggcgctgtgattgaggtgaaagaggggatgcattgtacggaggaggaaattcaggcgttctgcatggatttgccccggtataagcggccccgaaagatcatttttgcggaaattccccgcaatgccacaggaaaaattgaaaagccagccttgcggaagcggtatggggccgatcacttagtggctcaacagaatcgaagctaatatccctgggaaccggaacaaaggagggagcaagtatgccgagggcaaaaaagaaagagcgcagcttagctatgtatgagcacattgcagcgctgaactctgtggaggagtgctgccgatttttcgatgatctatgtgccgtgacggaactacgggcgatggagcaacggtttgacgtggcaaaaatgctccatgccggtaaggtctataccaccatcctccaagaaacaggtgccagctctgccacagtgagccgggtgaaccggatgctgaactatggcactggagccttggaagaggtcatggaacgggtagatcagcaaaagggtgtcgccaaagaagagacagaaacacggaggacagaatgaaggaactgatgttgggcaacaaagccgttgcccgtgggctctatgaggccggatgctgtgtgatctccagctacccgggaacccccagtacggagatcactgaggaagcggccaaatatccggaaatttactgcgagtgggcccccaatgaaaaggtggctctggaggtagcccatggagctgcggtaggtggaaaacgagcggcctgctgcatgaagcacgtgggcttgaacgtagctgcggacccgttgtttactatttcctatcaaggggtggaggctggtctggttatctgcgtggcggatgaccctggtatgttttcctctcagaatgagcaggactcccggcactatgccatagcggccaaggtgcctatgttggagccctctgactcccaggaggcgttaacctttgcaaaagaagctttccgcctgtctgaggaatatcacaccccggttttgctgcggatgtgcaccagaatctcccactcacaaagcattgtggaacggggcgttcgccaggaagtccctgccagagaatacgtgaaagatcctctgcgggtgatgatgaccaccaattccctcaaagcccattatcgggtggaggcgcgcaccaaggccatgacggagctggcggaaaccagcccgctaaaccgtctggaaatgggggaggatacctctttgggcatcattacttcttctaccagctatcagtatgttcgggaggtctttggtgagaaggcctgtgtactgaagctggggctgtcctggcccatgccggtacagaagatccgggactttgccgcgcaggtgggccaggtgctggtggtggaggaactggaacctatcattgaaaaccactgtcgtcaaattggtgtggcggtcactgggaaggagaaaattcccctggtggatgagcttacccaaggcgtggtggccagaagcctggggcgggaggcgaaaccgaccctgaccttggacgatcccattcccggtcgcccgccggttatgtgcgcgggatgtcctcaccggggggttttttacacgctgtcgaaaaataaatgtatggtctatggggatatcggctgctataccctgggcgtcatgccgccgctgaacgcgatggacctgaatgtctgtatgggggcctcctgttccggacttcatgggtttaatctggccggtggagaaaagcatgagaagcacagcgtggcggtgatcggagactccacctttgcccattcggggatcacgggcattgcggatatcgcctataaccgaagcaactctacggtcatcattctggataattccatcacggggatgaccggacaccagcagaaccccaccacgggaaagaccctgcggggagaaccggcgggaaagattgacctggaggccctgtgccgtgccgttggatttgcgcgggtgcgggtggtggaccccaaccagctcaaggagatggaccgggttttgaaggaagaactggctgcggaggagccctctgtgatcatcacccgcagtccctgcgtcatgctgaaggacgtacctaaggcgccgcccttgaaggtagacgcggacaagtgcaatgggtgcagtctgtgtatgcggattggctgtcccgccctcagtctccgggatggaaaggcggagattgaccggacccagtgcattggatgccaggtgtgtatgcagatgtgccaccggaacgcattgattgtataaggaggaaacaagacgtggaaactgtcaatattatgatcgtcggtgtggggggacagggttccctgctggcatccaaaatgctggggcacctgttggtaaatgccggttacgatgtcaaggtctccgaggtgcatgggatgagccagcggggtggcagcgtggtgacctatgttcgctttggggacaaggtctactcgcccatcattgacaagggagaggccgattttattgtctcctttgaactgttggaggcggcccgctggattgcctacctgaagcctaccggccgggtggtgaccaatacccagcagatggagccgatgcccgtgatcgctgggctggcgcaatatccggaaaacctggtggagaagatgcgggccaaggggattcaggtggatgctatggactgtctggcgctggcggaggaagctgggtctgccaaggcggtgaacatggttctgatgggccggttgtcccattactttccagacattgcgcctgaggcctggcaggcctctctggaggccaatgtcccggctaaggtgctggagctgaaccgcaaagcgtttgcgttgggccagaagggctgagaacgggaaaaggataaaagcaagagaggcgaaggagcctctcttgctttttacatttctttttcgtatttgacccgataataaatgctgcatcccaacaccaaaaggtagcaaaagacaaacagaagaatcgccgccagatccacctgcatgagggcaaaggagagcatcagggcgccatagacaaacagcataatatcaaaggcttttcccttggcggaattggaaatggcaatgtttcgctcgtctttctgttcaatttccaactgcttctgcaggtcgggggagcctttcaatgccttccggctcagcatccctcccatgccgtggccaaaggcgccgcagcccacgccaatgcagacgaaggggagaaccgccattaccccttgagagtctgcataccgtcgaagcagaacaaagccgatggcagccaagagaattcctaccacagttttcaccacatcataattgcgctctttcatgttgcatcctcctcgtagataaaaatatcctcaatggtggtgttaaaatagcgtgcgagtttgaaagccaaaataatggaagggttgtatcttccgtgttccaacgacccgatggtttgccgggaaacctccagggcagcggccagctcttcttggctgacgccatggctttttcgcagtgcttccaatcgatttttcaagagagacctccttttttgaatgtaaagtaaactttccaattttgacgaaaaaattttgagaaagagaaaaaagccctttctgttggaaagcttactttccataaagagaataccatggcgtcaaagaaatgtcaagtatactttccgttcggagaaaaatttttgaaaaatcccccgccggtcgattgacaggcgggggaagagaggggtcactcactcagtgcattcttctgagaaacaggtgcctttttttcgtagcaggagaaggcttcatccaccatggcttgatcaggctttttggtgaacaagctcaccacagggacaatcacaaggcctgccagcatggcgaaggcgccgcagttgatcgaggattgcagcagggtgggaaaagcaaaccatccggtggaggtggagatcagatttagagtcataatccccgaaccaaagaggaaagaggcccagcaagccgctttggtggtttttttccagtacagaccatagaggaagggggccaggaaagagccagccagcgccccccaggagactcccatcaactgggcgatgaagctgaaggaatttttgtactgaacaatggccaggaccatggaaatcaggacaaaaaccacgatgaaacagcgcatgatgaacacggcctgaaagtcgttcatctttttgacaatgttgcctttgagcaggtcgatggtcaaggtggaggaagaggcaattaccagagaggacaaggtggacatagaggcagagagaaccagaatcaccaccaccgcaatcagcagatcgggcaggcccgagagcatggcggggatgatggcgtcatatccctcggaggccacgtcaacctgatcagcgaacagacggccgaatccgcccaggaaatagcagccccccgccaccaccacggcgaacagagtggagatgatggtgcccttgtgaatggagtcctctgacttgatggcgtaaaatttctgaaccatttgaggcagtccccaggtccccaagctggtcaggattaccacccccaagaggttcacagggtcggggccaaaaaaggaggcaaaaataccgggtacctctccgtttacggtttctggatcggaaaccgcggccagcccgtggagcgcttcaagaaaaccgccctgggtattgagcacggcggcaatgacgacgcagatgcccaccagcatgacacagccttggataaagtcattgatggcagtggccatatagccgccggcgatcacatagatacctgtaaggacccccatcagaatgatgcagacggtgtaatccatgtggaacgccatgccgaaaagccgggagagaccgttgaacagggaggccgtgtagggaatcagaaagacaaagacgatgacggaggcgccgatcttcaaagacttgctctgaaatcgctgaccaaagaactggggcatggtggcggaattatagtgttgggttaggatgcgggttcgccggcccagaacagcccaggccagcagagagcccaggatggcgttgccaatcccagcccaggtggcggcgatgccgtacttccagccaaactgcccggcatagcccacaaagaccacagcggaaaagtaggatgtgccataggcaaaggcagtgagccaagggcccacggagcgcccgcccagcacaaaaccgttgatgcctgaggtgtgctttcggcagtagaggccgatgcctaccatcacgccaaagtaaaggattaaaagcgcaagcttcacagggaatccctccgatcatggatatctttaatgctttttgactttaacaccaaaaagctaaaaagtcaagaagaaatgaaaaaagagacgaaaaaacaccgcctcctcctggcagcataccagggaggaggcggcgcggagtgtatgagaggttgtacttatttggtagcccagttacctgtggctacggcggtgagataggcgttaataaatccgtccaggtctccgtccatgactccgttgacgttgctggtttcaaacccggttcgggtgtccttaaccaaggtatacggcatgaagacgtaggagcggatctggctgccccattcaatcttcagctggacccctttcaggtcggaaattttttccgccttttcctgcatctgcagttccaccagcttggcgcggagcatcttcatacagttgtctttattctggaactggctgcgttccgtctggcaggagaccaccacgccggtggggatatggatgaggcggacagcagaggaggtcttattgacatgctggccgccggcgccgctggcgcggtagacctgcatttcaatgtcctccggacgaatctccacctccacatcctccggcagatcgggcatcacctccacggaggcgaaagaagtctgccggcgggcattggcgtcaaagggggacacgcggaccaggcgatgcacgccgtgttcgccccggagatagccgtaggcgttttccccttcaatcataatggtggcggatttcagtccagcttcgtctccctcctgatagtccatgaccttataggagaagccatgacgttcggcccagcgggtgtacatgcggtaaagcatttgggcccagtcctgggcttccgttccgccggcaccggcatggaaggccaaaatagcgttggaggcgtcgtactccccggtgagcagggtctgcagtttggcggattccacgctctggatcagggcgttgtactcctcttccagttcaggcaggagagattcatcttcctcttcattgcccatttcacacaaaaccatcatgtcctcccaggaggcacggcgcttttcctgggattccagcttgtttttcagctgtttcagtttctggagaacccgctgggagttctcggggttatcccaaaatccgtcagaggcgctttgtgcctctaaaaaatccacctcacgggcggcgctttccaagttcagtgccttttccagctcgtccagctgggggaggaggttgtttagtttgaccttatattcgtcaaattgcagcatcgttacaatcactcacattctgaaatattgaacttatttattatatccgatctcccataaaattgcaataagaagaggcgggatttgaaaaaacagcataccggggcaggaccagccctttggtcgagggagccaactaatcagcgggatgccgctgctttttgtaatctttggggttgataccgtatttgttcattttccggtaaagggtgctcaagggcatggagagggcagcggtggtctcctttgcgttgccgccgcaggccttcaaggtatcgacgatccgctgggattcctccaggttggcccgggagtaaggggaagcgggatctgctggaggagcggatggaagggtatcctggagttctgatttggcgtcctgggactgctttgccttgccggcatagtaactgctcagcagattggtgggcagatcactgagatgaagcacaggaccctccgccgtgtggaggagctcttcgatgaccgactccacctcccgggtattgccaggccagtggtattggaggaatgcggcggcggcctcctcgtccagggaaactgcggcagtaccagcggtaaaggactcttgcgcgatgaaatggttgacgatggggaagatatcctctttccgctcccggaggggaggaattgtaatggcaagtgcgttgagacggtaatacaggtcggcacgaaagttctttttctgcaccgccgagagaaggttcaccgtggtggctacaatgagcttaaaggagacgctcttgggatatttgccacccaaacgggtcacttggccggtttgcaggacctgtaaaagggaggcctgggcctccagagagagacagtcgatttcgtccaggaaaagggttccgccgttggcctgctcgaactttccggtgtagccattttctttcccgccgcagaatacgccgccttcgtagccgaagagctcactctccagcagccctcttggaattttgccgcagttaaggcagacgaaggggccctttacccaggggctttcgttgtggatggcctgggccagaatctcctttcccgtgccgggctctccaaagatcagtgtgggtgtggcagtcgttgcggcaattctacccatggtctgtaccgattgaatggaaggggaggtcccaatgatggagtcaaaggtgtaatgggcggaaaattcattgctgcgataaaccagacgagtcagcgcggattggtcttccagtttgatcagcgttgtatgcagtcccgtttggtcgctggtgggaaggaccgttaggctgacatccagcggtgtttgataacggttcagaatggtgcactccatggaagagatcctttgtgacagaccctgggcaggggccggcagggaatcctgccggagtacggaatagatagactgaccaatcaagaggtcctcgctgatacgaaggacagagcgggctttggcgttgtgatgaatgatgactttgtggtcatcgaggaccagaattccctctgtaaaagcgtccagggcagaggtgagaaccgcattggtctgccggaaagagagctcccgctcaatgctgttgatggctgactccagcatagttagagcggagggatgatagttggccagaggaccggagatatccacgcaccctatcagatgatggaactgatcgtggatgggagctgcatagcagatgctgttgtggaaacgctgctgaaagtgctctggaccgaagaccatcactggtttttccagagaaagacagagggaaattccgttggtaccggactcttcctctgagaatatggttccattgctgatcgggtactggataggaggggcttgggaggttccatcgtcaaagatggtatctaaaatacagccgtgggcgtccacgatggtgatttgatgcttggtctcccgcaggtattgaaagaggttcattaaatatggacgggcaatgcggataagctgagcattgtcttggaccagtgcctggaggtggtctgagggaatggttttctcaagggcaaagggatctgcctgccccttggagcgccgccaagaatcgacgatttctggtcgaacaccagggatttgctcggggacagattctggtccggcaacgtaacgtgtccaggccgtctgaatccgctggaaatccaggttttctttcatggtatccttccttccccaaaacgagaattttctacgatagaaaaaatctaacacaaaaataagaaaaacacaagagatttcttgaagaatcaagaaaaaacaacgcactctatttggtgaaaaagaagaaatgagaaattatcactttgaattcttgaaaagctgggggaaaactgataatattatcaccagaaggcgcgagaatttttggaggaaatgagaaaaatgagagagaaaacgctatgcctgcttttggcagaccaagggtttggcgtatctctgtctcacgacgttctccaaaacgcgatcttaaaccattacgatttgggaggatgcatcatgatttacaaaccagacaaagtgtcaaaaatgaaaggtgcggacatcatcgcagagtacatgatgaaggaaaaaatcccctatatgatcgggtacgccggtcacggtgccattgggatgctggattccttcttcaacaagcaggacgacatcaaaattgtatggccccggattgagaccgcctgtggctttatggccgacgcctatttccgggtgaccaaacagcctctgccggtctatgtctccaccggtccgggaccggctctttccacctgtgcggtggccaatgcgttttatgactcatctgcgtttctgcaatttaccgggcaggcccccttgtcccagtttgacacaggagccctccaggagcagtaccggtatcaccaagcggatttctccacggctatccagccctatgttaaacagagctatcaggctgtgaccgccggacagctgtcctccttcctgccaaaagctttcaagctgatgaagacgggacgaccgggaccagtacatattgaggtgccctatgatgtctaccaactggaggcagagactgttgtggcagaccccattgactggtcggattccattgcctggcggactggcgcggaggaccgggttatcggctcgatcctgcaaaagctgaaagaggccaagcggcccctgattctggccggcggcggggtcaaccactcctctgcccaggaacagctgcgggtatttgcggagacgatgaatatcccggtgattacctctctcatggggaagtcctctctgccggagagccatccgctgtgcttgggtgtcaacggaacctggggacactatccagcggtggaggctgcccggaacgccgacatcatcctggccctgggttgccgcttcaatgatctgcacactgccacctggcagccgggctttgcctacaacttccctgtgaccaagctcattcaggtggacattgacgcctctgaaatcgcccgaaactatccggtggatgtgggcgttgtgggagatatccgcacagttctgacccaactgatcgacatggcacaggagaaacaggtgaccggagactacaccgtgtggcaccaggagatcgccgggtatcgaaaggaatggggggacttcattacaccctatggtcagagtgatgccgatcccattgacccccgccgtctgatcaccgacatccgcaaggtagcccccaaagacgccattatgttctccgacgtgggcaacaaccagccttgggtggagcagtattggaccaccgaggttcccaacacccatttcacagcaggcggattcgcggccatgggctttggtgtggtcggcgtcctgggtgccaagctggcccggccggagaccacctgcattaacgtctgcggcgacggcggcttcatgatgatgccccatgcggtggccactgcggtgcagtataatctgccctgtgtttggattgtcatgaacaactatgccattggcgccatccgggacctgcagaaattctattatggcggccggatcattgggaccagctttgagaagtatgagggcagaacctaccacgatggcgaactgtggaatcctgattttgctgctatggcccggtccatgggcggacagggcgttacggtcaccaaacccggtgagattgccggcgcggtagagcacgccatccagtccggcctgcccacggtcattgacgtgaagattgaccgggatatcaccgtccctctgacaacgacttggcagatgccccccatcccgcccgctctgcccaccttcggaaagatcaaggtgcgctgaaaagcggaaggtttggcaaatggcgggagaggataaaccctctcccgtccaagaaaggagttctgctatggaggcaatggaacgatggctgtcctcccagcagggagacctttctgccccgggactgcatctgttggaagcggccctggcaagctggcgttattgtccagcaggcgtgcttccagaagggctgagggaagaccttcagcaggccttgggagaggaagaggtccaggcagcggtgtcgaatctgctggcctgccacattttagaggaggtgccgggacaggaatcctctggactccgcctgcgggaggaagcgagaactacggtatccgcctaccttcgtcggacgcgggaaaaagttctgtggagaacggcacaggggatggtgacaggggagacatatcttttccaactggtgcaatacttacagcagttggaaccatcctgtacagtggcaacgggacaggatggggaacttttcctcactgtggaaggggagcgttaccaaatttggagaaccctctctcccttttggttgcccttggcggtgaaagaggaggatggggacaggatccttgtctttggtccctttgcggcccaagactggggacggctttacccctactatgattgggaggcctttcgggacacaatcgcgctgtatgatccctggcgccaagaaaagatgagcttgtgtagagggcgcgtgccggtgtacattgattggttccaccgggatcaatatcagggcagattctccatccctgtcaagttctgtgacgtcctgcatcagctgggactgatgcgatacaacgatgagcgataaaggggtgggaatgcaacaatcaatgcgattagaaaaaagaaaggaaaagaggtgcaggcaatgacaaatgaactcctgttggttggaacgctggtagcctactttggatttatgctcctggcgtacaagctgtttggccgggcgggattgtatggattcaccatatttgccaccgtggtgggaaatatcgaggtgttgttgttggtcaatgcctttggcatggaccaaaccttaggcaacgtcatcttcgccacgacctattctgcggccaaaattttaagtgaaatggagggtgaaaagggaccggactacgcaaagaaagccacttggcttagtgtggggaccaccggggtgtttatgctcatcacccagacgtgggcctggtacgcgccggcggatggaggactgctccagcaggtgttctcgaactcgccccggatcatgctttccagcctggtggtgtatgccatctgtatgctggtgcagattgcggcttacaagttcatttggacgctgcaaaagcatcgggaaagcggacaatgggtccgggcaggtgtatccaccctgtttacccagctggttaataccatcctctttacgctgttcgccttcctcggtgtctatgaatttagcgtgatggttgacattatgctggcaagctatattatctttattgtcacatcgttttgggatacgcttgtccagatcgtggcaaagaaaacttgtaaaaagagcaacattctatttaaggagattgactgacgatgaaagttttggtaaccggaaccagcacgggaatcggccgtgggatcgcagagaaatttttggctgagggctatgatgtcatcggatttgatgtggcggagagcaccattgaccatgatagatacacccattacatcgtagatgttgcctgccaggagcagcttcctgagattggcgaagtggatatacttattaataacgcaggcgtccaggatagcggacgtgacattgatgtcaacctgcggggtaccatttactgcacggaaaagtatgggattcagcccaacattaaggcgatcatcatgacggcctctgtcagtgcccacaacggcgcggagttcccggaatactgtgccagcaagggcggtgtactggcctataccaagaatgtggcgctgcgagtggccaagtacggggcgacctgtaacagcatctccgccggtggcgtgatcacggagctcaatgcacacatcctggaaaacaagtcgctgtgggaccaggtcatggcggaaacgctgatccccaaatgggctacggtagaggagatggcggagtggacctatttcctggcggtggtgaacaagagcatgactgcgcaggatgttctaattgacaacggagagattgccaaggccaatttcgtctggtaaccgattgcttcccgaacgggggcagagggacttacagccctctgcccctggtatcaaaggaattgcattcctgcccccggacgaagcgccggaatcccccgggttttggaccgcgataaaaataggagggacggccatgaagcgtgaacgggagacagtacaccagcggggcaggctggtttatcagctggaggaaaccccgcctatgggcagacgccttctctacgccatgcagtttgtgattatcttcattggttccattgtgctggtgccgatgcttgccgcggacgatctgggttggggaccagagcaggtcacattcctgctccagtgtgccatctttacagggggcatcgccacttttgtccaggccaagggcctgggaccggtgggggcccggcttccgatccttctggggacgacgtttgtggtgatcacgccgctggtggcaatcaccacggagtatgggtatgacgcgttcctgggcgcggtcattgccgggggcgtggtttatgtccttctggcatggtttggcttccgattcctgcgtaagttgttcagcagcacggtttccggtaccctggtgatctccatcgcgctgacgctggccccctcctgcgcggatatgatggcagggggcagtaacccagtgggcggcggttacaacggatggcagaactgggttctggcggtaattactatgggaatctgcctggtgggccactgttttggaaagggatttcttaaaaccaccagcctatttttcgggttggccactggatatatactggcgctggtcatgggggtgattccctttgacaaggtggaggaagcggcatggatttctcttcccaggccttttacctatggggtgtctttccacctccaaccgatcctgattatggtggtgatttatttggtgactgcggtggagtttattggggacaccacggccaccgctatggtctgtgaggaccggctgcccacccagcgggagctgcggggcggaatcctctgcgatgcactctccagtgttttgtctggggtattcaattttgcccccaatatttcttacagtgacggtgtggggatcattggaagtacccgggtggccagccggacggttatgatgaccagtggagttctcattaccctggcagggctggttcccaaattctcggcgctgctgtatacaatgcccgctcctgtcttgggaggtgcatgccttttcctgacggggattatgctcatggcaggcattgaagtggttctgacgcagccgctgaccctccgcaattctgttatcatcgggacatctctggcggttgggattgggttcgggttcagcggtgttttggaacaggtgccagtgctggtacgtaccctgttcagcgggattcctggaactgcgttgacaggggtatttctcaacctggtgttgccatcaaatcactgatatttcctccctgtcttgataaaagccctttcccccagtggattccactgggggaaagggctttttgggttgttgtatcctgggattagccgtgagaaggcggcgcagagagggagacaaagctggcgccggaacgagccgccaactgccgataatgtttgtacaaaggggcaaagcgcgtggcataggaacgtttccaaggctttcgcttgccgcagaaatgtaggattgccgtgtgctgcatcacccagtccatatggtatgcaccgccgcttcgcagcaggtagccggagtagtatcgggcgtcatagttccacagcgcgtcatcaatttgcagggtttgagcaccatacagtgagttgaatacatcttggtctggtagaagaagctcattctcatggtcacggacatattggaaaatggcttctggctgcaccaagacacgggcagcctctaaatccatgagcatcacaccggagttgtaatagtcctgttccgtcttcaggcggatgcgattgatcccgttcatcacgtcaaccacaccgatgtgggaggcggcggcaaaaacatttccctgcagatcgaggtcccataggggacgcaaaggattaatcacgagaatatccgggtcaaggtaaagaacccgtttcagtgaggctgggaggatgtgggaagccaacagccgatagtacatttcctgtggatactgctttgtgatgggagcgccctgaaagagctgccgttccacagcaatcggcgtcagtggaacgccgtgggcacggcaatcgtgttccagtgcgtccagcgcggtctgaggaatggcgctgtgcagaagccagacatggaactgttccccggggttgttgagaaggatagaggtcagcatggtttcgaaaggggcgatataattttggtcaaaggtgaccaaaagatgaatgcttgtcgatttcataggctgagattctccatggatcgcatgccgttgggggcttgtccaagcgtagaaaagtccacctctggcagaggataaatttgaactgattttttatatcttagaccgaaaccaaggatttatcaagtaaattggttgcaaattcttttgcagtcatggtaagctcaggaaaaagggagacgatgggagaggatcaccatgataacttctggtaaaaaagctatgctgcccagtgagcgttccaaggtatggaaggttgtcacttcggtggaacactatacatggcgcagtgatctgcgggggacggaaattttgtgtgaaaatcagttccttgaataccccaaacgaggccctgtgactgccttcaccattacaacagtggagccttgcaaccggtgggagtttgatatggaaaacaccaacatgcgtgggcattggacggggctgttcacgcagacagaggaggggacagagatggaatttacagagaccgtggaggtgaaaaaacgttttctcaagctgtttgtaaaaggatacctgaaacgtcatcagacgcgatttgtctccgatctaaagaaagcattggaaaaggcatagctgtgttagcatgtttcataagcggcaagggggcgatatggacaaaaaaatagagagcggatgcagcaccgttctccattttcttcgatcctatctggtaaacaatcagagccatgggggttcctggaagggaagcgtgaatcagtgcttcccttaacggtcgctgacgggaggaatgttggactcccagtgaaagataaagtcatccaggtcttgcggcgctggcaggacagggggaagggtgcgggtattgtgctcagacataaagaaagcctccttttgaagatatccaacccagtatatgcagcgggggagaaactatgtgcgtggcaaagccggaaaatatcgccggacgcaaccctttgccactttgggcaaacattgcaagagacagatgggaatggggactatggtttcgggcagactatgcctgggtgatgagaatgaaatatgaagatccccggatggaagcttattttaactcgcttccttccaaagtgcgggcgtttatcaataattcccgtgccgatatcagcacacccggtgagcttatgcttatcggagaacattttcgaaagagctttggggagccggaagagggcccccggggcaggaactaatctgttttcttttggactcccccgagcaccaatgtactggtgttcgggggctcatttcacgccaagagaaaacagcggctttggcaatgatgatatatcgggaaacattccctgtgtgcggcagcgtttccgctttcccagccggggattctgttgcattttgcgaaaagaaattcccttaaaatcaaaaaaggggattgacaattccatctaaccgtgctatattaattaagcacttaagagtgtgacgaccgggaaatgccggagtggcggaattggcagacgcctgggacttaaaatcccatgggagaaatcccgtgccggttcgatcccggtctccggcaccatatcgcggagtagagcagttggtagctcgtcgggctcataacccggaggccgcaggttcaagtcctgtctccgcaaccatgaaacgtgaccgattgtatcggtcacgtttttttgtattcaaaatgaaccatatttgtcatacttaaagaagaatacgatataccatagtttgggatgccggcgggggcatggtccaaaagaagcatagggggcacctgcctgcatcgacctgaaaatagtagaaaaagagtcggcagaatgctataataaaaaaaccttcggtggctctgtgaagaaccagggagggaaaaaggggcgtggaaaccgatgccgcgacaatctgggatgagtgccttggaaaaagagtggaaggccattgaaaaacgggaacaacgcctggccaagctggccctgcagggaaaagattctgcctggaaggggaagctggaagagaaggtcccgcctaaggtttcccgggcgttagaggcggcgttttgcaaagcctttgcgctggtgtttgaaaaaggaacggggatcattgagaaaagctatgacagcgcggacctgcggcaggcctatatccgccgggaggagggcgtgcggcagacgatggaccgccggtctcttcgccgggttcaaggggaggcccgaacgggggagagccggaaccttctcctgaccacggtggaggggatcggccttggggccctgggcattggcctgccggacattgtgctttttgtgggaatgctcctgaaaggaatctatgagaccgctctgcggtatgggttttcctatgacacaccggaggaacggctgtggattctaaaggcgatggaggcatccctgacgaagggatcgggctggttggaaaggaaccaggcagtggaccaaattatggcaggcagcgtggttccagatcaagaggcattaaagcggcagagggaccgaaccgcccaaacctttgccatggatatgctgttgttgaagtttgtccaagggcttcccttagtgggggtgctgggaggcgtggggaatccggtgtactaccgccgcgtactgcgctatgtcgcgttaaaatatcgtaaacgatatctattccaaaagagagaggagctggcggaatgaacgaatttattttgccccagggagaccgcgcggcactgatgccaggggccgcatacagtgtgcctgggctgtttctgtactcggatttgatttaccaatgcctggatcaggtcaaggagaagtttggctacgccattcctgtgcggtatctctacggtgcgcctaaggtccgatggaactgtggccgtctgattattacggacccccattatacccgggaggagatatttcaggaactggcaggggcggtggcacggggaattgtcccattgctgaccttctcctccccagagattgccccggcggatttgggggattctgcctgcaatgaggttctggccatggcggaggaggtgggcggtggagtgattgtctccagtccgctgctgcgggattatatccgggcgcattatccccgggtggagattcacgcctctgtcattatgactgcctttcctgagaagcgagaccgggcgtattatgctggcctggcgcggtcgtatgatcggtatgtggtccacccggacgacaattttcagtgggatttattggagagcctccccaaagacactgcggaagtgattctcaatgaacggtgtgtgcatcagtgcgcccagcgcagagcccattatgaatccatcgtacaggatcagagggtgcttatagagggggagggagagctgaccaatttcctggaccgctgtccctttgtgccggatcataagcaacacgggaccaaagccagaaacatatccttgaccacgcaggaggctgtgagactgcgtcagatgggatttaccctgttcaagctgcagggacggctggacatcccttacgtttttttctttgattttctccgctatacgttggaaaaccaggtggccttccctgcgatgttccccattttttcctatgccatccgagggcatttgaaagacaaggagcgccggcgcagggagcgtggaacacggtaaaaagacacgcccgtgaaacaaatgcactttgtttcacgggcgtgtttccattcatagatggaaccggcgccggacttcttcccggagggaagggacccggcggacaacgatcaagggaatgatcagaatcacgcagacggccaggacgatgagggaccagccgggagaccagtggcccagaaagaagaggtcaacaaaccgctctacccccagaatgaaaacgccgatggaaccgatcaccagtgtcatggaggtcagtgtgctccgtttcctgcggcccatggtcagcccccaaaaaaggaaaagagcgcccagcaggagaataatggggagcgccaggtgccaataccagtcccatccgtctaaatccacggcaatcaaagagacatagaccgcgatggccagcacatctgccagcagctggagccgaaaggtatccttccgatgatggagcagagggggaacggtccaaatccagatcatcagcgccgccccgatcacgtacaaagaccaagtgcgctgggtgcgcagaaaaacgtttagcacaccgcagcagacagccaccgaggccaggattgtggagagaagaatggcgacctggagtttggaggcagggggaacctctttccgctctgtgggaaagggcttgggcgccgtctgattgactggctggttggggttatggactggggtgtggcagagtgggcagaatgcggcggtgtcgtccaactccacaccgcagttgacgcagtaagacatgtgaatccctcccaaaggatcaatgggtgcgattggactctactttcacgggaatcccttcgcggactaaatggcaaaaaaatcttcgttctgtttcactggagactccggtgccggcaaaggtgatggccatggtgttgccatagctgatggaggcgcagtggggggaggggcgggtggcctgtcccagcatgacctccatccgctgaatgtggggttccatttccgggggaaccgggaaggcgccggggttggtataggttccggaataggggcgcacgcccaccagtttgtaggaaaaagccatgacggggttttttagggccaaaggaatgatttgcagaaagtgattcttggtaaactgcacattccctgtgagtttggcctgcatttcctgccggttggcgtgaaggtgcatatagctgtgaacctgccgcacaatttcaggcaaagtatattcccctaatgtggggtcaatgcaggggcgcatggtaaggataaagtttcgcagggtttccgaggggaaccaggggcgcagattgatgggaatggccagtgccacaggctggggatggcgaaaccggcgggccgcctggttttccaaaaggcattggagaagaactgcggtaagatactctgtgatggttgcttggtatgattttgcaacctcccgcagccggtccaccggaaccagccccagggtgacgttgagggtatagaaaggctcgggggcgctggtgttggggaaggcggtcttttccagcttgccccgcagcgtccggctgccggcataccgggcataggcgtcctccagctcttcctttcggggtggggcggtaacatccaaaatgcccggcccattggggatggaaaagcccagctcccggagatagaccgccagcagcgtgcggaggaagaccagcgttccggcaccgtcggagatggcgtggaaaacctccacggaaatccgcttttcataatagaggatgcggatcagccagtcattgtcctcgtgaaaccggaggggctgacaggggtttgccatgtccggtttcacaaaggggccgggattggggttgggctcaaaataacaccagaatgcgccccggcgaatccgtaccccaaagccgggaaaacgcggcatggtcttctgcacagcccgctggagcgcctgcgggtctaccgccttagtcataagtgccgagaagcgatagactgcggagtagcgttccttctgaatggcagaatagagtacccctgcgttgtccaaggggtaccaagtatttttttcctgtttcctgggcacaggcagggcctcctccagaaaaattgtgtgttcacaaatacattatagcaagagaaaaggagaacgcaatagttttctggcaccgcatccaaacatcagaagaatccaaacaacctgctggaagcaaaggaggacttccctttcccggcagaacatgatatactaaaaaatcaacacgcgctggagaactggccagagaggagcaatgctatggacccgaaaaaactctccattcgattgagcgccaaggggaaaaaagaggagaaggcaggaaaagaggaccgccgtttggccccgatgatgcgggcgctaaaggccattcactctgttggagcaccggattccatgaatccggaggatttggccaagcagcgggctgggcaggagcttctgggaaggctggcggcaccaatgattgtcatgaaaaagtgggagcccttttccctcaaagggatggccgctgcctgggtgaagccggattggccccacgacagacgccgggtgatcctttactgccatggcggaggctataccagcggaaatttgggatattcccggcctctcgcttccaagctgaccaatgccactggatgggagaccctgtgctttgagtatcgtctggctccggagcatccgtttcccgctgcggtggacgatgcccgaaaggcgtgggactatctgatgtatctgggctatggcgctcgggatgtggtggtggcgggagactccgcagggggaaatctggcactggttctctgccatcagctcaaagaggcgggaaggcagctcccgggacggttggtgttgatgtcgccttggaccgatatgaccgccagcggccgttcctatacccagcgggcagagatggaccccaccatcactatggactatattcaggcagtgcgggaagtctacgcggggggaagggatctgacctcgcccatgctctcgcctctgtttggaaattttgaggggtttcctcctaccttgattcaggtggggagcaatgaaatcttgttctcagattccctgcggctgcgggagcggatgcagacggccaaggttcactgccagctggaagtgtggaatgacatgtggcatgtttttcaaatgtttccggttcggaaagcggcgctggccatggagcgtattggcaatttcctgctggaacagtaatatggagtcaaataaagcggcaggctcttcggatgggcctgtcgctgttcatatgatagggagaacacaagaggaggagacgcgcggcaaccaaaggcgatacaaccttcctatcattctgaatggattcccttttagatggcgtacagcgtgctgttccgcaacctgttctgtgatcagaaaggcaatgatatggcagtacctccagggcagattctcctggttgacaggcacggcaatcgttgctacaatgggggcatctggaaacaaaatattgtagagtatttgtagcatacaggtgcttgcctgcgggcgagtgaaaagggaatacggtgagaatccgtaacgatgccgtcactgtgtatgggagctgcttttcgtgcaatcactgggaaactgggaagagaaaagccgcgaagaacaaagtcaggagacctgcctgtatgtagaatctcaaatctgcggtccacggatttttgttctcacaaatgacgtctaaaatacgggagtattgcagcttcattggtggagagacggtcgcggaaacgcggccgttttttgcaatgttttataccagaaacaagccatagaaagaggtatgaaatgatgggaaagaaactgcttgcactgctgctttgcggggcgctcctggtgacggtgctggccgcttgcggcgcgccagaggagaaggaggtatctgcggaacaggacagccaaccggtggagacagagaaggaaccagacactggggacgcctctctggacaacccccggaatcaggatggtatcggggagaaggaactgctggtggtcagctttggcaccagctacaatgacagccgacggctgaccattggcgccattgaaaatgccatggaagaagcattcccagagtatgcggtccggcggggctttaccagccagattatcattgatcatgtgaaaagccgggacaatgtcgccattgacaatgtgaagcaggccctggaccgggctgtggagaacggcgtaaaaaccctggtgatccagcccacccacctgatggacggactggagtaccatgaactggtggacgaggttgcccagtattccgatgcctttgagcacctggccattggaaaaccgctgctgacgtcagaggcggacttccaggcggtggaacaggccattaccgaggccacagcggaatacgacgatggcaaaaccgccatctgctttatgggacatggcacagaggcagcgtccaatgcggtctatgaaaccctgcaggatcagttgacccagtctgggcatgaaaattactacatcggcacggtggaagcagagccttctctggacacggtgctgtctgcggtgcagaaaggaacctatgagcgggtgatcttggtaccgctgatgatcgtggcgggagaccatgccaacaatgacatggccggagaggaggcggactcctggaaaagcaccttcgaggcagccggatatcaggtggagtgcctgctgaacggtttgggtgagctggagtccattcagaaaattctggtggagcatgcccaggatgccatagactccttgcattcttgatagaaaaatagggaaacagcagcccgaaagggaacctttcaggctgctgtttctgagtggatggaggaaatcatgaagaaatgtatcatgtgtttggccgcagccctgctcttgaccatggctggctgcggagcacagccgaaggaatctaagcaggcggtggccgatcaaagtgatatggcacagccccaagaagtcgtaaccgagggaatggaaccggtctatgcctcccaactgaaggagggcgagtattctgtgaccgtggactccagttcatcgatgttccagattgtctcctgcactctgacggtgaaggatggcgctatgactgcgaagatgacaatggggggaaccggctacctcaaggtgtttctggggacaggagaggaagcggccgctgcggacgaggctgactgcattgcttatgaagagaccgccacgggggagcatactttcactgtgccggtggaggccttggacaaaggcattgactgtgcggcatacagcaagcgaaaggaaatgtggtatgaccggactttggtgttccgtgccagctccctgccccaggaggcctttgtggaagggacaatgaccacagtggctgatctgggactgtcagatggtcgttatgaagtcgctgttacgttggagggcggttccggtcgggccagcgtggattctccagcgcaactcaccgtcaaggaggggcaggcgactgctaccatcgtgtggagcagtgccaactatgattatatgaaggtggacggcgtgcagtatgatccggtcaacacagagggaaacgcagcctttaccattcccgtggcgggatttgactggaaattgcctgtgctggccaataccacagcaatgagtaccccccatgagatcgagtataccttgacatttgattctgtaaccctggagcgtgtggaatgaagacaagaaaaaaactctggatttttttgctgagcctcttctgtcttgtcctgggtggatgtggagcgcaggagggagagacagaggcagaagcaccaggcgtgtcctgggaaagcctgtcatttccgcaggaattggagattctgtatgccacccagttttctgcagcgtcttctcctgagggatataccaaaatttccattgaggacggcttgtcctatctggtggtgccggagggcgcggcggtccccagcggcgtgccggcagagatcacggtgattcagcagcccttggatcatatttatttggcggctacctctgctatggacttgttccgggcgctggaagccatagacaaggttaccctgtccggcgtggaggcggacggatggtatattccggaggccaaagaggcaatggagcaggggaggatggagtatgccggaaaataccgggctccagactatgaactgcttctgtcacggtcctgtgatttagccattgagtccaccatgatctaccatactccagaggtaaaagagcagctggaggactttggcgtgccggtgctggtggagcggtccagctatgaaaatcaccctctgggccgtatggagtggattaagctctatgggctgctgctgggccgggaggatgcggcggcggagtattttgatacgcaggttgagaaactgagagacatactgcaaacagagaacacagggaagacagtggcgtttttttacatcacctccaatggcgcggccaatgtgcgaaaatcaggagattacctggccaaagccattgaactggccggcggaacctatttgttccaggatttgccgggggaagacaatgcccaggccactacaaacctgcagatggaggccttctatgccaaggcaaagcaagccgatgtgctgatttacagcagtaccattgacggagaacttcagaccatggaggagctcttggaaaagagcccggttttgtcggattgcaaagcggtcaaagagggggcggtctggtgtacggggaaaaatctgtttcaggagagtctggggctgggagacttgatggtggatattcataaaattctgaccgaggaccaagtggcccaggatgagctgacctacttgcatcccttgcggtaatgggggaggacggcacacatgaagcgggagacgagacgatatgggattgcatttgcagtgctgctggtgctgttgggagggcttctgatctggaacctgaacgcaggcagttttcccatgacggcctcgcaggtgctggcgatcctcttcggacaagggggagatgagacggccagccggatcgtttgggatatccgtctgccgcggattttgggggcggcgcttctgggcggcgcactgtcgatttccggctttttactgcagacatttttcgccaatcccattgccagcccctttgtgctggggatttcctccggggccaaactgaccgtggcactgactatgatttttctcctccagcgggggattctatccaattcctttgtgctgattgggtcagcctttgtgggggccatgctgtccatggggtttgtgctgttggtttcccaaaagatccggcggatgtctgtgctggtgatttgcggaattatggtgggttacatttgctccgccgtgaccgatttcgcggtgacctttgccgaagacgccaacatcgtgaaccttcacaactggtcggtgggcagtttttctggaatcacgtggagcaatttgggggtcattgcggggacggtgggcctggcggtcctctgggccttttgtctgtccaagccaatgggcgcgtatcagctgggggagagctatgcccagagtgtgggggtttccatccgccggtttcgcgtggagctgatccttttgtccagtgttctgtccgcctgtgtcacggcttttgccggccccatctcctttgtgggcatcgcggtgccccacttggttcgaacactgatggggacctcgaaacccattttggtgattcccgggtgctttctgggcggtgcggtgttctgcctgttctgcgacttggtcgccagaacggtttttgcgccggtggagatgagcatcagttctgtgaccgccctgtttggcgcgcccattgtcatctatatgatggtccgccggcagagcaaagccatgtaagtggggagagacagatgaacgcgtattatcttcagacagaacagatgacggtgggctaccatggcaaacccctcattgagaagatcaatctctgccttcggcggggggagatcatgacgctgatcggccccaatgggtctggcaaatccaccattctcaagagcatcgtccggcagctgcggcctttaggcggtgtggtgcggctggagcaggtctctctggaagaactgtccccccaggcggtggcgcagaagatgtccgtcctaatgacagaccgccttcagccagagctcatgacctgccgggaggtcgcggcggcgggacggtatccctacaccggaaaactggggctgctgacccagcgggattgggagaaagtcgatgaggcattggccctggtccacgggtctgcgctggcggatcaggcctttactgccatcagcgatgggcagcggcagcgggtcctgcttgcccgggcactgtgccaggagcctgagattctggtgctggatgaaccgacctcttttttggatatccgatacaagctggagattttgagtactttgaaggaactggttcgtcagcgtcagctggcggtggtcttatcccttcacgaactggatctggcccagcgtgtttccgaccttgtggtgtgtgtccacaacaatgccattgagcggtgtgggccgccggaagcggtgtttacttctgattacattaccacactgtatgagctgacccaggggagctatgaacctggctatggaagcctggaactgccccgggttcaaggcgcggtcaaagcctttgtcattggaggcaatggggaggggattgggacatatcgccggctgcagcgggagggggtccctttcgtcgccggtgttctccatgagaatgatgtagagtttcccgcagcccgggctttggcggtggaggtgattgcccagaaggcctttgagcccattggggcggcacagtatcaacaggccatggcgtggttggaacgctgcgagcgggtcttttgctgctgtgagacctttggcaccatgaatgaaccaaaccgttggctgaaacaggcggcgcgggaaaggggaaaactggtggattggacggaggtaccccatggcctttgaacactatatctattccaatggaaagaagctccgctgcggattcaccaccgggacctgtgcggccttggcggcctcgggggcagcccagagactgctcaccggccggtggccggcgtcggtttctctgcgtacccccaagggacttttggtggaagttcccctggaagactgccgtatggagggaccaagcgcggtctgtggggtgcggaaggacggcggagacgatgtggatcagaccacaggcgccttggtccaggctgcggtgtcaccctctgttcagccgggcatttccattgagggggggcctggtgtggggcgtgtgaccaggccggggttggaccagccggtggggtccgcggccatcaaccgggttccccggcagatgatccgggagcaggtggcgtccctctgccgtcagacgggatatgagggagggctccaagtgaccatctcggtacctgcgggagaacagattgcccagagaaccttcaatccccgcttgggaattgaaggaggcatctccattttaggaacctccggaattgtggagcccatgagtatccaagcgatgatagatacccttcaaattgagctccgccagactgcggcccaggggcatcggggggtgattctgaccccgggaaactatgggcaggattttcttcgccagtgcggatggggaggcggaaggattcctgtgattcgatgctctaattttgtgggagaggctctggatggggcagcggcagagggatttaagcgtgtactgctggtaggccatgtgggaaaattggtgaagctggccggcgggattatgaacacccacagccgctggggtgactgccggacagagttgttttgcgcccatgcggctgtgtgcggggcgggtcaaagcacctgtcaggcgctgctggagggggccaccaccgatgcctgtctggagattttggaacaggcaggcctgcgggaagcggtgatggcccgcctgatggacgccatagaggcccatgtctcccgccgggtaggcggtgcttatcgtgtcggggtaatcctgttctcccatgtgtttggggagttgggcaggaccccgggaacccaggaggtgttgaagcaatgggagcaggaagaggaatttttttcggagtaagcgtgggcccgggtgaccctgaactgctgaccaggaaggcatgccgggtgctggaggcctgcccagtgattggagcggctcaaacagcccggggggagcagctggctctgtctattgcccggagggcggtggatctgacgggcaaagaaatcctgtctctgccgttttccatggcgcgggatctgtctgtgcgtcaggcggcttggcgtcgggcagcggcgatggtccggcaggttcttgacagaggtcaggatgtggccatggtggtgctgggggatgtgtcgatctactccacatattgctatttgatggaactgctccgggaggagggctatgagacggagatgatcccaggggtggccagcttttccgctgtggcggctcggctgggtgtcagtttgaccaccatggaggagcctctgcatattcttccggcctctcagcaggcacagtgggagggattgacactacccggcaccaaggtgctgatgaaatccgggcgaaacctgaaggacttggtggaaaagctggcagaaaccgggcagttggagcaggctgtcctggtggcaaactgcggtctggaccaggagatggtctgcaccgatttgcgggcccttccagagggggcggggtattatactaccattcttgtgaaggagtgaaagcatggttcattttgtaggcgcggggccaggagcacccgatttgattaccctgcggggggcggagcggctgaagaaggcggatgtggtcatttatgccggcagcttggtcaatccggtgctgctgggtctgtgttctgcgcagtgccgtatctttaacagcgcggagatgaccttggagcaagtgctttccaccatggaacaggcggagagggaacagaaacaaacggtgcgtctgcatacgggggacccctgcctctatggggcgatccaagaacagatggatgcgctgaaaaaacgggggattccttacacgctgacacctggtgtgtccagtttctgtggggcagctgccgcggtagagggggagtataccctgccgggcatcagtcagactgtgatcatcacccggatggcgggccgaaccccagtcccggagcgggagaatattgcctctttggccgagcatggggcgaccatggtgattttcctgtcggcctctttgctggatgggttacaggaagcactgctccagggggcctatacccagcagacccctgcggcgctggtgtataaagcgacctggccagaggaaaaggtggtacgctgccccttgggggaactggctcaggcgggacgtgaccatggcatctccaaaacagcgttggtgctggtgggggattttttgtcgggagactatacccgaagccggttgtatgcgccggatttctccacggagtttcggagggcatccgaatgaggctgggatttgcggcgttttccgcccagggctatgccctggcccagcggctggcccaggttttggggggcacggcaacccgctgcggggtagactgccctttgcgtgactggatcagagaggcgttttcccgatacgagggcctggtatttgtaggcgctgtgggaattgccgttcgggccattgccccctatgtgcaaagcaaaaccacagaccccgctgtggtggtggtggatgagggaggacggtttgtgatccccctgctcagcggccacttgggcggggccaatgggctggctcaccgaatcgcggcagcgggagggggaagccctgtgattaccacggccacagatgggcgggggctgttcgccgtggacagttgggcgaaagagcagaactgccatgtgatggagccggaacgaatcaaaggagtatccggaaaactgctggagggggagaccatctggatgcgctgcccgtgggcggtgtccgggctgcagccggaaggggtgcttcttggggaagcgggggattgtgatgtggaggtgaccctttctcctgggaaggacccagcccttcatctggtgccgaaaatcttggtgctgggtgtgggctgccgaagcggtgtcggcaaagagaccctggcggcggcggtggcccagacaatggagcggttacacttcgtgccgcaggctattgcccgggtctgctccatcgatttgaagaaggaggagccgggcctgctggctttttgtgcagaaagaaagctgcctttccttacctactcccccgaggagctggcacaggtcacaggggactttactccatcagaatttgtccgtcaggtgacagggatcgacaacgtctgtgagcgcagtgcggttttgggcagtgggggcggcccactgctccagagaaaatgcaagggggatggagtgaccttggcggtggcacagatcccctttcaaccagaatggcggtggtaacatggaaagaaaacggatttacttggtgggcttggggcctggtggaagggagcagatgacccagcaggcctatgcggccctggcggatgcggatgttttatgcggctacacaggatacgtggacctggtgagagggtggtttccggaaaaggagacctataccacaccgatgacccaggaactggcgcgctgccgctgggcgctggaaaccgcgcgagagggcaaatctgtggctatgctgtgcagcggggatgctggtgtatatggcatggctggccctctgctccagctgaccgagggcggggaagaggtggagatcacagtggtgcccggtgtcactgcggcgctgtccggcgccgctatgctgggggctccgctgatgcacgacttttgtgtgatctcactgtcagatctgcttacaccttgggaccagattgccaagcggctggtgtgcgcggcagagggggacagcgttatcgttttgtacaaccccggctccaagaggcggagagggcatctgcggcgggcctgtgaaatcctgttggagcggaagcacccagagacggtgtgcggatgggtccgcaatgtgggaagagaggggagtgaagtccgaattctctccttgcaggcgttaaaagagaccgaggtggatatgtttactaccgtatttattggctccagtaccacccaaaggatagggcgctggatggtcacgccgcgggggtatgagaataagtgatgaaaattcttctctttggtggcaccacggaaggccgcctgttagcggaacggctggtgggaatgggacaccaggtgaccgtcagcgtggccacggaattgggcgctgagatactgcaagggcagttttgcggaccagttttgaccgggcgaatggacctggaggccatggcaaaactacttccatcgtatgatttgtgcgtagacgccacccatccctatgcggtgaaggtgacaaagcagctccaggccgcctgcgctgcggcgggcgttccgctgcggcgtctgcttcggaaagagagtgggcaggagggctgtatggtggtggacagctgtgcccaggcagcatcgttcttgcaaaaacagcggggcaatgtgctcctgaccactggggccaaagaactgggagcttttgctgcgctggagcctgaccggctgttcccacgggtgctccccacccatgccagcctgtcggcctgtgaagcgttgggcattcctcaccgaaatatcctggccttgcaagggccgttttcccaggaaatgaacgcggccatgctggcgcagtatcagattcgctggctggtcaccaaggatggcggagcggtggggggatatgaggaaaagtacgcggcggcccaagagcgcggggttccggtgattttgatccgtcgtccaggggacagtggcagttctatggaggaactgctgaagtcgttggaagggggagagatgccatgcacgttacgttaattggactgggatgcggcgacatggagaccataacggcggcggcacagcgagccctgtcccgggcggaagggattttcgggtcacgccggctgctggaggcacttccgcccagcggtgcgcaacgggttgcggcggtgcaaccggaagaaattcgggaccatctgatccatgccggctgggcagagagctgtgtgatactgagtggtgacacaggcttttactccggggcgaagcgcctgctgcctgtgctggcggcggcggggtttacgacgacggtgctgccggggatctccagcctgcaagttttttcggccaggctgaaacgcagttggcaggactggcgcctctgttctgcccatggagtagcggtggacccggtggcggaggtatgccatgggaagcccgcatttttcctcactggcggtagcttgaccccggcggaactatgccggcagttaacggaagctggactggggggcttgcaggtgacagtgggggaggacctctccggggaaggggaacgcatttctcatggcacggcggagaacatggcggagagaaccttttcgtccctgagcgtcctattggccgaggcggccccccgcccgccacgccggacgccggggcttcccgatgaggcgtttctgcggggaaaggtgcctatgaccaagcaggagatccggtccgctatcctgacgaaactggcggtgacgccccaagatatctgctgggatgtgggggcgggcaccggcagtgtcagcgtggagctggccctccagggccggtctgtctgggcagtggagcggcaggcggaggcctgtgagctgattcggaaaaaccgagccaagttttctgcgtggaatctccatttgcaggagggaaccgcgccggaggcctgtgagacactgcccgcgccggacgccgtttttgtggggggcagcggccggcggctgcaagaaattttgacgctggttgtccgccggaatccaaaggccagaatctgcgtatccgctatcgccttagagacattacaggaggcagtgagatgcttggaaggacttgggtaccgagcagacgtcacacagatctccgtcagccggggcaagtcagtggggcagctgcatctgcttctggcacagaatccggtttttttaattacgggagagcctgtatgaaacggctgatgatttccgctatggccagcggaagcgggaaaaccgtactgacctgcggcttactggcggctctaacggcccggggacacgctgcccaggcgctgaaatgtgggccggactacattgatcccatgtttcatgaaaaggttcttggcgtacccagccgtaatttagatctctttcttcagggggaagatggggtgcggcggaccctgttgaaacaaaaaggggactatgttgtggtggagggcgccatgggattctatgacggtgtgaacggcacagaccgggccagtgcctggcaggtggcgcggacagccagtctgccggtggttttggccatccggccggggggaagcagcctgactttggccgctcaggtcaagggacttttgaccttccgggcggattctcagattcgtgggttggttcttaccgcctgtcggccctctctttacgcccacttggcgcctattttggaagaagagaccggactgccagttttaggttacctccctcccatggaggaggcaaacattggcagccgtcatcttggcctgctgacgccaggggagatcgcagacctgaatcagcggttccgcaaagtggcggagcagttggaaaagacagtgaatctggacgccttatgggcgttggcggaggaaacagagaaaacagccgttcaagaccgcccaagacggttccgaccaaggagttgctgtgccatcggcgtggcgtgggatgtggccttttgtttttactatgcggataacctggatgcccttcgggacgccggggcggagttggtttttttcagccccttgcaggcggacgcgctcccagaggtggatggcctctatctgggcggcggctatcctgaagtatatgcccaagcgttgttccgacaggcgggaatccgcagtgccatccgggttgcccttcgggatggcatgcccacggtggcggaatgcggaggatttttgtatttgcaggagcagctgcagacggagcaggaggttccttggcccatggtggaggtgctgcccggtatgggctatcctacccgtcagctgcggcggtttgggtatctcaccctccaagcggagcgggacagcttgctgtttcgcgcgggggaggagattccagcccatgaatttcaccattgggacagcacccaaactggaacggcgcttttggcccaaaaaccatcgggaaagcactggcggtgcggatatgccacagacaccctttatgcggcctttccccatctccattttgggggagggcttcctttggcggaacgctttgtgtcagcggcagcggcctatcgggaaaggaaacagagatgacttggaaggagaccttggagaaaatccaggcaggagaggaaacggcaagagcgcaggcgctccggcgctgggacagtctggccaagcccttggggagcttgggcattttggaagaggccattgtccggattgcggcgctgaccgggacagcggaggtctgtttgaagaatcgggcactggtggtgctgtgcgcggacaatggagtggtcagccagggggtcagccagtctgatgcgtccgtgacgcgggcggtgaccgccgcgctgggaaaccagagcagtaccgtcaactatatggcccagaaggtaaactgtcaggtggtgccggtggatttgggggtactggactttttgggtgcgccaggggtgaaaaactgtcgagtccgcaatgggacgggagacatttctcagggccctgcaatgacccgggcgcaatgcatccaggcaatagagactgggatttcattggcccaggaggccaaagagacaggggcgtccatcctcctaaccggggagatggggattggaaacaccaccacctcctgtgccgtggccagtgttttgctgggaagggacccgggccagctggccggacggggctcgggactgtctgaggagggcttccggcgcaaagtgcgggcgatccggcaggccatctgccgcaatgcccctgacccgggggacccgatttcagtgttgcaaaccgtaggcgggctggatttggctggcctatgcggtctgtgcctgggcggggcttatgtgcgcctgcccgtgctgctggatgggctgattgccgatgtggcggccctctgtgccgtccgactccgtccccaggcggcggatgccctgctggcgggacatgtatcggcggaacccggggcacagtgggttttgcaggcactgggcctgcgggggatgatccaagcggagatgcggctgggagagggaaccggtgcggtggcggccttgccgctgttggaccttgccctggcggtctatcaaagcggtcatacctttgcgcagctgggcattgaagcctatacgccgcagtaagaaggagaggacgagcatgtttacccttgtcattggcggtgctgccagcggaaaaagtgaatatgcggaggcccatgtggagaccctcccaggccgtcggctgtacattgccaccatggagccctgggatgaggagtgccgggcgcggattgcccgccaccaggcagcccgggcgcacaaacggtttaccacagtggaatgctatcggaatctctcccagcttactgttcccccggatagcaatgtgctgctggagtgtctgggaaatctggtggccaatgagcgatatgggagacagggcggcggcgtggcccaggctgtggcaggggtagcgcatttgctgcggcagtgcaggcacgtcacagtggtgaccaatgaagtgttttccagcggggaggcgtaccagggggataccttatcctatttaagggacctggcgtgggccaatcggaccctggcccgccgtgcggaccgggtggtggaattggtctgtggtttgccctgtgtttggaaggggacggaaggatgaggggaattctggaaaccgtggcggtggcattttccatgttctccgcgcttcccatgccccagatttcctgggaaaaacggaatatgcggtatgcgctgtgtgccttccctctggtgggaggggtgatcggtggattgtgctggctgtggggggagctctgtcagtgggggggcgtgccggaccttctgcgaggggccgtgctctgtctgctccctgcggcggtgacagggggtatccatttggacggctattgtgacacggtggatgccctggccagccatggcacaccggcgcggcggcaggaaattctgaaagacccccatatcggcgcctttggggtcattcgtctgtgcgggtattttttgctctcgtttgctctgtggaccacgctggccgccccggtgggaaaggagctctgcctgagcttttgtctcagccggtgcctgtccggctgggcggtggcgaggttcccgctggcaaagcattcgggcctggcttatacctttgccaccgccgcagaccggaagcgggtggcttggattttgctgctggccggcgtgggcctggggggaatcgtatgctggaaaagtttggccggcggagccatggtgctggcggcactgctggtattttgggattactggcgaaggtccaggaaatactttggcgggttgtccggggatttggccggctggtttttgcagcgggtggagctttggatgctggcggccgtatggattgtggaatggggggcgcatcttctgtgatttttgtaacgggcccgttgtttgcgggaaagagagaatacatttgcaaggctttgggctggtcagaggaggacttggcccggcggggaatctgggaggtgcagaacctggcgggccaggaggaagacctggagaaactggcgaaaaacctggcccaatatgaggtggtcatcgccacggaggtcgggggcggcgtggttcccgtggacccggtgcagcgacagaacagagaggccgcggggcgcttggcctgcctcttggcccagcgggcggaccgggtgatccgtgttttctgtggtttgcctcaggcgctgaagggggaacttccatgagagtggagctgatccgccatggggaaaccctgtggcaggggacgggacggtatcaaggacagaccgatgtaccactgtctgaacagggaagacaggcgctgtctcccgcgtcgttctcgccggagaaagtctacatcaccgctttgcagcgaacgaggcagacggcggaacgtctgtttccccaagcgcggctggtggtggtggaggacttaggggaaatgaactttggacggttcgagggacgaagtgcggcggagatggaggaggacccgtcctaccgtgcctgggtggagggcatgtgccggggacaatgtccaggcggagagagtctgcctgcgttttcccgccgtgtctgccgggccttcgcccgactgctggattgggcggtggcctctgaggaagagcagcttgttcttgtggtccacgggggaacccagatggcggtgatggaggcgtttgccatcccatcccggccctatttttcctggggtctgccctgcgggcaaggctatgtactggaggccgaaggatggttagaacaccgccaactgcgcttgctgggaaagcgggactatacaaaagggggatgacatggaacttgtggtggctggggcactcagcttctgcctggacctcctgctgggggacccaggctggattccccatcctgtggtatggatgggccgggcaatttccggcctggaagagcggctgcggcggatttttcccaagacgacgcggggagaatgggccgcaggtgctctgcttgcgatcttgctgccggcagggactttggcacttaccttttctgtattgtggcttgctgggcagattcatcctgggcttcgcttctttttggaggttttctgggggtggcaggcgctggctgtacggggactggggaaggaaagtagccgggtttatcgggcgctgcgggagggaactctggagcaggcccagcaggcggtggcccgcatcgtgggacgggacacccagcggctggaccgggcgggggtcacccgggcggcggtggagaccgtggcggaaaacttttccgatggagtggcggcgcctttgttttactttttcttgggcggcgctcccttggccctctgctataaggccatcaataccatggacagtatggtggggtaccggaatgaacggtatctctactttggccgctgggcggcccggctggacgatggagccaactggcttcccgcccgtctgtcggcgttgctgctggtggcggcggcttggctcttgggggaggatgggagaggtgcctggcggatctggcgccgggaccggcgcaaccacgccagccccaacgcagcgcaaacagaggcggcgatggccggagcgctgggggttcagctggccggaccagcttggtattttgggatacgggtggaaaaaccgaccattggagagcatcagcgcccgattgtaccagaggatattctgcgcagtaaccggctgctctatgggggcagcgtcctttgccttggcgttctgatcgggctgcgctgcgcccttgtcttgggaggagggattggatgagaaggggagagcatggcggggactgggccgcctaccagatacaataccatgggatgcccctggacttttccgccaatgtaagccctatggggattcctgcgggcgtgaagcgcgctctgtaccaggcggtggaggaggtaaatcggtatccagaccccttgtgccggcagcttcgggcgtgtctgggcaggcaccatgacgtctcttccgcccagattctctgtgggaatggggcctccgacttgatcgaccgcctggtgctggcgcttcgccctaagcgggggatggtaactgcgccggcgttttccgagtatggccaagcgctgaggcgggtgggctgtcaagtggaggagtttcccctgcaacgggcagaggattttcggatgacagcgcggattttggagcgcattacgcctgcattggatattttatttctctgtgagcccagcaaccccgctggacagacaacagaccgggctttgctggagaagatcctggagcggtgtgatgcctgtggcgtccttcttgtggtggatgaatgctttgaggaatttctcctggaccggtcccattccatggtttccaacctgacgggacatcaccttttgattctccgggcctttaccaaattttatgggctggctggggttcggctggggtactgtctgtgccaggaggagacgttattggagcagatgcgtttggcggggcagccctggccggtgtcccacctggcccaggcggcggggatggcggccctggaggagacggtgtatggagaccagctgcgggcgtggacccggcggcgacgggaggcacttcggttggcgctgacccagctgggctgtgatgtggtgccggggcaggccaattatctgctgtttttccatcggaattcgtcgttggatcaggacttggcccagcgggggattttgatccgaaactgtgagacctactccggcctggggcctggctggttccgggtggcggttcgagaggaagaggcgtgccgacggctgatccaggccatggaggagtgtgtgggatgaccaaacgattgatgattcaagggaccatgtcaggcgtgggaaagagcctgctcacagcggccctttgccggatcttttggcaggatggatatcgggtggcgccgtttaagagtcagaatatggcccttaacagctatatcaccgagaacgggctggagatgggacgggcacaggtgcttcaggcctgggcggcgggccgggaacctgatgtacggatgaacccgattctcctaaaaccgtccagcgacgtgggcagtcagctgattgtcaaaggggaggtccggggggactaccaggcgtcggaatatttccgcaagaaacgagaactgattccggagattctggcgtcttaccacagcctgtgccaggagaatgacattcttgtcattgagggggcggggagtccggcggagatcaatttgaaagcggatgacattgttaacatggggctggcccggctggtggacgcacctgtcctgctggtgggggacattgatcggggcggggtgtttgcccagctctatggaaccctggcgctgctggagccagatgagcaggaccgagtggtgggctgcgtcatcaataagtttcggggggatgtggcgctgctccaaccagggctgaaaatgctggaggagaaaaccaaggtcccggtactgggggtgatcccctatgtgccgctggatctggatgaagaggactccctggcgccctgtttgacacggacttcccaccataaaccagtggaccttgcagtgattcgcctgccgcggctgtctaattttacagattttgcgccgctggagcgacatgaggcattgggcgttcggtatgtcagccgagtggaggaactgggacgtccggacggggtcctgctgcctggcaccaagaacaccatgggggaccttctgtggctgcgccagaacggactggaagccgagatcaaaaaactggcagcccagggaaccccgctgctgggcatctgcggcgggtaccagatgctgggacgcagtctgtccgatccggatggggtggaagaaggcggtatgctggcaggaatgggcctgctgccctgtgacacggtgtttctccggcggaagatcaggcgaagaacccgggcgaaggtggtagcgccgatgctggcagggggaaatttggcagggtatgagattcacatgggagaaaccacggtccacggtgcgccattttgccgcctggacggaggaaaaccagaaggagccgtccagggaaatgtatttgggacctatcttcatgggctgtttgacacgggagagctgacggaacgtctggcccagtggctcctgtctcggaaaggacttgcgggagagaccggaggtctgcaaagtcatcgggcgcatcaggaagagcagttaaatcagttggcctgtatcgtccggcagcacatagacctgccggctatttatgaggcaatgggacagaacgggaggggagaacgatgaagcacagtagaccagctgacattgagcggaccagcatggcgatcatcgcagaggaactgcggcagagggggatgcaggtcccgccggatcaggaggccgtggtaaagcgggtgatccacaccacggcagattttgaatatgcagaaaatcttgtttttacaaaaaatgcagtttcgctgggggttgcggcccttcgaaagggaacgcccattgtgacagacaccaatatggcaaaggcgggcatcagtcggcctgggttggagaaattggggtctcatgtgatgtgtttcatggccgaccctgcggtagcccaacgggccgaggcgcagggaaccacgcgagcggcagccgccatggaacaagcggcacaggtgtgtcccggggcagtcctggcgatcgggaatgcgcccacggcgctgtttgccattgcccgacagatggagcgaggacagtttccggcgatgctgatcggggtgcctgtgggatttgtgaatgtggaggaggccaaggagcaggtgcttgcgctgtgccggcggtttgaagtgccggcaattttggccatgggacggaaaggtggcagcaatgtggcagcggctatttgcaatgccttgctctatctggccggggatatgctggaccctgccgaacgtggctggcagtgaaaaggaaaaaaacagaaaaagaaagccctcagaatttctcttgttcaaggaattctgggggctttttgggatgattttggaacattttatacagtaaagcgagaggagaagtccaaaatttacccggcgttttgacgattttatcgtggaagatgcgaagaaagcactgtgcttttggagaattggaaagcaaacgggtaggaatcaaggatagagaggagattggccgaagggggagcagggaaaaaatatgataagaatatcttatgggaagaggaggggggaaagaacagaagggaggaagatgatcatgtggaggaaagaatcagggagaagaaaattggattcataagaaaaagtgaaaggagaagagaagcgtataaagagaaaggaaaggggggatggctcgaaaatggacaggaaaaaacttgcacaaaggtaaaaagcaagttttggatttctttcttgcaattgagaaagacctatggtagattgttcataatttcacagaaagttttcttaacatacgaaagggagagagaaagggggtgatcggatgtctctggatgcggtgaaacgagtcatggaagtggagaaacaggcttcacagcaacgggaagaaggggaacgagaggccaggcgccgaatcacggcggcggaaaaggcaggggcggagcgcttagagagtgcttgtcgagcggcggagataaaagtaaagaaaatgatgacggaagaggaagaaaagaatgcaaaagaaacagcagagcggcaggaggaggctgcgcgcctgtatgaggaaatcaaggcagaaggagagcgtcatttggaccaagccgcagagtggatcgtgagaagggtggtggagttctaagtgtcaattgtaaaaatgaagcggctgcggctgctctcattgacttcagagcgggaccatctcttggcccggctgcagcgtgctggctgtgtggaggtgacagaaccggaagaaccgcaaagcatgccggaatggggcagcttgctgcgtcgggattccacagcgcttctgacggtgaaaagtcaagccactacggttcggaccgccttggagaatgtaaaccgatacgcagcagttcggtcaggactgttcattcaacgggaggccatccgggaacaggattttttccggcaggaaacgatggaagaggccttggcgctggcggaaaagatcaatgcctggaaccggcagctggcaaagctccagacccaggagaccaatctgaagaacttgaaaaccagtttgatgccgtgggccccgctggaccttcctcttgaacttcaggaaacggccacatcggtatttcagctgggaacttgccctctggcggtgaatctgtccgaactgaccgcacaactggagaaaactgcggagcgagcccatctccaggagatttcccaggataagcatcagcggtatctcctgctgatctgccataaggaggcgctggagcgggcaacgcagtgcctgcgggcccatggatatgggatttctcactggaaggcccgtacagggacaccggcggagaacatccgtcgggtggaagaggaactgcttcaaaatcaacgggaacgggaggacgtgatccagtccatttccgcttgccaaagccagaggaaaaaactggaactttgtcaggaccgcctccagcaggaactccagaaggagcaggcgcgggaaaaaattctcaccgatggcacaatgatttttttggaggggtgggttgcccagacggggctgtcccggctggaagaagaattgagcgacattctctgtgcctatgaatggagggaacctgatcccgaggagattccccctacgctgctgaaaaatcaaaagtggctttcctgtatcaacatggtgacagagatgtactccctgccggcttaccggggaggaattgatccgaatccgctgatctttggattctttgtggtgtttttcggcatgatgtttgcagacctggcctatggcctggttctctgggcagtctccctggggatcaccaaaaagtatcgtcccaaggggacggtgggaaacatgtttcagttgggacagtacttgggaatctccactgccgtgttcggggtgctgacaggtggtttctttggagacgcagtatatcagtttaccacggcgttctttccggaacacgtcattaccttgccggcgctgatcaaccctctgcaggatccgatgaccattatggtgatcgccctggggttgggggtgcttcacatgctgtttggacagtgtgtccatatttacatggaggcccgggatggacgccttctggatggcattttggatgtggtcccttggtggattgtgtttgcggggattgctctggctgctttacaggggagcgctgtggtggttctggtgggatttctggcactgttgtttactcagggacgacataagaagggtattgtacggaaactgcttggcggtctggccagttggtatgatatcacaagctggctgggggatatcctctcctactgccgtttgatggccctgatgctggccacctcagtgatttcccaggtgtttaatattttagccaccctgcctggagagggcctacccaagcccgtgggtatcctggtgtttctggtgatttttttggtgggaaatctctttaacatgggcatcaacatcattgggacctatgttcatgcggcccgcctgcagtatctggagtttttcagtaagttttataaggagggcggtgttccctttaatcccctgaaatatcagaccaaatatgtggacgtgaccacagacagcggggaggtggtggaatgagtatccacgggttcttccagactgtgcccttggaagggactgcgcttgctctgctgggcgcggccttggcagtggggctgccctgcgctggttctgccactggagtgggaactgtgggccgggcaggggctggtctattgtctgtggacccagggaagttttctcgggtgctggtcatgcagattctgccgggcacccagggactttatggcctggtcatctggtttttcgcattgaccaagctgggatttttttcgggagaactggcgcatctgacgccgtttcagggactggagtttttcggtgcctgcttgccggtggcccttggcggcctaattttcggcattgttcagggcaggatttgtgctgggggactctctctcattgccaagaagcccaatgatctgagccggtcggttattctggccattatgatggagttttacgcgattctggccctgctggcatcgtttttaatgctcaaccactttcaattttgaggagagagtctgtgcctcttctgacaggaacaggaggaatcattcatggagacaattggaattgcattggcgtttgtcggcgcggccctggcagtgggcttggcctgctcggggtctgcccgcggggtgggcagtgtaggagaagtgggggccggtgtgctggccaacgacccgggaaagttctctcagattctgattttgcagatcatccctggaacccagggtctgtatggactggtggcctggttttttgccttaatgaagctgggctttttttccggggagctgcgggtattgactggaagtgaaggactgatgtttttggcggcctgtctgcccatggccatcggtggcttgctgtccgccattgcacagggaaagtgtgcagcggccggcgtggccctggtgtccaagcggtcagaggagctgtccaaggcgattatcatggccatcatggtggagttctatgccattttgtgcctgctggcatccttcctgatgctcaatagcttataattatccattctggcagaaaggagagcatggggatgcacgggattgaaaaagttacagaccgcattgcccaggatgcccaggcagagattgaggcccagctgtctcaggcgcaggaacgggcggaccaaattctggcggagtatgagacccaggcgcgggaggcggtggaacgtattttggcgcatgggcagagagaggtggacgcgcaccgtgcccaactgcacagcatggcacggctggaggcgcggaaacgagttctggcagccaagcaggatgtaatagaagcggcgtttgagaaagctttggcccgtctgtgtgccctgccacgggagaaaatggtacctctgctggcccggttggcggcagtctatgcggaaacaggggaggaggaagtgattctgcccccagcatcccggcgggcttacggacaggacgtggtggaccaggccaaccagctgattggggagggacacctgaccttggggccggcggaggaaggaatcgcaggcggtctgctcctgcggcggggccgggtcgatatcaattgtaccttttccatgcttctgcagcgacggagggaatcgctcagtgcccaagtggcagagattctctttccccgaggagagcaggtgtgaacgacggatgaaggagggcgccttgtgacaagaaaaatacatgatacggactatttgtttttaactacccgcgtccgtgctctggagggctgccttctgaaccggggacagatggagcaaatgctggaagccggaagcccggaggaggcagcccgcatcctgaccgactgcggttatccagaactggaaacggtcagcgcaataacggtgggggagatgctgaacagagaacgggaacgtttgttccaggatttggcggaattggttcctgacccggcgattttggccgtattccagttgccccacgactatcacaatgtaaaagtgctcttaaagagcgaagcaatggggattcaggaggaccggctgctggtggatgccggccgtattccgtcgaagcagctggtcgctgcgctgcggtcgggagaggttcagaatctgccgccgcagctgggagaggccatagacgaggcccgccaagtgctctcagccacacgagacccgcagttgggggatatggttctggatcggcgctatttccaggagctgcttgtcctggcggaggagacgggatctctgtttttgcagggatatgttcagcgcatgatagatgcggccaatctccggacggcagtccgtgttctccgtatggggcaggggacggaattcctggagggaatccttttcccgggagggaacatggaggtggagcggcttttgacagggatcaatggcggaagtatgctggaggaattgtatgcttcctcccccctggcacgggctgcggaatcaggagctatggcggcccgtggcggttccttgacacaattcgaaaaggactgtgatgacgcggttttggatgaggtccggcgggcacagtttgttgcgtttggagaggcgccagtgattgcctatttggcggcaaaggaggctgaaatcctggcaatccgcatcattctgacaggacgtttggcggatttggcgccggatattattcgggaaaggctgcgtgaggcgtatgtataagatcgcggtggtgggggaccgggacagcgtgctgggctttcaggcccttgggctgtctgtcttccccgttgaaacagcggaagaggccagaagggtgatccacgccacagccaaggaggcgtatgcgatcatttacctgacagaacagctgggcacgcagttgaaagatttgctggcacagtacgaaaaagagctggcacccgcagtaattctaattcccggaaaagaagggtcgctgggaatcgggatggaaaagataacagaaacggtagaacgggccgtgggtgcggacattctggcataaggtttttgcgccaagaaagacgaggtacagcgatggccgctggcaaggtccatggacggaaagaagggaaaaagagcaatgagcaatggtaaggttgtgaaggtttccgggcccctggtggtggctacgggacttgcggaggcgaacatggcggatgtggtccgggtaggggaacagcggctcattggagaggtgctgaccatgacaggggacgccgcttcgatccaagtgtatgaggagacctctggcctgggtcccggggcagtggtggaaaccacgggggcgccgttgtccgtagaactggggccgggactgatcggtatgatctatgacggaattcagcgtcctctggagctgattgccagcctcacaggctccaatcatctccccagaggagtagaggttccggccctggatcgggagagaacttgggagtttgtggcgtcggtttctccaggcaccaaagtagtgggcggggatgtcatcgggacggttcaggagaccccttcggtccaacataaaattatggttcccctggggatgacggggacccttcgcagcattcaaagcggaacctatacggtgacagaaaccgtggctgttttggagaatgagcagggaattcaggagcccctgaccatgctgcagaagtggcctgtgcggaaaggccgcccttatcagacaaaatttgcgccggtgaccccgcttcagtcggggcagcgggtaattgacaccatgtttccagtggccaagggaggaaccgctgcggttccagggccctttggatcgggaaagacggtggtgcagcacgctctggccaaatggtctgatgtggatgtggtggtctatattggctgcggagagcgcggcaatgagatgaccgatgtgctccgggagttcccggaactggtagatccccggacgggggaatcccttatgaagcggacggttctcattgccaatacgtcggatatgcctgtggcggcccgggaggcctctgtatacaccgggattaccattgcggagtatttccgggatatgggctatgatgtggcggtcatcgcggattcgacctcccgctgggcggaggcgctccgggaaatgtctggccgcttggaggagatgcccggggaggagggatacccggcctatctggtctcccgtttgtcccagttttatgaacgggccggtgtagtgcagtgcatggggtccgatggacgccggggttctctgaccgcggtgggagcggtgtctcccccgggcggggatttgtccgaacctgtttctcaggggacgatgcggattgttaaggtgttttgggctctggatgcttcactggcctacgccaggcattttccagcggtgaactggctcaattcctattctttatatttggattctctcagaccttggtttgaggagcatttgggaaaagcctttgtgcaaaatcgtacccaggcgatgctcctgctgcagcaggaggccagtctgaatgaaattgtccagctggtaggcaaggatggcctggcgcctggggatcagctgaccttggagaccgccaaaatgattcgagaggactttctccagcaaaatgcatttgttgaggtagattccttctccaactatgaccggcagtccaggctgctggcgatgattttggactatgaccggctctgccggggagccctggagaagggggcagaccctgatgcgcttttctctcttccggcccgtgcggccattggcagagccaaaagtgtaccggaggagcgatatatccaggcctatgaaaccattgcccgggatatggcccagcagattgcccagctgacagagaaaggaggggcggatatatgatcaaggaataccgaaccattgcggaaattgcggggccattgatggtggtccggcaggtggagcgcgcgaccttcgatgaactggtggagatcgaactgtcggacggatcggttcgccgtggaaaggtgctggaggtcaatggagacagtgcggtggtccagcttttcgaggccaatgcggggatcaatttggcccatgccaaggttcgtttcctggggcatcccctccagctggcggtgtcccgggatatgctggggcgcgtgttcaatgggatggggcagcctatcgacggggggccggaaattttggcggaggaatatcgggatatcaacggtttggcgatgaatcctgcggcccgggcctatcccaatgagtttattcagacgggggtttcctccattgatgggttgaataccttggtgcgggggcagaagcttcccattttttcgggttccgggctgccccatgcggcactggcggcacagatcgcccggcaagcaaaggtgttggacggagactcaaattttgcagtggtctttgcggccattggaattacttttgaggaagcgaactattttgtcgaggagtttcaacggacaggcgccatcgaacgaacggttctatttacgaacttagccaacgatccggcagtggaacgaattgctaccccccgtatggcgctgaccgccgcagagtatttggcatttcatgaaaacatgcatgtgttggtgattctcacggatatcaccaattacgcggaggcacttcgggagatctccgcggccaagaaggaggtccccggccggcgggggtatcccggctatctctatacggatcttgccactatgtatgagcgggcaggccgtcaagtggggcgggcgggttccatcaccatgatccccattcttactatgccggaggatgataagacccacccgatcccagacctgacaggctatattacggaaggacagatcatcctttcccgggagctgcaccgggctggcattcagccgccggtggatgtgctgccctctctgtctcgcttaaaagacaaggggattggggcaggaaagacccgggaggaccatgcggggacgatgaatcagttgtttgcggcctattctgcaggtaagcaggcgaaagaactcatgtcaattttaggggaggcggccttgtcgcccacagatctgctgtatgcccgatttgccgaggaatttgaaaagaaatacgtcggtcaaggctttgaggagaatcgatccattcaggagactttggcgattgggtgggatctgctgtcgatcttgccggaaacggagctgaaacggatcaagcaggaacacatcgacaaatatcttccccggcaagcgtaaggaggcggaaagatgccatcggtcacagtgaatgccacgcggatggaattgacccggctcaagaaccggttaaaaacagcagtgcggggacacaaactgctcaaagacaaacgggatgaactgatgaagcagttcctggagagtgtccgggaaaaccgtacccttcggcgtcgggtggaggaaggattgatgcgggcccatggttcgtttaccgtggcatccgctctgatgtccccggaggggttggaacaagcgctgctttaccccaagcaacgtgtggagttggatatgaccacccgcaacatcatgtcagttcctgttcctatgtatacttttcggacgaaagagtgtaaagggaaagagctttatccctatggctttgccatgacatcctgcgaaattgatggcgcagtggaggcgctctcctctgtttttcaggatatgctgaagctggcgcaggtggaaaagacctcacagctgttggcgcaggagattgaaaagacgcgtcggcgggtgaatgcgttggaatatgttatgattccccgtatgcaggagagcatcaaatacattagaatgaaactggaggaaaatgaacgaaataacatagttcgattgatgaaggtcaaagatatgctcctggctgaagcgttggaagagaaacggaggcaggatcagaaaatagttcaacatctgtaaagtcaatatgctttacatatattcagggacggtcaaccttgcagtttaatggtaaggttggccgcttttgaattttgtatttattgtaaagagagaacaacaagctggaccaggcatgaaagtggagagctggaccagcgtttttatttcttgggaaactttctctcgctgctccagataacttgcaggtatttgggtaggctatgcagggactggaaaggggggcagagcggatttgtgctttgatttctcgagaaaatattaatataactttaacactccagggaattcgctaagggcacattcacgagggttctgctataattgctctgcaaaaaagagaaaaacaaaggagggaacaaaagtgcttgacctaattatggtggccacattggctgtttgctgtgggcttgtctatttgttggtccactggtgtcacaaacaggtggacagcaacgaatgacccaggccaatgtatgaaaggaggaagtattgtgatcatacttggcgtaatcgtattgcttctgggcgcttaccttgtttatgcgctggttcacccggaaaaattctaaggcacgcaggaggtagccattatgctgcagttaatcctgacgattatcatttacttgatcatcgtcattcccgtgggcgtttatttgtatcacgtcgccgcagggaaacgcaccctggcagatccggtttttaaccgcattgacggggcaatttacaaaatcagcgggatcaatcccaaccagggcatgaattggaaaaaatatgccctttgcctgttaggaaccaatgccattatgattctgattggatacatcatcctgcggattcagagtattggcctgttcaaccccaacgggattggcgccatggaggaaaccctttccttcaacaccatcatcagctttatgacaaacaccaacctccagcactattccggtgagtctggactgtcctatctctcccagatgctggtcatcacctttatgatgtttgtctctgcctccactgggtatgccgcttgcattgcctttattcgtggcctggcaggaaagaccaaggacaacgtgggtaacttcttcgtggacttggttcgtgttacaacccgtgtgctgttgcccttctccattgtgggtggcctgctgttggtatggcagggagtgcctcagaacctcacggggaacctggttgtggacaccattgaaggaaccaagcaagccattgcgatgggccctgtggcagcgttggagattattaagcacttgggaaccaacggcggtggcttcattggagcaaactccaccacaccaattgagaaccccacgattatctctgacctcattgaactgtattctatgatgcttctgcccggcgcatgcgtcattaccttcggtaagatggtgcgggatcgtaagaaggccatggcagagagcagtgaagtaaaggttgatctgagaaagagcctgaccgcccgaatctatggacgggaaggacgcagtatcttcctggcaatgggaattatcttcctgatcggtctctctctctgcttctggtcggagagccaggggaacccggcactggctgatgcgggcttgtcccagtccatgggtagcatggagggcaaagaggtccggtttggcattgcccagtcggcgatgtttaccacgaccaccacatcctttaccacaggtaccgtcaataacatgcacgataccttaacgcctttgggcggcatggtgccgctgctccacatgatgctgaacgtggtctttggcggcaaaggcgttggccttatgaatatgattatgtacgccatcctggcagtctttatctgtggcctgatgattgggcgtaccccggaatacctgggcaaaaagattgaaggacgggagatgaagctcaccgcactgtgcatcatcattcaccccttcctgattctggcgttctccgcgctggcggtcggtaccgcagcagggcaggagggaattaccaaccctggtttccatggcctgagccaggtgttgtatgaatacgcttcctctgctgcgaacaacggttccggttttgagggcttggccgataacacctatttctggaacattaccgccggcttggcgatgttcttcggccgctatctgtccattgtgattcagctggcgattgcggggtcgctgatgaagaaacgctttgtcaatgagtctgctggcacactccacaccgataccttctcctttgcggtgattctggtgtttgtggtgtatatctttgccgcactgactttcttccctgcgttggcccttggcccgatcgcagagcacctcaccctttgggcgtaaggaggaactgtgaatatgagtaaaaatcgcaaccaaaaactggtgacgcccgagatttttcatcaggcggtgattgggtccttcacaaagctcaaccccagatacatgatgaaaaaccctgttatgtttgtggtggaagtgggctgtatcatcacgctgcttctctccattttccctgggttgtttggggatgtgagtgccggcaccaatcttcgcctgtataatgtgatcgtctgcatcattttgttcattactgccttgtttgcgaacttcgcggaatctgtggcagaaggacgaggaaaagcacaggcggccagtttgaagaaaacccaaaaggacaccaaggcacgtcttttgctggaaaatggcacggagaaggaagtcctctccagccagctgaagaaaggtgatgtggttatggtctcggccggggagattattcccggcgacggtgaggttatcgagggcattgcctccgtggatgagtctgcgatcacaggtgagtctgctcccgtggtccgggagtccggcggtgacttctgctcggttaccggcggcacgaccatcgtgtctgactggctgaaaatccggattacttctgagcccggcaacagcttcttggatcgtatgatcgcgctggtcgaaggcgcttccagaaaaaagacccccaacgaaattgcactgaacacgttgctggtctctctgaccatcattttcctgatcgtcattgtgacgctgtatcccattggcctgtactccggtgtacagctgcagacctctaccttgattgcgttgtgtgtctgtttgattccgacgaccatcggtggtctgctttccgccatcggaattgcgggtatggaccgtgttacccggtttaatgtcattgccatgtctggtaaggcagtagaagcctgcggtgacgtggataccatgatcctggacaagacaggcaccatcacttacggcaaccgtttggcagctgacttcttccctgtgggcggcgctaagcgggaggatctgatccgctgtgctgcactctgctctctgaaagatgagacaccggagggcaagtccaccttggagttggcgcgtcagctgggggataagagcaaggagctgtctggttccgagttcatttctttctctgcacagacgcggatgagcggtgtggatctgcctgacggcaccaaagtacgcaagggtgcgtctgatgccattgaggagtttgtatcaaaactgggtggcaaggtaccctctgacctgcgggaaaaggtttccgaaattgccggcctgggcggcaccccgctgacggtttgtgagaacaacaagattctgggtgtcatctacctgaaagatacggtaaagcccggcatggtagagagatttgagcggctccgcaagattgggatcaagaccattatgtgtaccggtgacaatgcgctgacagctgccaccattgccaaagaagccggcgtggatggatttgtggcagagtgcaagccggaggacaagatcaagctgattaagaaggaacagtccgagggtaagatcgtggccatgactggtgacggtaccaacgacgcccctgcgctggcgcaggccaacgtgggcctggcgatgaacagcggcaccaccgctgccaaggaagcggccaacatggtggatctggattccgaccccaccaagattctggaagtggtggagatcggcaagcagctgctgattacccgcgggtccttgaccacgttctccatcgccaacgatattgccaagtactttgccattatcccggctatgttcatgacggccatccctgaactgggtgtgctgaatatcatgaatttggcaacgccttacagtgccatcctttctgcgttgattttcaatgccatcatcattccctgcctcattcctctggccatgaagggtgtaaaataccgccccatgtcctccggaaaaattctggcccgcaacatgctgatctttggggtgggaggcatcatcaccccgtttgtcgggattaagatcattgacctgatcatccatccgttgctcgccctcattggattctaaggaggtccaggtaattatgaagaattttttgcacaatggtcgccaggcactattggtgacaatcgtattgttgctgatctgcggtctgttgttccctctgctgctcacggggctgtcgaaagtttttttccccagtcaggccgccggcagtctggtgacagtagacggacaagtggttggcgcaaagaacgtcggccaggagtttacagaggactattatctgtggggccgtccctctgcctatcattataatacctatgtggagcaggaggatggaacccagacctacaacgatggttctgaatttgcaggtctgtcttccggttccaacaactacgcaccttccaaccccgctctgacagagcgtgtggaggctgatttggagaccttcctggagaagaacccggaggtgaaagaggaagacattcccaccgatttgctcacggcttccggctccggcttggaccctcatatctctccggattctgcggaaatccagattccccggattgtggaggcctctggtctgagtgaggaagaggtcagagaaatcatcgaccggaatacagaaggaaagacactgggcgtctttggagaggacaaggtaaatgttctcttggtaaacattgaaattgcccaggctatgggattgattcctgcttcttctgaggaataatcttggagtttttctttcagatcatcaaagagagccgcagaatctgcggctctctttttcaatttgggatatagggtggaaatgggggcgatgagatgctaaaattaattgtattacttacaatcggtgtaggattgttcttaagatttttgcagaagtggaatagaagaaaaaggaggcaatgaatgaaaaagtggtatgcggaagagtatgcgtttgagatagaggttatcagttttctccggggatcgcgtacagagcgatactgccgcaatggggaggaaattggagaccggtatacttgtacctatggttgcccggtgaatggggaagggcagggaatttgctctaaagtaatgatgatgctgtttcccatcatggaggcggtgagaagcggtggagatttagagaatattggaggcgtgagaaaggattgcaaagaggtggtttgccctgatggatgtgtcgtgtttcgattaacggcgaaaaaactcgggaatgaaaatttttataaggggaaattttttgactgagtaattgaccaggtccagagattcaaaaaaccgcttcctatgggagaaaactgagaatgttttctgctgcataggaagcggtttttgctgctggatttttctattttcaacgagacaatttgaaaagttatttttattcccactcgccgagttaaatccatttctaaacttttttgtatagaggatttgattcgtcgtggttttatttgatacagattatccttatcctaaggtctattcggacttttgctatcaaaaatctatccaagccatcctatcacgggttttgcttgagatgcatgattgggtggcttaggagtattatagcactaacaaagcactttgacaatctttccatacacttttagggtgtctccatcatgaatttcaatagggtggtattcagcattatccgagcaaagaaagacctttccatctttatgtagcagtttcttacagtaaacttccccgttaagaaaaaatgcaccacttataccatcagctatttcactttgctttttgacaaagacggtacttccgttgggaatatccggttccatactgtcaccagatacacgaagcgcaaagtctccatcctcaacatccgtttcatattctacatagggtatgtcactatccagcatattctcacctaaaccagcggacaaaggaatatcatatagatggataatccgctttttcggattagctataatatcaaattcttcgtttgtgcgaatgtctgccatccatttctgaatctcatggattgcatccggaatatgcgattcgatgtgatccggacttaagcagtacataaaacataaaacctctttgcaagtgcgctgtttttcttcttctgaaataaaacggtaaaaactaagatcgccttgcatcgcataaacacgggtttcaaaatgactttctccatggagcacgagccgatacataaggttttcaaaatacctagaatgattgcccaaactttttataaccttcgggtcaaaagagacttctgcaattcctgtcccataaataaaagtagagaatgcttccaatgctcgtcgcatagaattaccaattgccaaatctaacccctcgatattgcccattgcatagttaaaaatcatgtgtagcaaatcacgatattcattaatggactttatcggatctgacaaagttctcccttgcaactcaaatgatttacctttaactgacacacctagcttttgctttttgaaagacttctccatttcgtcagctattttttgcaaatcagaaaatgtagataaatcgtgtgtcaaaaataggattttacttttggcattacctttaataattctatgtgtctggtacctcaggaaggagcttataccgactttgttctcaaaatcaaagctagaaataggatcatcaataaccactaattcttcatcctgatatagtcttccaacatcctgatttgacaatatctgagtaaagaaatagcataaagcaataatgtttctctcgcctagagaaacgcttttgggtttaacatcattgccgtttgatttcaagtagtacttgtcatttttcaactcaatcgaaagccgaccatgcgaaaaaaacacataatcgagcgcattgtttatgttttcaatggccagccccacatttgacttttgcaactcaagagcctttaaatgctctgaggtttcgttcacctctttctgcttggtttgcagtttggcctctgcggctctcatttcgcgctgttgcttcaggtaatctcgatacgcttgtcctatctgcaggtgtgcaatttttttgttaatcagaagcaaatctcgcaagattgcttttcgtcgttgaatggcatctacaaattcttgccgttttgactcaagtttacttaaaagcacatttagttgctggatactgttttccaaacctatgggggcaatatttaccggattgtaaatactatttaacttcagttggatagcggctaaatattgctctatcaatttttgacaattctcaatctgttcctggatttcttttactaacccagcatccaaatccgtaaaatgagaatagtcttgaccaaatccaggaaaagatattgcccgtaattctgccttatgctcatcaacatccttgttcagtactttattgatgctattaattaggctacgacgatattcatcatcaatctcccggaaacagtagggacatacagtagtagctccgtcactaaaatcattttttgctgcctcaacaatagattgccgtccactctgaatcattgaaagaatcatcgattctcgctcagtcaacacaggcttttcgacgagctctgctaatagatcacaaattactctctcaaagccgtccgtgaactcaattccaccgatgggcaccggatagcttgttgtgacatcggccaccttatctagtagcgccttggtttcatcaaacttttgttgtaattgttctttagtctcagaaacagaaaggcctcctatttctctgacaacctcttctgttaccttcgagttaattttgtttcccttgattgcagcatctgtagttgcccaatcgccctgtaatacttttttgatacgagtaaaatggtaatcagggctaagcgggttattcttatttccaaatgattgcaatgctgtttgagctacatcatgttcttcttgagctgtcgccaacaacgccgtatagcgatctatatctgcctgtaaatcaacttggcctcctaaaaggataatagtccccaacccatctgcatcgatctttacattttcgtcaatatatttttcattgaatacaaatattttgctttcaggtaccaaatcaatctcgttatcagctcgatcaatcagtgaagcagataattcttctgtatcctcaccggaagcaatttgagaaaagccatctgaaattgtacttttaccgctgccatttttaccgtaaacaatagcaatacggtcgttatcattagggaaaaaagtcaaatttgttttctttgaaaagcaacgaccacagattgaaagaccttttactttttcaatcatagtttcatcacctcattgttttctcttcattccttttggcctcttagcctctcatacagcaccgtgcccacggtttccatgacctgccgcatcatgtcaggatcagagaacatcttcacaaagaagtcctcattctgctcataccgggcggcagccatgttgggaaagtccttctcgaacagtagcatgaaggtcttgcggtcattgttctgggcgtagctgtgccatttgtcctgagcggcatagtcgttctccatctgaagcaggaccttatccatctcggtgaagttggtgccgtacttctcattgattttgtcaatgataaccgtcagcggatcacgcttcttctctttgcggccagcctcgccggtaattgggcggaaaccctccggggcgctctccagttggattccgccctcgaagtccttttccaaacggtaatactccagcaacaccttgtcatccacatagaccttatcccgcccgcctttgggtagcatggtatagaggaattttgcatatacactgaacttgtggatatctttatcaaacaagcggcagacctgcgtgacgaaggcatagatgcggttgaatcgggctagagtggacttgaacagctcctgcttttcttcctccagtgcctcgaaacgatccagcgccgggcgaatggtgccctggagtttgcccaaatcgccgccggactgctccttggaggaatagaaaatctccgcaaaccggtcgatctctatctgctgatacacccggtactcgtccagggtgttcttcagatcgtacaccacattggggtcggtctcctcttccagaaccgtttcctcgtagtacggctcaaaggcttttctgatgtcctcggcagagttcacgaaatccaggacaaaggtatccttcttgccccgcatggtacgattcaaccgggaaagggtctggacagccttcacgccggacagcttcttgtccacaaacatggtgtgcaacaacggctcatcaaagccggtctgatacttttctgccacaatcagcatcccatattcgtccgtatggaatgcctcaggcagagccttctctttgatggtctcgccggattttgttttgttcagcttctcctcggtataggtctccccgttgtcctctacctctccggagaaggccaccagcacatccaggtcggtgtatcccttctctttgatctgccgcttgaactccagtagatagcgtactgcatggagccgggagggcgtcacgatcatggccttggccttgccgccgatcttgtggcgggtcacattgcggaactgctccagcatgatagccgttttctgcgagatgttgtgggggtgcagcgtctcaaactggcgaatagcacgcacaccggcggcggtgtccagctccgggtcatcgggaatggccttggcgatcttgtagtacatattgtaggtcatgtagttttgcagcacatccagaataaagccttcctcgatggcctgccgcatggaatacacatggaaggggtggtatttgccgctctcatcccgctggccgaacatttgcagcgttttgtccttgggggtagccgtaaaggcgaagaaggacagattttcgtggataccctgggcggccagttcatccaacagcttgtcctcatcgtccttgcgtgtggcttcttcctcgtactcctctttggcgtactcctccaaaactttctcggtgtcggccagcgcccgtttcagcttgcgggcggcatcgccggtctgggaggaatgggcttcgtccacaatgactgcaaatcgcttattgccagagcgcacttctttgtagataaccggaaacttctgaagggtggtgatgataatacccgtcccggcttcgatggcctcccggagctgctgggcgttcttgtcgatcttctgcaccacgcccgccacatggtcaaactgatagacggtgttttgcagctggctgtccagcacccggcggtcggtgacgatgataacggactggaagattttctcatcgcggtcatcgtgcagaccggtgagccgatgggccagccaggcgatggagttggacttgccggaaccggcgctgtgctgaataagataattcttgccggagccgttggcttttacatcggccagcagcttggtcaccacatccagctggtgataccgggggaaaatcatccgctcggacttcacttcaccggtcttttcgtccttctcctgctgcaagtggaggtatttatgtaaaatctccagcaggcggtccttgcacagcacattctcccacaggtaggcagtgtcgtaaccgtccgggttgatggggttgcccttgccgcccacatttccggccccgttgctgccctgattaaagggcaggaaataggttttcgccccctccagccgggtggtcatatatacattggtcagatccacggcaaagtggaccagcacccggttcttgaactcgaaaatagcgtctttgcccgcccggtcgaacttgtactgctggatggcgttagcggtgtcctgcccggtgaactggcatttcagctccatggacaccaccgggatgccgttgagaaacaggacaatgtcaatgctgttttcattgctcagggagtagtggagctgtcgggtacagtggaggatgttggcggcgtactgagcctggctggtctcattgatagaggtctccggcttccagaacacggcccggaacttgatgccccggtcggtaaaaccctggcgcagtactttcagcaggcccaccagcttcacttcccggcaaaaacggtcgatgagctggcgctcactgtcggcaccgtagattttctcaaaccgctcccactgcttgggctggctggtgcgaatgaaggagaggaaagtggcggtgtccagcgccttttcccggttgaaggcagcggggttgcccttctgatagccgccatgggtaagaaggtattcctcaatatcctgctcaaagcgcttttcttttacgtcaaagtcgggcactatttttcacctctattcagaaagctggtaactctctcataagtttccaaaaactcgttctttgtagaattaggcaactcttctcgatcaaaggacataatccttatgttgatgtgctttctaaaagcctctcgcaaatccagataatctgaaaattctttttttgagattattccagaagaagcaaactccacaatctgttcatggaattcaaacggaaagtccagataatattgcagttgtttgtcctcgtgaatcattttagataaatcacatttttccgcagcatgctttgccgctcccggatagtcaaacacttctacagattctctacactctccatatgttttggacaacaaaagtagggcgacttcccgttggtttttgtctttttctatacttctgtgatccagctcattgaatgtaattagatataggcatacaactacaatgttactaatgataattgaagcaatatcccagttaatattttcgctttgaattcctatactggcaggtaaatcatttatgtccagaaggaaatagatgaatgtaagtacaaggcaagagagtatgattttgaagatgcgttttttcaaaccttacacctctttctttccggtcacgacctcataaatgagggattttttataagccattagcctacaaatgatttcattctttcttgtaagcaagccttcgatttttgcacagcggttatctagatattcccgtattttaacctgttcgtcttttgaaggtagttgtactttagttctcctaatgctctcgatacccaaattaccctgattagcagtaccggtctcatatacaaatattgcgtctaagattctgttctccttcaacaaataattatagtatccggcatctatagattcttttggaataaaacaccctacacgctgatttagaaacagttttttacctttgcaatctttttctgccacaagatgcgtaaaaaaataatctcgttttccttttgtccctgtcattgtgaaaagaatacttcccggactgatcctaaacttatctgtagcactcgcaatttcatcgctaatatacactggattattttcaagtgccatatatccgctcttcacatttccaattctaatcacttgattgtcagattccgatgtataagaatcgctgttatatgcgtatccccccaagaaatcaaaaagcatccccagctttgcaacattccagtgctccggcataactccgatgaaactgtcaccgctgtccttcatggacacatcgggattcagaccttttgtgacggcttcggtgatgacggacagcttataggctttcagtttctcgatcacttcctgctggcgggcaatgatggtgtcgatctgactacacttacagtcgaggtaatcggcgcgcttgcactgttcctcatgtgacaaagccacaacgggataattcataagggtttcaacgcttaatgtccacctattatcatatgaaacgccctttccataagagaaaaacgccatcagccaatattgaactttgaagtaataatcataaaaagcaggactcacccctgcgttcgcctttaaattgatatatgcggggcttatcactccttggactttagaaatgctacaatttgcgccactatataagtccatggggttcaatagcagatcaccttcctcgacaggattgtaattgtaatagctttctgcaatttgtccttcattattcgatatatctctgactttaacaccatctcgtgctaatgaaagtatggttgggttctcctgcatggccttttcatttttccgagtaaatatatgctttacccgctccgttgaccaatcagccggaatctccccaatccactcaatcccgctggccttcatctccctcatgccccaaacacctccgccagagcgccgtccaactccgcttcaatggccaggatctcctgcatgatctccgccgagggcttgggggcttcgtacttgtaaaaataccgggtgaagggaatctcgtagcccaccttggacttcttctcatcgatccaggcgtccggcgcaaagggcagcacttcccgctcgaagtaggtctggatgtcctctttcagcggcacattttccgtatcccgcagggcggtgtccggctggggcttgcccttcttcaaaatcagctggccgttttcgtccttcagagggcgctccacggtgattttggtatagccaaagtcggcagtgtcaaaaattttgctgatctcactctccacaaagtcgccgtacagccgggtaatctccgtgatggctctctccgggatgtcgttgcgcttgttgcccagagccttgcggcgcttttcgtataggccgttggcgttgatgagctgtaccttgccctctcgcttagttccggccttcttattggacagcacccaaatataggtggcaatgccggtattatagaaaatatcgtttggcagggcgatgatagcctccagaaggtcattttccagaatgtacttgcgaatctcggaagggccgctgccggcgtcgccggtaaagaggggagagccgttgtgaatgatggcaatgcggctgccgccgtccttaggttccttcattttggaaatggcagtgagcaggaacagcatctgaccgtcgctggccgcaggcagaccagggccaaaccgtccggcaaaccccctcttggactcggcttccaccgccgctttttcattcttccactcccggccgaagggaggattggacagcacatagtcgaaggtctggccctcgaactggtcgtcggacagagtgttgccgtccttgatgaagtcggcattgttgcccttgatgagcatatccgccttgcagatagcaaaggtctgatcgttcagctcctgtccaaaggccatcagttcggtggaggcattgagctggtgcagatattcctctgccactgacagcataccgccggtaccacaggccgggtcatagatggtcttggccacattgttgccggagagaatgtcattgtcatcgtagaacaggatattgaccatcagttggatcacttctctgggagtgtagtgctgcccggcgtcctcgttgtgggattcagaaaaccggcggatgatctcctcaaagatgtagcccatctccagattggaaatcacatccgggtgcagatttgccttaggagaagtaaattctttgatgacgatgtagaggatacctttgttggccatggtggtgatctgtccgtcaaacttaaacttttccagaatgtcctggacattctctgaaaaaccgttcagatagtcccggaagttggcctcgatgttgtccgggtcatccagcaaccgctcaaaggtgaacttgctggtgttgtaaaacgccttgccggaggcattgcgcagcagcacatcccgcatggggagattcttcacggcttcgtacttctccagcaccgcatccttggtgtcggccaggatgcagtcgaagcggcggatcaccgtaaggggcaggatcacctctccgtattcatggggcttatataccccggtcaatttatctgcgattgcccagatcagggcggctttttcgcttacattggcactcaagctcatgattcttttccttccttttcctctggaacaaactccagaatatcgtccacgccgcactccatcacgcggcaaatccgttctacactttcgatggaaacatactcgtttcgctttaggcgggtgataatattggcactaaaaccggcccgctcttttagctgtgcattgcttatctttttatcaatcatcaaatgaaataaccgatcataacaaatcgccattttagttcctccaaagcaagaaatgcttggatttattttatcacattttcgtgaaaaactcaatctcgagttattttctcttccgtcaatctaacggggctttctttgtcacggccttgagatatagttctgggtcaccattcaaaatcagctcagcataggccagcggattgttatagatcaaccagtccagttctgaccgctgatacatgccgttcgccacctcgttctccacagcggtgcaatcgatggcgagcagtgtcccgtcatccagacgcagttccacacaggctgtgtccgggttgaactcacaggacaaaatctttctcatagtcgttacctcccaatacttgaatttcaattgattttccgcagaggcacaaggtctgtttcgttaattttagaatctggcaagcaatgcgtgtggctatccacacacaaatccggcaagcaatgcgagtgttaatacacactcacatttcctgtcgtctgcttgttgagggcagcgcccccaagccccttgaacacagaatttcattctgtggctgcgcgttctgcgaacgctttcaaagggtacgccaaagcaccgttccctttcagatgcccaggaacaaatcgtccccccttattgcctgatggctgccgtaaaacacagtagccctcgcttgatgtgtgggcaaaatgcctacctatcgttctcttttactccgcaccctgtgttctgttttttgggcatggggtgtcgtgaaacacgacatcctatggtgattttggggtaccctaaaatggggcaccctttgggataatggggtggcaaaacaccacctcatccgagatgctttttagctgaatttctttgcccaaactgccgtcagccattccttttgccagaaaaaaacaggagcgtgccacgctcctgtccttacaaacatagagaaaacttttatgctaatctcatcggtgaaattagtctaaacggaaacttatcttaccaccgaaaatccgggaacactccacgcttatccaagtatgcctgccgggcctgctcccgttcttctgcggtgggtgcagtcttatattttgcatacagttcatgccgcaccagcgcatctaacttttgctccagcccctgatgaatttcctcggcataatcatcgtcataggccagatgatactccaccaaagctacaaaaaggtcataggggatttgtacacttttcatattcatttcctttctgcgacggttgcgacgatagcgacggtgtttttgacggtatcattttcaccgtcgcgaccgtcgctatcgtcgcgctccttattcttcggttacttcacaggcggttgattctaccagcatataggtcaatttcacttgccgaccggaatgtttggccttattttcatagccaacatggtattcctccagcagcctgcctgccttgacattcaggtacttagtgagggcgttggaggccattcccgtttggatggcttcgaccagttcggatggagagccaatccactcccggcactcggcggaaaccaactttgcaactgcatccagcactgggtccggcggttctttatacagctcgttttccatgcgttccagattccaaatctgggtctgcgggtccttcttcaagtagaggatctgatccggctgatctcgtcccaccaccttaatggtggcgtccagttccgtgcgctttttcttctgcatcagcagcgaaccatctgcacagcccagcagcccggtggtgccggaaatcgtctcaaaggaatcgtctgcctgctgcttccgggtatggtggacggtcagaacacagatcccgtgctgatcagcaaactgcttgattctgccgatgatctcatagtcgctggcataactgtacgcttcgccgcctacctcacggattttctgcatagtatcaatgatgatgagattggtgtccgggtgctcctgcacgaaattcttcagctgttcatccaacccattcccaatctttccggcggcggtggcgaagtggaggttgggggtatcgttcacaccgtacatcataaacatccggctctggatacgctgaaaatcatcttccagcgcaaggtaaagcaccgtcccctgatggactttatatccccacaaatcctgcccgatgctgacatggtaggcgatctgagccaccaggaaggacttgccgattttgggtgcgccggcaaggatatatgcccctgcgtaaagcagaccttccaccactggtggcctactcttataggtggtttggaacagctctgtcatcgtgagtgtatgcaggtatcgggggtctgtcatacgctgcatcttgcggtacatttcttccagactttcctgggagtttacaatttcatcgttgcttttttgcccggaagtgggtatactattttcagtgatttgagagattgactgcccatcatctgcgccaacagatgaaccctgggcggtcattttctttttctcatcggtcataggcgaattcctcctgcatcccgttcataatggttgtaatcattcggatcgtgtccagcagctcgtcgttcacgctttgcccggcttcgatccggcgcagctcgtccagcacggcagacaactgatcccgcagggctttgtaaacctttgggttgccctgcaccaccacatctcgctccaatagccgccggataatgtaatcctgcttggtcaggccggtgagtttcaccagggtttccagttggagatcttcttccgctgacactcggaaagccaccgtcttgtttctccagcggttgtggttgtcatagttcttcttggacatcttcttacacccccttctcatttttcagtgaatccaacttgtcagccatctccacctgtcgggtggggaatagatgggcgtatcggtaggtgatgtcgatactctcatgccctacacgctctgcaatagccagggcagtgaagcccatgtcgatcaacaaactgatgtggctatgtctcaaatcgtgtatgcgaatccttttcacccccgtttgcttgcagccacggtccatttctcggtggagatagcttttgctgatggggaacatccggctgtccggctccactccatagagctgcttgaggtagtcctggagttcatcacagaggaactgcggcatctggatcacgcggttactcttgggtgttttaggcgtagtgatcacatcctgcttattgagccgctggtaagacttattgacggtgacggtgcgcttttcaaagtcaaaatctgctggggtcagggccagcagctctccctcacggacaccgcaccagtacaatacctcaaaggcgtagaaggacaacggcttgtccatcatggcctcagaaaagcgggtgtactcctcccgggtccagaacagcatctcctttcgttcctccgctcccatgtttcctgcctgccgggctgggttgatattcagaccgtaaaatcgtgcagcatggttgaaaatggcactaagttgattgtgaactgtcttcaggtaggttttagacagtggtttaccatggcagtccctcaactcccggatttcattttgccaacggataatgtcctttgccgtgatctcagagagttttcgatttgcaaaataggggaggatctttttcttgatgatactctccttggtaagccaggtattgagtttcagcttgggtttaatgtccttctcgtagagagcaacgaagctctcaaaggtcatgttcacatcagcctgtttttccatcaggaactcccgttcccattccaacgcttctcgcttggtggcaaagccgcgcttgagcttctgctggcgttcacccttccaatcggtgtagcgaaattgaacataccaggtgccattgtccttatttttgaacgctgccataattatttctccttcctttctgtctcagatcttgtaccatagaatttctcgtggaaaaactttcggtcaattcgcccggcaatggtgatgcagccggttttagccagttcctcattcatctgtcgaatgatcctataggcaaaggggatggagatccccaactcctccgccacttcgttgacacgcataaaaatctgattagccatagtaaataccttcctttctttgtttttggtagctgcctgctaattttgtttttcataaagacctccttactctctactgccactttttctcggtttcgcaaccaaaaatctgatggtccatttgattctctatattatctaaacttattagcttagtgtttttataatactatacatataagtttagttcaagtgttttgaaagaaatattattaaataaatttgcttagattatcttgacaaaactaagcaaatatgctatgtttcaaataaggacaatcatagactggagttgatgatatggcgattggcgaacgaatccactttttccgtctcctgcgggggatgacacaaaaatatcttggcatgtcactgggcttcccggagaagtctgctgatgtacgccttgcacagtacgaaacaggatcaagaaccccaaaggcagacctgaccgctgccctggctgaagtgctggatgtctcgccccatgcgctctctgtcccggacatagactcctatgtagggctgatgcacaccttgtttaccctggaggacaactacgggctgaaagtcacagagcaggacggtgagcttgccttgcaggtagattttcgcaaaaacaaggatgccgcccgactgcacgagatgctctggacctggcgggaacaggccgccaagttggaggccggagagatctctcaggaggagtacgaccgctggcgttaccattacccggagtacgacagcagccaagtccgcgccaagatgccgccggagggtctgatctaaccctctcacttgtaggccacgggaaaggtcatttgttgcacaaaaacagataattcagataaatgagagcaaaataaaaaaggtctaactgatcaacaaaaatcagttagaccttttacttatgaataaaaagatgaggatttttaggctactcgcaagccacccgatttttcttttcaaactcaataaatcgggatttgacgagtgctatcaatctgctatcaaatggggaatttgaaaatcaaaaacccagtgtttatgcgcctttgcgggccctcatatccactttttgcttattcccactcgccctctgcaaaatcatcttaaacaagtttgatttggtgatttagcagagagtatctacattatttgaattatcggatacacatcggctatccgattttttgttgccatggtgttgccacgcgaaccggaaacttaacgccaagaagtatagataagttgtctcttgtcgaatgcttccttgccgccctccataatatcaacaatctgcttatgcgtagaatccaagtcaatattaccttgggcaacatcaattcttgattcttgaaactcgacaactaatactctttcggaatcgccaagcacagggatgtttgcgttatgtgtagcaaatataaactgcatataaggttttttctgtgcaatagcggtaatgacttcatcatagatcaccttattatcgagatcatcttccggttgatcaatgaagataatatcattatcatcttgtgtcaatataaacagtataagtgctgatgctcgctgcccgattgagtgttgcctcaacagttttccgtgataataaatatctactttattttcaacctgcctgttcagcaattcttcatattgaccacgaagcttatcttccaattttacatattcgccaggcgtaacaatacctttcaatttgctgccatcgcaaacaatccaatcttctatgatagctgcataatcagtaaaagaatcacaaatagcttgatatttaatatccgagattcccgtccccttgaaatcatttttaagttgagctttgaagccttctcgatctcccttgaatgtgatttcaatcttgagttcggtttggttctgattgattcgttcggtttcggctttataagcattataagttgccaagagagcttcattacgttctcgtgttgccttagtaaatgatgcttctattttggatttagaggaagcttcttcgcttaattgctttagtttttcttttgttttttgcaattcagcggtcattttgacaaaactatcaacatccaaagtatcgtctttgatttctcttttaatttcagcaaattcatccgccaaactatcaattcgctcttttaggcgggatatgaggtcgtccataccacttcgttgtttttcaatttctacaatacaagagccgatttgtgcgagctgagcatcgattgacgacaatactattgatacatctccaaatatgtccttattaaaatcactactatatccgtccaacgcactcgatacaaccgagttttttgaaaacgcagtacgaatatcacgcagaatagtgtctattctattttttacagcatcaagctttgctgtatcggtagcgtatccactttgctttttaagtttgtctgcaacacctttttcttcaaaaatcgagagtttatgttcaagctcggtttgctgtgttgtaacttcagtcatttgctgtggaattttgctcacatccagtaagcgctccactgttttgatcagttcattcacacaattatccaaattagaaggttgaccaattctaccgctaatcagtttctccaacaaaccgttttcgtgatctgcactgctggacagatccttttgaccaaaatattgtaccccatcgaacaaactgatcggattaatatttaagtcattaccggtctcatcaagaacatttatgcgttcccccaatattcggctgacagaataatgttttccgtgtttatctattacattcaatgttgcttttccgccagaaccaaagacatttttcacaagagattctttatagtctttgtccatttgagctgtaagtcccaagacataccgcacagcttctaaaatagaagactttccgctacctcttatgccaataagcgtattcagctcacgagagaacataattgtttgaccgtcgaacttgccaccttggaaagagattgattctataaacccatgtttattgtcaggaacactttcgctaactcggtctctataatcttgtaaagcaaacttaattgcagcataggaatattcaccgatttttaaatatgtgcatctgtctccctttcctatatctgagatggatttgggatcggaaccctcaaccagagccggcaaatacccacagcatttttcaaacttaccaagattgtcacgtgttctagatttttgcaacccaagaacacgatgtctaaaaggtgcaaaacctgctaaagattcaagcaacccacccctacactcactaaataggccgctgttttgatctacatgtgcaaatacgataaaataatcccgtccataagcgtctaactgatcaaatacattttttagatcaaatatgctttttgtgttgcgattttctggattggaaatagtggcaaatgctgccgtcagaaatgtctggatatgattgtttccattttcaagccattcctctggattaaacacaattagcgtatgaataccgtttgcgccttctttaacggtcaattctactcccggcagaataaatatgtcttgctttttcgcagccttacgaatagctttatattcttctatgtcgaatttgttgtgatttgtaattatgccgacattgatgctcgcgttttttagagcagaaacataatcacccaaaaatgaggttgactcgccagaataggtgaattctttatccttcaaagtatgtaaatgaaagtctgcgcgaacatattgtaagcctgattcaaacatacttatcccccatttctcttatgttgttattgctttgacgcttactccattgctaaacatccattcttgaatgctgctggataagaaagagtcaacatctgattttggaataccacagtatacgcaagtacagttccctccccaaagcgatcatgcaacagtgttcttccatctgcacagaaacttattgcatctggtaaagaccgcagatacggtatttcaaccgtttttgcaggacattcgggaaaacttgcttcaagtgcaactacttgtccttcaccgaaagttacatgacgcacaacggcaccggcaggcacaaggggtgcgtcatcggacttgtgtacaacaattccgcttgcgatctcatttgccttttcagaaacagttgtgtcaatgtactctttccaagccggggcctccagtatatctcttctggactcgcattggagaatcaaatctctgagtttctgaggatctgacttattagactcaaacattgctacgaagtatttctggaactgtaccaaggtcagagggacaatgtcaagtcgctgctttacatcgccttttgcgtaccaaataccgtgtttgaaagtctctgcggtgtttgtgtcaatgcggacagcaacaaacatgccatagaccggtttgtcgtatttcagaacagcatcggaaacatgacgcctgacaggttcgccctccattgcctcttggcgggaagatgtggacattgtgacttcagtcaagatggtaaagtcattaaactcacagtacaagtcgccttttcctccacctgcagcggaaaccggcaagaagtcagaatccaatttgaacccacggacttcataaggcttattgaccatgtgatcaatcgccagtgctgcacgccaaagtgtccattcaagatacgcaggggtctcatccttgggtacttcaatagcgttatcttcgtcgtagaccatcttgccgccacctttaattagcagcgtcatataatctctgatttcttcccactggttacactgatcgctggcatactgtatttcatccgtctgagcaaggatattttcgagcctttgcctcgcgatattgacttctgtgggagtattcaaaggcagatcggaaatgtcaaaaagaatatgacgctctttcatctgcctgaccaaatcatccaacaaagattttgcgacatccatattgtctgtgggcaacggtgcaccggtacagagcaacttatactgctccataatggactgcaaactggccgtagatttagcgagtttttctgcaagtatgcgttttgtaggtacgattataaggcctctgccttttcgttggagcacacccgaaatgcggaggtatcgcatattcatatcgccgtaatccaagaaattatcagcttttttgtcgtagttttcgcctcttttagcgatttcctttttgtcgaaagaacgcttagcttgggaagcagatctccgctgacgcagatcaaggatgttatcaacgacttcttccagcttatagctgggattggttgtttgtccccacagagcaaattcaattctgctcagttcggaggtgcccgtgcgcttctcgagttccagcataattgccagcaaccaccgtaatggggagaagtagtgtgtgccatccgacattgggaactgttctacgctcattgctcgcaggaagcattcctgtacggccgggtatgtatctgcttttagaaatgatcttccaaagggtgtaatgtcatccaatgcgccgagatcctcttgccggccatcttttttctgaatctgtggataaatcaatccgtttttagcaaacatcaaccgccatttacgggcgtgactaccagagctatccttgccaacttcgttctgaataatccctttctcatcgagcaaattcataaaaccaagctcgttttcacgcccatggagatgtcctacaaaggcagagctagcatacacagagaatccttcttggattcgattaggattacgcaggccagtattacctaccagccatattttaatttgttcgctcataccgcatcctccaatcaatacccaacgaaaaggtattcctgtacagaatttctatgtgttttggcatcactctgatttccaaacgaatacttgtagtctacagggatgacttctacatgctgcttatacttggccatgatcgctaccatttcatcttgcgtaggtaagctgttagaagaataggaaacaatcagtatactgtttgcaaattttttgaaaagatgatcaaacgcatctgccgcacctttgcgggtagcaaaaggcgtaggatacgatttaaacttctttgtttgcgtatgttgctgaatttcgacccccttccaatcgcgggcaaggccctcaacaaaatggtatctccgaacgtattcattatcggataggggagaatagtacggagggtcaatgtaaactaaatctacctgttccaccctcaaatccatagcatccccctgcttggaacgattgatttgaccgttatcaaatacagccttattgacagcttcaacagcctccaggaattgctgagcaagcgttttttgtaaatccttgcgtccatcattgtatcgctgtcctgtgtaggtaaagataccacggggacgcttctttatgcaggcacgaatcaatgccgtcatagcgattgcgtgtttgtattgatctttgatatctgcaatattagtgcgaagcgtgtcaatcaagtcgttttcttcatctgtgtaataaagacctttgaaagtcgatgccacaaagtgatcggactccctatgttcaataagcaatcccttggctttatccaacggcaaggtaacagaattgttttctatcattgccttggtaaatgttgcagacatagccatataatcattgctgactacagacttaccctgcgctttgaacatatagccaacaattccggaaccggagaaaagatcgacaacggtattcaccttaaattgcgaggcaacagaccatatttcggacaataacttgctctttgagcccataaaacgagtcggtggataagctgacacttgttcaggaagcggctgaggaagcaactttattaaagtacgctgcttcggaggaatagtgacaatgacatcctcacctttacgtgtgcttccgttgcaggaaatgtggcgtttcgtctgaatgacatcaatattgaacggagcgtatagctcatgtaccaatgggtgattagagtttgttaggatgacatagcatccacgttcatgtaatgccataatcattttcgaaagctcaatatgatcttcttcgtaaaactgttctttagtatacctcttaaaatcagcgtattcagagaccggcaaatatggagggtcaaggaaaataaagtctccgggctgggcataatgctctaaaaccagaagatagtcgccgcacagaatatctaccttttgcagtgctacagacgctgctctcagtccgtcctcatcgcaaatctttgggtttttatattttccatagggaacattaaactgtccctgcttattgacacgatacaacccattaaagcaagtcctgttcaaaaagattgttcttgcagcagcctcggcttttggaagcgttgtccactcttgactacggacggcataaaacatctcggaagtgttttcgtactgtttgagacactgaattacatcttccacatgatcagcaacttctcggtacatattgattagttcgggattgctgtctgcaatgactgcattttccggctgcagtgcaaagaacattgctccgccgccaaaaaacggctcaatatatcggccaaaggaggtcgggactttcggcaaaagatcacccaacatctgtgttttgccgcctgcccatttcaaaattggcttggcttgagcagacactatttttttagctgcttgttctgccaatgtactcgcctcctttcatttaatgggatcttgggttaattccataatatcaccaatatcacactgtaatgcggtgcagatttttaccaacacatctgtagtgacattttcgctttttcctaactttgccatcgaagcgtgactaatacctgctgcagcgcacaggtctttctttttcatatctttatcaattagcagcttccaaagcttcttatagctaaccgccatacctatcaactccaatagtagttctcgcagttcaaaaatcgctgataaaaattctgcgttcactgattttgaaaatagtatagcatagctatgctcgcttttcaagatgataattgcaagttcttcctattcggtggcaattctgcagatactctctcgcctatcgctttgataaggcagtcttattatgggaatggctgattgctgtggcggcagggattttccctgccgccgttacgcttatgctgtgtaaatcagttcgctatttacaatttccatagctctgcctcgtatgctattcatcctgccgacccaatccatcggatcggcggcttttagcgtttctgtgatgccttccgcttcggccagctgttttaccagccgaagaaacatcgcctctgcttgccggtctatgtcggcaaggtaactgtttaatctgccgctggtgagcaacgtcgcataggttgcccggcgatgctccttcaggtaacgccggtgacgctggccccacacgccgatgggcggctgttcttcctcgggcagtttcaaattggggagcagatgatccccgacctgcgtataagtgccgcccattttctcaaaaattgtctttgccatagtttgttcctacctttcaaaagttgtatttttgcgccttgtgcgctgggtttgctttcgctgctgctccatatcttttgcctgtgcaatcagattatctatctgctgactaccaaggactttccgcagaaaacggaaatccttcaattcggagcgtaggacttcattttctcctttgagccggtcgttggttgcggtcagatgctcgttttcccgatacagccgaccgtttgtgttatttagccggtgatagctgtccagtgccttgtaatagtggtagaacacctcccggatgacttctttcagctttttgattaacgggtcaacaaatcgctgcttataggtcttcacggtcattagagtgggcggattggggagctgaaactctgcatccgactcaattcgctgctccagcttttcaatagactgcgcaccctgatcgaagttgtcgatccgattctgcaccgtttccaactcgtcctgcttttcggccagtgtggtgtccagtgccgcaatctctttctcccgttcctgcttcttgtaatccaagacggagagatgcttttcgtgggtgcctttctgctcccactgaatgtcataccgctccatcacggcggcaagctgttccttttcggactgcacccactgcgcccattccgttgcaccacgagtgccgcctttgaagccttgcgccgccagcgcctgtttcagcgatacccgggtgtcaagtccacgcttgctcccggtggtgaagggcacaaagtcaatgtgcagatgaggcgtggtttcgtccatatggaggtgcgctgagaatacccggaggttgggatttcgctcctgaaatcctcgatagtattcatccaatatggttcgtgccaattctgcgtattcgccggtagcactcatatcgtccttgttcccgatttgcaggatgatttcgtggaatggcttctcctgattgccggagcgaattttctcgtagtagttcggaatgcgccggtctgcacgggtctgcttctcgttgtagcgtttcagggcttcatcgaaaagttggtggtacacagtctggatgcgctcgttgcagtagtcgatgttcagatgagttcggcttccgtctacattctccgcccgaaatttgcggctgttgtggttgacagatcctttgccgacctcggcactgatcgttctcttcataaaatctcacttcctttcgctttccggccgcagccggggttctgttactcttgtcaagagtaaacgcaaaagcacttttgacagcctgcggccatcaaaagatgctgtttgcgctctcccgagggggctggtacagagccggtgcatcgagcaccaaccctgtaccgggactttgccccggcagcctgcgggctgctccccagtgctcaatgccctttgaaaagggcagccgcacggcttgccgaaacttcaaagcgtgacaaaccgtgacggtggtgacgatgttttagacctcgccagcacccaccaaaagaccgtcacggtcgtcaccctttgacacgctgtccatctctctccacagggagattttgcgtccaccgtgattgcggcttgccttgtagtgaatatcgtgatctcgcagcagccgcatcgagccgacgctcagccgcagagaaagcacattgggcttgcagtccagatgcaacagaccgcacagctcagaagcagtgccttcccactgaccaccagccgaagaaagaaattccgcaatgctgtccagaaacgggtccggcggctcctgccaaagctctgtttcaacgcttgccagctcccataccagcgtttcggggttcttagtcaggtgcagccgctggtcctcctgatctctgccggtgacatccagtaccgccgcattggaggtgcgctgctccttgctgagaacaaaaccgccatccgctgcacccagcaggccgttggtcccggcaatcatatcgaatttgtcatctgcctccaacttgcgggtatggtgaacgattaccatcgtcaccttgtagctgtcggcaacggctttcagccgggacacaatgtcgtagtcgctgctgtagctgtattctgcgccgccaacctcacgcacccgtttcagggtgtcgatgataatcagaccggtgttgggatgctcccgcataaagctgcgaatctgatcctccagaccgctgttggctgttttacagtgggtggcaaaatacagattttccgccgcttcagctccgaacattcggaatagtctccgctgtaagcgggcatagttatcttccagcgcaaagtaaagaacgcccgttttccgcaccttgtagccccacaaggacaggccggtgctgacctgataggcaagctgggccatcaggaagctttttcccactttcggggaaccggccagtaagtaggcgcctcggtacagcaggccgtcgatcagcggctcctgcccctcaaagtccgtatcatagagggtggtcatcgataccgcttccagataatccggggccatccttctttgcatttcccggtagaaatcatcgtcagcccccttgaaatctgaatcaaaatcggttaaactattgtcagtaagtttttgggatgactgctccgtatctgcgccaacagatacaataggggtggtcatttctttttcgttggtcattcaaattcctccttcattccgccgagaatgtcggcgatcatttcaattaggtcaagcagctcatcattgactacgctgccgctctcaattctttgcaattccaaaagcacttccgtaagctggtttcgtagcgccttgaaaactctgggattgccctgcaccactacatccttgtgggtgagccgccgggtgatatagtcctgcttggtcagcccggagagctgcacatagcgttcgatttgggcatcttcctccggcgatacccgaaaagcaaccgttttgctgcgccagcgattatgctcgtccctgttcttcaatgacatcttaaatacccctttccatatccagcttatccgccatttctgcctgcttagaaggaaacaaatgtgcatagttgtaggtaatatcaatactctcgtggcctacccggtcggcaatagcaaccgcagaaaaaccttggtcaatcaaaaggctgatgtgactgtgtcgtaaatcgtggattcggatgcgttttacgccggtttccttacagccacgctgcatttcccgatacagatagctttttgtgactgggaacatccggtcatctatgccaatgtcatactgcatcttcaaatactcctgcatctcatctgccagaaagcgtggcatcgtaattgtgcgattgctcttttccgttttgggcggcgtgatgatgtctttcccgccggtgtgctgaaatgtcttgttgatcgtgactgtgcgtttatcaaagtcaaaatccgccggggtcagcgctagcagctcaccctcacggatgccgcaccagtaaagcatctcaaaagcataaaacgacagcggcttgtccatcattgcatcaatgaattgcagatactcatccttggtccagaaagccatttcccgatttttcttcttgcccatacttccggctttcttgcagggattttccttcaggttgtagtacctgacggcgtgattgaaaatggcgctaatctggttctggatgcttttgagatacaccggtgagtagggagccccatccttgtcacgatagttgattagctcattctgccaccgaacaatttgctgcggggtgatgctgctcattttgagctttccaaagtaggggagcagcttggtgcggatgatgtgctccttgctctcccacgtgctgtccttgatgcggctgcgccgatcttcctcataatgctccacaaagcttcggaaggtcatatccaaatcggaacccaatttgttaagctgctccctctcccagctttgtgcctctcgttttgtctgaaagccacgcttctgggattgcttccgttctccgttccaatctgtgtaccgataaatgacccgccaagtgttggttttcggttccttataaactgccaatgtgattactcctttctctctgcaccgtagcaggtgcgctccataaaatactttctgttcactcgccctgagatggtcaacatgcctttttctttcagttcggcatttaacctctggacgatcttgtaggcgtaggatttggaaacgcccaattcctgtgctacttcctccactctcataaagcttgtgttttccattccatcacccctttcgtttggttatagttctcttatttagtgtcggagaactttctgaccgcattccgatttgcccgagcgggtacgccattaccgtgacgcacgacggatattctgttgtctacaaataacttaacgctatttgctatagccattatactaaacgaatttgctattgtcaagaggcttgcaagaaaatatttaacttttttgcttttgctatcttgacacaacttaaattcatatgctatgctaattgcacaatacataaaggagtgttgtgctatggcaatcggtgagagaattcgctttttccgtaatctgcggggaatgacacaaaaatacttggggcaggtgatcggcttcccggaaaagaccgccgacatccgtatggcgcagtatgaatccggcagcagaacgcctaaggcagagctgacggagaaccttgccagtgcgctgggcgtctcgccgctggcgctgtccgtgccggacattgacagctatctcggcctgatgcacaccctgtttaccttagaggatcgctacggcctgagggtggaaaccggcgaaaacggcgtttccctgcgtgttgatccccggaaggggaaggacgccgctgagctttccgaaatgcttgttgcttgggcgcagcaagcggaaaagtatcgtagcggagaaatcaaccgggaggactacgacaagtggcgttataactacccgaaatatgacgaagcctccggttatgtgaaagtgccgtcccagcagcttagcaatgcaatggtggaggcgttcaaggaccggctgaaggctgattaaaaaacaatagaaaaaaagcgctatctgacttggcttcaaatcagatagcgctttttgttatcgcaataattcaaataatgttgccattttgttgccacagcgggcactcatggcgaaaaagccttggtatgactggtttttttccgggatgcaatcattcccactcaagtcttgggctttgatttagggttataaaatgtactctcgatacgcattttgtccaaataatccacgtatttcgggctgtacataggtttcttacgaattttgtagccgttttgtagccagctattttatacgtactaaccgttcgcaacgacttgatttgaataatctgcggtgggtttcaatatgatttccgccaatcatcagacaaaattgaccacctgattcacctaaaaaacatcttggagatatgactatgagtaaacttattttctgtcaattcaacatcgacacagcctgcgtagaattggtttttgacgatagaagccagattcccattgacttcaccgccgttgaaaacgaagttgccgataaccgcttccagcggtcagagctggattatctgatctacaacgacccgcttgcttatgccgatctgattctgaacagcaagctgaacgtcctgtttgaataaaccgacatgagcataaacgacagcgtcccggttcataatgattgggccgctgcttattatatcattgtattttgcgaactcattcctcgaacagatacagaagatatccgtaaccctctgctttcatctttgcgtaaggcacaaagcgcagggccgcactgttgatgcagtagcgcacgccattgggggactccggatcgccggtgaacacatgaccaaggtgagaatctccggcacggcttctgacctctgtgcggcgcatgccgtggctcaggtcctccagttccaccacggcaggctcttcaatgggctttgtgaaagccggccagccgcagccgctctcgtacttatccgtggaggaaaagagcggctcgccggtgacgacatccacatagatgcccttttcaaacttatcccagaactcgcctgtgaaagcgcgctccgtgccgctctcctgtgtaacacggtactgctccgccgtcagcttgtcccggatggattccgccgcgggcttctgatagtcgcccggatcgatgcgcagccgggaaaacagctccatctccgcgcgcgggatgtggcagtagccgttcgggttcttttcgaggtagttctggtggtactcctcggcggggtagtagttcttgagtgggccgatctccacgaagaacttttcactgcgtccccgctcgatctccgcgatgcgctccaccgtttccttcgcgctttcgttggtgtaatagacaccggtctgatactggctgccccggtcgttgccctgccggttctccaccgtggggtcgatcacatagaagtaggccagcagcagggcgtcgagactcacctgtccggggtcatactccacccgcacggcctcccgaaagccggtctcgcccttgcagacggtcttgtaatcggcgtccgcctcgcaggtgccgttggcatagccgctctcggcatcgatgacgccggggatggactgcatcagctgttccatgccccagaagcagccgcccgccagatatatgacattttccgtggtatccatatacatgcttccttcaccggacatatcagagggctgtccggtcatttccttctcgtccgttttctgcggcatatttttctgcccggcagtgcagccgctcagcagcagtaccgcggtgagcagaagcggcaatactctccgatacatggtgtatccctcctttctgagaagataaattcgtttgtcagcccatatcggcggcaagagcctggtcgatgagcttttgcagcgtctccgcctgctttttttccgtgatggcgcctacgatgggctcacccacgatattgccgttgcggtcaaccacataggtggtggggtaggcaaaaatgtttgtagtgaactttcccgcctcgccgtcggaagcgaaatacacattctggtaggtcacgcccttcttggccagtacatcttttgcttcggaaattgccgcttcatcgccatccaatgtgaaggtgttgacaccgatgagtgcgccgcccttcttcgcaagctccttgttcagtgcgtccagctcggaaagctcgcccacgcagggattgcaggtggtgaaccagaaattcaccacggtgacggcgttggcggagaacagctcgtcgctcttcaccgtgttgccatccaggtccttgccctcaaaggcggggaatttctgcatgctgccgtcatcaggcggcgtggtcatgtcgctgcccgcgggcacgctcatagcgccatccgtagattgctgtgccgcctcggggtactttttctctatcatggtcagcttgttttcaatctcgcagatcttctccgccgcctccttgagcagcttcagctcatcctccgtaaactgatctttggaaccttcgatggtgtccaacaagaactcaccatagtttttgccgtcctcctgcatggtcatgcccttgtcggccgccatgaaaaccttttcccaaagcgctgtgtcctccgagagaatggcattttcctgcgccatcagctccttgtgcatggcaaccgcttcctcggcattcttcggttcgctgctcattccgtccattttgtctccgccctttgtgccgcaggctgccagagagagcaccatcagtgcagtaagtagcagcgccagaattctgccggcagtattcgtcctattcatcttcattcgttttattcctccctgttattgttgtttgtctgtagcgtttccgctgcttttgccttatctttaccgtctccgaagccgtagcggaagcacacggctttcgtcgaacaggcgcggatgcacattccgcagcggatgcactcggtatggttgggcgttttcgtcacatccacatccatcttgcaggctctggcgcatttcccgcaggagacgcacttattcttatccaccttcatctggaagagggacacccggttgaacagcgcgtagaacgcgccaagcgggcagagccacttgcagaacggtcggtagaacagtacgctcagcgcaatcaccgacagcaggatgctgaatttccatgcaaacagcttgcccagcgccgcccggacgccggaattggcaagggacagcgggatggctccctccagcacgccttgggggcagaggtatttgcagaagaacgggtctcccatgccaacatcgttcacaaggaacgccggtagcaggaaaaccatcaccagcaggacagcgtatttcaggtatgtcagcggcttcagcctctttgtggaaagcttcttcgtggggattttgtgcagcagctcctgaaaccagccgaaggggcatagaaagccgcagataaagcgccccagcagcacgctcagcagaatgaggaagcctgtgatatagtaggagaagctgaacttggaagaccccaccaccgcctgaaacgccccgatggggcaggccccggacgccgccggacaggagtagcagttcagccccggcacacagacggtcttccccgccccctgatacagtccgcccttgagaaagttcggcagatgcaggttggtcagcagcgtcgcccccgcctgaatccagccccggaagcgggacatggtctgtgaaacgcctgaaaactttttacccaatgcccacacactccagacataatttgattgctttgctcagcactgtcgccgcctcgccccgccagacaccaaagcacagcatggcggctccggccatcagcagcacgatctgcgccgcggcctttttcccgcagctcatttttcatcaccctttccgattttctgcccccatcatagcgcgggagagttaaagtctctgttaagaacgaaaacttaacgcaaaccttatctgtttttgctataatgaaagcaacacaaaaacgaagaaacaaaaaggagggctctcatgcaccttttagtaattgaagatgaacgcgccctgtgcgagaccatcgttcgcagcctgcggcggctggcctacagcgtggactactgctatgacggcgaaaaggcgctggcgcttctgggcgtggaacgatacgatctggtgcttcttgatctgaatctgccgaaaaaggacggcatgacggtgctgcgcaccctgcggcagaccgaccgggagacgcgggtgctgatcctctccgcccgcagcgaagtggaggacaaggtgcaggggctggatgccggggcgaacgactatctggcgaagcccttccacttggcggagttggaggcccgcatccgcagcctgacgttgcggcagttcacccagcaggatgtgctgctaagctgcggaggcctgacctttgacacccgctcccgtaccgccaccgtcaacgggcagacgctgacgctcacccggaaggaaactggaatcctggaatacctgatggtgcatcaaggaaggccagtaagtcaggaggagctgatggatcacgtttgggaaaatagcgtggacagcttcagcaattccattcgcgtccacatctccgccctgcgcaaaaagctccgcgccgtgctgggctatgaccccatccgcaaccgcatcggcgagggctatctgatgggaggcgaggaggaatgaagcggctttccctgcagtggcgcatcacgctgatgtccgtcctgctcatcggcatcacctgcgtggtcatgaatttgctgctgtgctcctccggtgtgtactatatggacaccattgcggacagtttacaaggcggcggcacggtgatcctgaatgatggcggagcggcgagctttgacccgcaactcatagcacccaacgaggagttgaccatcgtcgtcgatggggtgcaggggcgcttccgcaccaccaactggtacatcacggcggcggtaacgctgctcagcggcatcctcgcctattttgtcagcggacgcgctctcaagcccctgcgcagctttgtctcgcaggtggagcaggtgcagctgaacaatcttgccgatatgaggatcgatgaagacgctatttcggagttccggcagctgagccgctcgttcaaccagatgctggagcggctgaacaacgcctttgccgcccaacggcagttcaccggcaacgccgcccacgagctgcgcacgccgctggcgctgatgcaggcgcggctggagctgttttccgcggagcatcccgacgtgcggccagagacggcggagtttctcacccttctgcgggagcagacggagcggctgacccaaatgaccagaacgctgctggaaatgagcaatctgcggcaggtggcgcggaacgagcaaatccagctcgcccccatgatcgaggagatcttcacggacctcgccccgctggcggagaaaaacggcatcacactggaggcggagggtgacggcattatgactggcagcgatgcactgatctaccggctgatcttcaacctgacggagaatgctgtcaagtacaaccggccgggcggctcggtacgggtttctgtcactcaggagctggaaaagctcctgctccgcgtctccgacaccggctgcggcatcccggaggtgtatcagcgcagtatcttccagcccttcttccgggtggacaagtctcgcagccgggaatacggtggcgcaggactggggctctcactggtatgggagatcgccgacctccacggcggctccgtttgggtagagaaaagttcggagaagggcactaccattgcggtggggttgccaacgcaacaatcaacgaagccctaaaacccttttattcgtttttcgccgcttcgcttgccgccctgcggcgttcctctctgtatggggcggtcagccggaaagagaagcgtcccttttcaatctcaaattccttgtagcccgtgtccaggtctacgtccgtcagcttgcagacggcagggtgtttgcggctgtatgcggtcagcctgtttttgaggtcggtgttgtgggtgcggatgaagatggtggggtctttctcgtcaaaatagatttcggtggtcttttcctgcttggtaagtccagttctcataggcttatcctttctgcggctctgtcactcaataggggtgtttttcggggattttcttcggctcttgacttgggaaaaatggcgattttcaaacaggagcgcgccggacgatgtctgccctgtccgacgcgctcccattcgataaaatgcgttttttccggctctacacaggaatcagcgagcttcgtccctcgtgaccgctttttctctgcgcggatggaagaatcgccacagattattacgctgaattacatcctcatagctgcggactttcccgcgtagctccgtattttcacgctccaattctgccgcacggagcttgctgtggacagacttataatcagaaatttcctgtttcaaactgtcaatctcagccttgagctttgcaatcagtttgtttgccgcatccaacgccttttgcagtttggattcctttttctctgctgtaacgtacttctttgccagagtggaaagtcggccaaagtcctcacgctccacggcaactttggatgagaagggaatggacgttgccacgattttttcgatagaccgcacatcgacccgctggttctggattttttcaattttgcttccaagcgttgctgcctgcttttcctgctgacggttctgctctgtgaattctgccagccgcgcctgttcctgctgcaccttgaactgcgtcaccgtcaggtgttcctcggagctgccgcgttcgcctcgctccacatcgtcataccctgcctttcgcatggcggcgaagaaatcatcttgcagaacggaataggattttcggagcacagtttttccgtttgcgttcagcagcggttttccgttttcgtccagtgcgggcttggaatcccacttcttgctcatgctgacctgctgtatcgtttccttgaccgtccccaccagagatttatccttgcagcgtttcgaccacaggatttgcttttccacgacgggaatgtagaccacatgaaggtgatagtggtacacgtcctgccccagcgcgtcggacatggcgcggttgcgctcgtcggcgtgcatgaccgccgaaaggatgtactgctcaccgccgacgatttctattgcggatttgtaagcatcggtgtaaaattgttttgcgaagtcatagccgccgtgattatgaaaataggcggtgtttacgtcaaagaccagctcgccgtaaagaaaggcatcctctttcaatccacgggtggagatgatcccgtcctttttcaactgctcagacatctccgcatatccggcggtcggtttcttgaaatggacattgaggtgcgttctctccgggacaatatcctgattgacataggattccttttcccgttcgttgtgctgctgcgcgttgccgattttggcagccgtcagcctcatatttcttgcgctggtacggtgaataccgtcgcctcttgccataggcagtttacctcctgatttcagattgtgcaggacgggggcagctttcgagggagcacttctgcggaagtgtaataacccactatgatactttcaacctgcggctgcaaagtatcgtgggctctccgagggggaacggggtatgcggcttctgcggaagcctctgccgtggcttgcaagtagtacccactttgcaaaatccacggcgtgaccgccagcctttcagcaatcaaatttgcttcaacgctgccgcccacaggcagagagaattttgaaaatcctctccgccatccatctcaaaatctgctagtttttcgatggggacggggatgcgaggggctgtgtcagctaatgctttgccttgtctgccagcaacaggagcgtggcacgctcctgtcacagttcccaaggaggagtagtccatcggtagctctgcggcactccacgccggtcaagatactcctgccgcgcctgctcccgttcttcttcggtgggagcagtcttgtaccgggaatagatctgccggttcagcatggcgtcgagcttttgctccaagccctgccggatttcttcttcataatcgtcttcgccccgcagatgatacatggcgaggtcgatgaacagatcataggggatttatacgcttttcattttcctatcctttcctatccgcgacggtcgcaacgattgcgacggttgctttgatggcatcatttccaccgtcgcgaccgtcgcagtcgtcgcgctttcatcagtcgattacttcgtactcaacattgtcgattatcatataggtgagcttcacctgccgcccggagtgcttggccctgttctcatacctcacatggtactcgtccagcagcctgccggattttacgttcaggtatttggtgagagcgtttgccgccatgcccgtattcaccgcttccgcaagctcggtcggactgcctgcccattctctgctttcggaggaaacaagctgggaaaccgtatccaatacagggtcgggcggctcctgataaggctcgttctccgtccgttcaaggctccatatctgcgtgtcggcatcttttttcagatatagaatctgatcctgttgatctcgccccacggcatcgaccgtggcctccaatgctgtccgttttttcttctgcatcaggagtgctccgtctgcacaaccaagaagtcccgtcgtgccggagatcgtttcaaagctgtctccggctggctgttttcttgtgtgatgaacggtaacgatgcaaatgctgtgcctgtccgcaaaacgcttgagctttccgatgatctcatagtcgctggcgtagctgtaagcctcgccgccagcttctctgatcttctgcatggtgtcaatgataaccagcttcgtgtcggggtgttcctttatgaaattctcaagctgctcgtcaagaccgtttccgattttgtttgctgccgttgcaaaatgcaggctggcagtatccgccacgccgtacatcataaacattcgactctggattctctggaaatcatcctccagtgcaaggtacagaaccgtaccctgatggacttcatagccccacagcctttgccctgtgctgacatggtaggcaagctgcgctaccagaaatgattttccgattttgggtgctcctgcgaggatatatgccccggagtagagcagaccgtctatgacgggcggtctgctcttgtaggcggtctgatacagctctgtcatggaaacggtatgaagataatgtgggtcgttcatgcgccggattttctcgcgcatttcctcaatatttccctctgggggattgctttcgcaggtttcatgtagtatgctctggttagttgaattgtgaggcggctgccctccatctgcgccaacagatgggatgagggcggtcgttttctcattatccgtcattacgctcacctccgggaatctggaagccgtagaacttctgcttgaaatactgggcagggcattttccggctacggtcagatagccctgggatttcagctccctgttcatttcccggacgatctgatacgccttgctgcggctgattcccatgatctctgccacctctgacgctgtgataaactgtgctctcatagtacctcctgtttcaatgtgatctgcctcggcctgcgtatcttttgttcatccccctttctccagcctctccgaaatacgcaccctgagtacatattttattatacgcacacaaggtgcatttatcaagcctttagaaaataaaaatatgtacttgcaattcgctttattctgtgatatgatatggacgaggtgaatcagatatggacaatttcgattatcccgccattgggcagagaatcaagcagctccgaaaacgcaaggggctgaaccagaccgaactggcacaaatgctgaaaaaatctctccgcaccgtacagaagtacgaaactggagagatcgaagtgtcgattgccgttgtcaatcagattgccgacctgttggattcaacgccgacctatatcctcggctacgaatccagtacaacgcagatcagaacgctttccgacgtgatggactttctctttaagctggaaacggtagaaggcatcgacttcaagatcgacgtgcagaagccaccccgccgcaagcagtgggaatgttccatttcctttgacggaaagagcatggcagagttcaacgccgatatgtgcctgttccttgagcagtgggaggacgaacgcagcgagcttcgcgcctataactccacgcaggcagcatataagcgctggaaggagcagacgcttgcatactatgccgcgaacgcagtcaaatgcacagagccggaagaacttgaccgtgatgaactaattgcaagacggacagagcttttggaaaaggaatacggtaaaaacgagagtaatgagtaaataaccccatcaaagcctgattcttgagggaaggaggtaaaaatgtcagtaacaaaagacggcgacaccggtcgctggatgtcccagatccgcgtgacggactggacgggcaagaccatccacaagaagaagcgtggctttgccaccaagaaggaagcccttcaatgggaacgggactttatcagccaatccacgggcagcctcggcatgaccttcggtgacttcatcgccctgtatgtcaaggatatggagcaccgcctcaagccctccaccgttgccagcaagaaatggctgattgacctgaaggtaacgcctttctttaagaaaatcccgctgaacgagatcaagcccactcatgtgcgccaatggcagaactccctgaccagctatcgggatgaaaatggcaagccttacgcccagacctatctcaagtgcatcaacaaccagctcacggcgattttcaactacgcagtcaaatactatggcttgaaagaaaccccctgccacaaggcggggagcatgggcaagaagaaagccgacgagatgctgttctggacaaaggacgagttccagacctttatcgagagcatgaaagaccggcctgccagctacacggtatttatgaccatgtactacacggggatccgggagggagaactgctggcgctcacaccgtcggacatcgacttcgagaagaagaccctgacggtgaacaagagctatcagcgcctcggcagagaggatattatcaccactccgaaaacgccgaaaagcatccgcactatccccattcccgacggtctttgcacctgtttgcaggagtatatgtcccattgctacggactgcaaaaggacgaccggctctttccctataccaagagctttctgtatcacgaaatggagtatggctgcaaagcatcaggtgtgaagcggattcgggtgcatgatattcgccacagccacgccagcctgctggtggagatgggcttctcaccgctgctgatcgcggagcggctcggacatgaaaaggtgcagacaacgatggacacgtacagccacctgtaccccaacaagcaggtggaggtagccagacagcttgacggcatcatgccgtgagcctctggctacaaaaatcgctgcaaatgtagccaatttgtagccactaaaaaagaaaaatcctgaaaaacgctgtattaccaacgcttttcaggattccaaaaacactaaatatttattcccactcgatggttgccgggggcttggatgtaatatcgtatacaatccgattgaccccaggaacttcatttacaatgcgcgtgctgatgcagtccaaaatatcgtaggggatacgggcccagtcagcggtcataaaatcatcggtcgtgacggcgcgaagggccaaggtatggtcataagtacggccatcgcccatgacgcccacagagcgggtattggtgagaacggcgaaaaactgactaagattttgggcttcccgggatttagaaagctcgtctcggaagatgaaatcggccaggcgaaggatatctgctttttccttggtgacatctccgatgatgcggatggcaagacctggcccggggaagggctgacgactgactaaatattctgggagtcccagttctctccccagctgacggacttcatccttaaaaagcatacgcaacggttcgagaatctctttaaaatctacatagtccggcaggccaccgacattgtgatggctcttgatggtggcggcttctcccgtcccggattcaattacgtcgggatagatggtgccctgtgccaaaaagtctacggcaccgattttttttgcctcctcttcaaagacccgaataaactcttcgccaacgattttgcgtttctgttctggttcctctacacctgtcagtttgcccaggaaacgggtttctgcattgacccggcggaagtgcaggttccacttggaaaaggcggcctctacttcgtctccttcgtgcagacgcaaaaggccgtggtctacaaagacgcaggtcagctgatttcccactgcttctgcaagcagtgcggcggcaacagaagagtccacaccgccggaaagagcaagcaggaccttgccgctgcccaccttttttcggatggcggcaatggcagattggcagaaatcgtgcatcgtccagtcgccgttggcgtgacagacagaatagagaaaattgcggatcatttccataccatattctgtgtggttgacctctggatgatattgtacgccgtagaagcctctctgcatgtcagcgatggcggcgttgggacacattttcgtatgggcggtcaaagaaaagccggaaggaacctgggccatataatccccgtggctcatccaggagatgccctctgacgggattccttggaagaggggacaggtagtgtcgtaataagtgactgtctttccgtattcccgggctgtgtcttcctgggcgggggaaacctcaccgcccaagctgtgggccatcagctgacatccataacaaatacccaagatgggaacgccccaggtgaagatctcaggatccacatggggggcggtgtccagataaacgctgttaggcccgccagtgaagataatgccgattggtgccatggctctcagctcttccaagggggttgtataaggttttacctcgcagtagacgccgcattcccgaacccggcgtgcaatgagctggttgtattgcccgccaaagtccaagacgaggacaagctcgtgtttcacagggaccatcctttctcttgcgtaaaatgatgatgttttattgtactgcgcgtcagtaggaattacaagtccggtttgcctgatctctgtatcttttggttacatattttgtaaatgatagggcatgctatggcaaagaatgggacgatcaaagggggagaaggcatgattactgctgtggtccggacaattattttatatctgctgattatccttggaatccgcctcatggggaaacggcagatcggggagttggagccctccgaactggtgctttccctgattattgcggacctggcggcggttcctatgcaggactttggaattcccttgattatggggattattccgattttaactttgttgtgcttgtccgcgatcctgtctgtgctgacggtgaagagcatccggtttcgggcactcttatgcagcagacccagcatcgtgatccaggacgggaagattttaacccgggaaatggtgaagaaccgcttcactgtggatgaattgatggaagagcttcgcatggcaggggttacggacctctccacggtgaagtatgccgtgctggagaccacgggccgcatttctgtgttgccttacgctgagcatcagccggtcacggtcagagacatggggctgaaggtgaaggaagccggactgccggtgattgtggtcagcgatggccgggtactctcccacaacttaaaaaccaggaatctgtctatgcggtgggtgaaggagcagatgggaagccggggcgttcaggacatccgccaggtgtttctgatgaccgtggacgaagccgacaatgtatattttgtcaagaaggaggagaaaacttgaggcagctttggatttctgtggcgatcttagctggtatggtgctccttctgtcctggaacatggtccatgtgcatcagctgacggaacccatgcgggaagacctgtcccaagcggttgcagcggcgcgggaggaggactggcagaaggcagaggcactgacccaaaaggcacaggagcattggcagagtaatgtgtcatatcttcggtttgtacagtttcatgaggagattgatgaggttactgtactgctgaaggaggcaaaaggattcttatgggatcgggaagtgggcgagtacacggcaatgagtgtccggatctgtggcaagctggaggcaatgtgtgggctggaaacaatatccgccggaaatcttttctaatgtgaatgaaaataattcattgacaaggagcggaatgcggtgtatccttagcaggagctcaaaaaggagggattcccatgtcgcggattacaaaggatcccacagaacgccggcaagaaattttagatacggccctgaaacttttttgggaaaagggctatgaaaaaacctcgatgaccgagattgcccaggccatgcaggtggcacagggactgtgttaccgctattttccatccaaagaggcgttgtttcagacagctgttgatcaatatgcccagcggcaagtggatcagatcgccagcgtattgagaaaaccaggtctgacactggtccaagtggtggaacaaatgccgacctttctggaaaccgaggcggaggacagtgccattgccaagctctgccatgggccggagagcgaaaagctccatgggccgctctccatggcgatatgtgccaaacttcagccgttggtgcaacagttgttggagaaggccaatgagcggggagaggtccagattgcagacccggagacggccgcctctttttgtgtctatggacagttgggcattctatggaatcaaacgctcagtggagaggagagagtacgccgcgtcaaggcatttttaatccatctgctgactacattttaagcaaagaccctgctctttttgggctgggactcttttcggcaagtaaatgaatgaaattcattcaaaaaaggagaaaaatatgagtaaaaattttgatatcatccatggcaatcccagccagtgcttgtttgccatggtgctgccgatgatggcggcgatgtttttgaacatggcctataatttggtggacagtctatggattggaaacctgctgggagagtctgcctacgcggcgctgacagcggcgaccccaatccttttgctgctcaattccatcgcaatgggggcgaccaacggggttgctattttgctctctcaggccattggggcgggggagacacgacgaacccgaaccatcctgtttacttcatttattttaagtattgtgttttctcttgggatgacaggattattggagggaatggtatcccctttgcttcggtttcttcaagttccatcggagctgtatgaaatgacttgtctctacctgaggatttatttgattgggtatggggcggtttatctctattgttattttgccgctgtgctgcgcagctttggggatacggtgttccagatgctggccatgctggtatgtactgtactcaacggcgcgttagacccgctgttgattcacggatttggattgcagggcgcggcagcggcgacggttttgtctcagggaatttgtttggggtttatggtgtgttatctgagaaagaaagccttgttttctttccatgctgctgattggtccgggaaggagcttggcaccatttgcttaaaaagccttccagcggcgtttcagcaaagtattcctgccatcagcaccagtgtgcttactgcgatagtcagcggttttggggtgaccgccctggcggcgtatggcgtggctgggaagctggagcttcttctcttctatccagcgatgtcctttcaaatggttttgacaacgattgtgggtcagtgtataggggccggacgccgtgatcgcgcgtgggtatactgtaaaacggctttgctttggggcggaggtctgttgatcattctctcctgcggtgttgtgggactggctcatcctttgtctgaactgtttgtagacagtaaggctgtggcggaagtggtggccggatatttccaggtggtcagtgtgggatatctgttcaatatggaaaccaactgttttctgggggcagtcaatgggatgggtcatccaggacacagcatgctttgcatggtactgtactacttaatcattcggattccgttggcctgtctgctctcctctgccgggctaaatgggatatgggctgctgttttgtgtagccatgtggcagcggtggtaacggcgtgcctgcttgccaggggattggcctccagaaagaaaagccccatataatccgtctttcgcagcaaaaaagctgcgagggatgccgacaaagcggacatggtcagataggtagacaaagagaacagaccgctgccgcccatggtggatacacattctgtaaaggaaggctgagaacggatgatgagacagaacgataggaacattcagtgggacacttctccttacatggcgcggcagactttacagtccgcgcatccattgcaaatgggcttggaagcgcagggagatgggccccaggagaggcgtgcagaagacgcccttgtgacggaaggggagggagagcagaaagggaatccgttcctctgctcggatttggttctcacaagccacgtgaaaaaatacgttttcccaaccgttgccccagtcttccggcagacaggcggatactctttggggacgcttggttaggaggaaaaagatgacatctggtcgcatgcgaatcatatcccaggcatcatcccgccatgggtctgcttccggtaagaaaaaatcggaggtcatgcacacccagagcatttcaccacgcctaattttgtattggccccgccggtctttttggagcgggtaggaatttttgtccggtagatatctgcgccgctccggccgcttttctggtccatggagcagtaccggcacccttcgctgtacttatgacagccgtgccaaggattccaaatgtcatgcatgccgattttcgtgtttccaatctttgatctgttccaggcgagctttccacttggcctcttgcccctggtctgtgggctgatagtagacccggttcaccagagtgtctgggagacattgtagggtggtgagcttgtccggggtatcatgggcgtattgatagcctttgccgtagtttaagtccttcatcaatttggtgaccccgtttcggagtgctagggggacaggctccgtcaactgggtcagggcgtcttgtttggcacgttcataggccaggtacagggcgtttgatttgggtgccagggagaggtaaaccgcagcttgggtcaggaaaacagagcactcaggcattccaatgaaatggcaggcctgataggcagccacagcgatttccaaggcacgggcgtcggccagtccgatatcttcgctggcaaaccgggtcaggcgtcgggcgacgtaaagggggtcttctcctgcttccagcatccgggccagccagtaaactgcggcatccgggtcagaatttcgcatggatttgtgcagggcggagatcagattgtagtgttcctctccatttttgtcgtagagaagggacttttgggcggtgcactgttccagggtctctctggttactgtaatggtattgtcggagaccgctccgttgaggaccaccatttccagggtggatagggcgattcgcgcgtcgccattggcaaaacgggcaatgtgctccagcatgtccggctcgatgaggatatgctgagccccaaagccgcgggggtcctgcagggcccggttcagcagatggacaagctcttctgaggttaaagcgtggagcacgaagaccttgcaccgggagagcagagcgccgttgacttcaaaggagggattttccgtggtagccccgataagcagaatacttcccttttctacaaagggaaggaatgcgtcttgctgcgctttgttaaaccggtgaatttcatctacaaatacaatggtgcgggttccgaatcttcggttgctctccgcctgctgcataatggcgcggatctccttaatcccgccggtaacagccgagaatgcaatgaactctgctttggtggcatgggcaatcacttgggctaaagtggtttttcccacaccgggcggcccccagaagatcatagaggcaagctgatccgtttcaatcagccggcggaggagcttgccttcccccaagagatgggtttgcccgacgtattcttctaaacactgagggcggagtcgggcagccaggggacgagggggctcttgcccgaataaggtattttgttccatggtgggtcctgctttctgcttgcgcttggtatttgtttatggtatcacagagtttgagaagcttcaatagaacgggctttcttttgtcgctgatccagtccaggaaaggggattccatggtttttgcgggctggcatgggaccggagggaagggaaagagaggaagaacgagaaatttgacggaaaaggtatgggaaaggggcaaaaaaatctgcgaacaaacgaaaaaaaattttctctcagttctcccgttttttgcagagtgtgctataataacggagaaatggtcgtgtaacaccgagatacttttagtagggaggacaaggaaatatgaaaaccctgtacaacggaaagacgaagacggtcatgctggacgaagccactggtgtggtgaatctcttctttaaggattccgccacgggagaaaacggtgtctttgaccccggctccaacaccgtgggtggcagtgtggaaggcaaaggaaagatcggcctgaaaatctccaagcactttttcgaaatcatggagaaaaacggcattcccacccactatctgggcgcggatgtggagcagggcctgatgcaggtgcgcaagctgaccgtgccgaagctggagtttgtgctgcgttattacacggctggctctatgtgccgccggtttagcctggaagagggcattgtctttgatcctccctatacggaggtcacattgaaggacgatgagcagggagatcctctgatcagtgagcgcctgtgcatcatgaaagggatgctggcccctggtcagtacgacgaggcgctgggcattctggtcaaggtaggagaggttctgaagaaggaactgtccgctatgggcctgacgctcattgattttaagattgaggtaggctatgatgaaaacggcaagatgtatgtggtggatgaaattacccctgacatctggagagtccgggacgagaaggggaacatccccaaccagatcgactgcgcgaaaatgattctggagaaaatttaacagcgtgatagaaggaacttcctccctgctgtacggggaggaagttttttacctcaatggagggcagtacactccacaaaaaattcaaatttctctggtatactaccatttgaggtgaaaaagaatgtttcgaattttaattgtagaggatgagcctgatattggggaactcctccagaactatttggagcatgccgggtatgtgacccgtttggcccaggagggacagggtgcgttgacgctgttttatcaggaaacctttgacttagtgcttttggacttgatgctccccaagatggacggatatgcactctgccaagccatccgggaacagtctgacgtaccagttatcatggtgactgcgttggacagtgaggagcatcagctgcagggctttcagttcaacattgatgattatgtaaccaagcccttctccatccccgttctgttgcagaaaattcgagcagttcttcgccggaccacagggcacgccggagatgagcccatctgttatcggaacctaaccttggatttggagggatatcaggcctatctgggaggaacccctgtcgatttgacaaggcgggagattgcactgctgcggaccctgttagagaaccaggggcgggttctaacccggcagatgctgctcaaccgtgtgtggagctacgatttctacggggatgagcgaattgtggatacacatatcaaaaatctacgaaaaaaattggaggcggattatattgagacggtgcgcggcgtgggttaccgaatggagcgggaaaataagacgtaatctgccagtgaaaattttctgttttacctgcctgctcctgttggctgtctgtattgtgacctacggtctgatcgcctggatgatgccggtgacataccaggcagacagaaaccgcgtgttatcggagcaggcggagagtttgatccaagagttgagcaagactacgctatctgcgtgtggcccgctgctggagaaatttgcgtcggattatgatgcccaagtgagtattttagatgaaactggtcagccggtggcggggacaaaggaccttgcacaaacagaggaggaagagggccgggtgacgtttagccagattcaaacggaggagggcatgacgctgcaaaccaacgaatcaatacacattacccaaaccgttgcgactccgttttcttttcaaggcagtcaggatgtgtatcagctgatggtggtaggcagaatccgaggggtgaatcaagcgatggaagccttggggaaattatggccttggctgctggcctcggtggtgtcggtgtctattttggggtcctttttctacgcccgctatgttacccggctatcccgcgccatgggggagctgcagggggcgaatgaggcgctgcggcgagacatggaacgagagcgggaaatggagcggcagcggatggaattctttgccgcagcttcccatgaactaaagacgccgatcaccattgtcaaagggcagctgggagggatgctggacggggtgggggtctatgccgaccgggagcgatacctggccagaagtctgcaagtgatgggcagcatggagcgtttggtgggggaactcctgaccctttcccggatggaaggggagaaggtccgccgtggcataaagcctctgaatctaaccgatctcctgactgcctgtgtggaggaatacacggacctctttgcccaaaaggagcagacgctgcatgtttcccttgcgccggaccttcgggtaccgggagagtggaatttactctccaaggcggtctgcaatcttttaaccaatggagccatgtattccccggacggggcggaactttttctctctgctcgggaggaaggggagcagatctatttctctctggaaaacacaggggttcacctgtcagaagaaaggattccccatctgtttgaggccttttaccggggggagggctctcgcaaccggcagacgggcggaagcggtttggggctgtacctggtgaaacggattctggaataccattgtggggagatacggattagaaataccgccgctggagtctgtgtggaagtttggctgcccagaaccaactccacagaaactacaacttcctgctaaattaactccatatttttttgctatcctttccttgctcttaaaagcaaggaaaggatttttgcgatgaaactacagatggaacatttaaccatgacctatcccaccggaaagaaggcgcttcaggatatgagccttacattgagcagtccccagatgattggactgctggggccaaatggagcgggaaagtccaccctgatgaagcttctgacggcggcgctgcttcccacccagggaagcatttttgtggacgcgcggcccctggccaaaagcgaaggggccttgaaagcccagcttggctatctgccccaggactttggactttatgaggagctaacggtaacccagtttctggactatatggctgccttaaagggcattcgtgcccccaaagcagagattcggcgggttttgtcggacaccaatttgacgccgcagcggcgagccaggattcgtaccctttccggcgggcaacgccagcgggtggggattgcgcaggcgctgctgggctcccctcagctcttgattttggatgagcctaccgtggggctggacccggaggagcggattcatttccgcaacctatttgcacaggaggccaaagataaattggttctgctgtccacccacattattgaggatgtgcagtctgtgtgtgaccgtctcattgtcattcatgggggagagctcctgtttgacggacgccctgagcagctggttgcccgggcccagggacacgtgggggtgttccaaggctatccgccccaaggaatttcctgcgaggtaactgcccaggtcaacacagccggaggaatcttatgccgggctgtggcggagaaactaccggagacagttcagaaagtagagcctaccttagaggatgcctatgtctatctggtggggaaggaggggaagcggccatgacagtttggcgtgaccttcgagtggagtggatgcgtctgtttcggtccaagggaacctggctggcattgctggccgcttccgctgcccccttggtgggctatggactctatcagcccgccgggggcggtacaaccgcggccttggttcttctgaatcccatgctggcaggcgcgctgggcggggcgcttgcgtttgcggtgttaactttgtcagagatgaaccgggtcaaaaaggggagaatgggacctttgacagacagtgtggtctctcccctgcggatggctgtggttcggaccgttgtgctgatgctgaccgcagtagtgtcctctctggtgaccagtctactttaccttccctatacctggtaccggttgggggagacctttcagggaaaggaatatgtccaagtcgccctgctgtttttgcttccctttctggaaatgacggttttggcggctgctgcgttttaccaaatattccagcgggtggatgtctgtgtgctgcttctcctggcacttttgctggtgggactgggcccttggagtcaggacacctatttgctgtactggatggatttgtccaacctgggtttttccggagacttaggcaatacgacgattttccggctggcgcggtacagccgtttgctgtggctgtgcctctttggcgggctctgggtggggtcccttctgtgcgttcgaaaccacggcaggggtatttttggctccatggcttgctatgggcgaaagctctacttgccgctgctggcggcttgtcttctggtaagcggagctggcttgtatttccgccaaccttacctggaccatgctccgcctgtctctttggataccggcaatgtaacagggggagggacggcctattccagcatggaggagacggaagaacctacggtggtcattcataagacgcagctggagctgctggttcatccggaacaaggcacggcagagggaaacgcgacctatgaggtggaaaacatcagcggtacggaacaggcgtgtctgctggatattaatccaggctatactgttgagcttattttggtgaatggagaagaggttccgtttacggatcaacacaacgatcagtttatctctttgaaaaatatctccctcacgctccctgcgcaaaagaatttgcaggtggagatttcctatcaagggcgcattcaactgcctgcgaacacaggggtgttggccatttatgatgagatcacgccggagtacatcagcatgggcggcaatagcgtgcttcctgcccttcacggggagacggcggaagattgcacctttaccggccgcgttactttgccggagcagttgcagatggtgtcgaaaggaaagccggcgcaagtggtgggagagggggaaggaacccgaacctggcatttggaaggaacgggactccgcccggcctttttcgcgggaaactatgtctgtgtcaaactcaagggcacagcattcccggtgtatttctggtatagtgcgacccaccaaacggagtttacctcgttggggattgagcgtttgctgacagacaccgtatcttactgcacggcgcattatggggcgctgccctatacagaggagtatccactcaatatcgtgatgaccagcgcccacatgatgggcggtggtgccgcggacaatctcagctatatgggggaacttttcttttcggaggacaacctgaaagacccctctaagggggccagtgcggaagaggtgattgcccatgaaattgtgcaccagtggtggggcagccagtgccccatcatggatctggaaaatacggattggagcgcggaagctctgacctgctacaccacataccggatgatgaaagaatggaagggagcggactatgcccagcagttctacgtggaccagtggcagacgcggtatgatgatatgatggatcagttttacctccgcaatccgcagtatatcagccgtttgtcagaggagcatcaagcctctatacaagccctgatctttgacgccagcacctatggaaaggcacctttgcaggtgaaacaggcggagaccttggtgggtggagaggcggcaatggacgctatcctccaaaccctcttccaacaggggggaacggagatgcctccctatgtcacttggcaggactttttggatgcctgcggcctgacagaggatcagcttgcggtgaaagggggacatggaaatggttaagattttctactatgagcttcgccgtctgttgggaaatcggtttaccgttggcttgctcttggtggccctgctatatgggtactggaccatgcgaggggaaatcctgttgggtatagcgaatacggcgcccttttccccttggagttttggggcttatctggccgaaatgatgccattgctcctggtagctctgctctgttttctttctattctcacctctgacacaggaaaacgggtggaagttttgattgcggcaaccccgctttcccaagcggtccactgccggattcggtatactgcggtcacggtggcatttcttgtggtcacagcagtgcctgtggtgtacgccgttggattttatgggatcatttttggggcgatagactggaacacgctgctgctgcccctggtgataactgtgtttccgcctttcttgctggtcatgggcacggggctttggctgggacgtgtgcatcatagactcttgatggcgctggtggctgtggttttgcttctggcagttgtgccggtgccatcttggatggacctttatggaggaactttcttttcctcttatccggattccctgggggtcctggacccgccctttcagctgccggcctctgtgatcgccggaaaagtgacggtctctgccttgggagcggggttcgttgccgacgcggcccggtgaaaagagtaagcgagcaggacagcagacgctgtcctgctcgctgtgaaacaaggaattttaatcaatggcccgaaggcgttccacgatgctctgcttttccaggtttcgaaaacagagaacaggaatgagccaggcgaaaacgagaaggatcggagtgcagagaagaagggggaagagtgtgaattggaaggtatagaatccatctgcggtcatcgcacggaccaggacgccgaccacgacggcgctgagcagataggagaggagcagcgtgataccggcgtaagagagtccctccaaggtcagcatggttcgcagctgccgtttggtcatacccacactttggatcatggcgaactcccgcttccgggagacaatggcggtgaccatactgttgacaaagttgagtacgccaaccagggcaatcaccacgctgatggcgtatcccatgacggaggaggagcgggtctgtgcttcgtattggtctatcatagtttgccgggaggtgatgttcataccaatggcttgggtttgctgataatcagtgagcagtgcagagactgcgtccagactttcatcggcgacgttaaaatagaatttccgcagatgattttgcgggaagagctgggtaaatacatcggcctgcaacaccagaggaaggtcaaatgcgggggtggttcccgccaccatgggctggaggggagagaggattgccatgacggtaaatgtccgtccttctatctgaatctcttctcccaccgcataagtgggcaggccgccggattgggcctctgctgcgggcccgatggcaaggacatagtttccggtggcaaaagcctctggatcatatgtcccgtccaggagataatctccgctggcggcggcctccaggattaacccgtctgcgccataaacggtgtgggtgagggtggcaccggcgactgcttgatcgaagctggctttccaggtggggaacatggggtcgtaggaggcaaattcgtccaaacggtcttgggtataataggtggaaagattctccgcagccttctggctgacgggaagggacacttcttgggcgtacagccggccagtggcctccacagtgcccaagcggttgagctgatccaggagactctgctgaatggtctggctgttggggtcatacccgtcggcactttggtttgtggcatcatccagctggaagtctgccacggagaggtccaggagatatttctccacatcgaagctggcgtttttggcgtagaaaaagctcatgagcaccaaaccaagggtaagggagcagaggacaagaaaggtccgttttttgttacgccacagattggcccaggccatggcggccaaggaggcgccccgccgcccttttttctccttctttctggagcctggggcggcatctgtgtaccgcagtgcttccactggggagacctttccggccagccgggcgggaaggaggcacgagatgataacggtcaagtaggcaaatagagctgaccccacgaaaatcaggggatggacggatactgtgggggtaaaatcctgggtggcgatcagaattgggaccagctgatgccccaacagataccccagaacgagtccaaggggaatcccgatgagggagagccggtttccctgcccgaaaatgatgcgtcggatctgccttttggtggcgcccagggttttcagctgaccatagaaggcgatttccgaagccacagagatttgaaacacgttaaagatgatcaaatatccagccagaaataccagtaccatgcccacatacatggggatattttccgcgaaaatcatttgctgggtctccgcgctgtatgccaggttggtggtaaatttcaccttgccggtcaggccgcagtctgccagaatttgtgcggttttttcctcgattccatcggcatcggcaaaggtcaggcacaggtttcgggtgccgaggatttgcccctctgccggcccctcggccccgccgcaggcggataaagcgaagtcctcgctgacccaggccatgctggcgtagacggattcgttgccctcccagaaaccgcagagggtaaatgtgttggaaattgatgcactgctggagagatcggggcgccaagagagggtgactgtctgccccagggcaggggagatccccagccggtgcaggacttgggtgtccagggcaatttcgtcggcccgctgtggcagccggcctgttgtgggagaggcaaagcaggattccgcgtaggaatcgctggcgaagcgaatctccacctgacgaccggccagagcctgattttccacggtgcccaccagaatggatttgccccaggacaccacgtctgggtgagagacaattttttcaatttccgcatcaagaatggacttggtgctggtgtgtgctgtggtacctgcctgccgaagatacatctccgtcatgttttggcccatgctctgggatagggtgaacaatgtggtgaacatcatggtggtcagcaggatggcgagaatggccaccagattgcggcttttgctgcgccgaaaggtgcgggcggtgagcgttcctaagatagaggtctttcgtttcattgtgctggcctccttaggggtgaattctgccatcctcaatgcggatgactcggtcggcctgggcggcaatgtccgggttgtgggtaatcatgacaatggtttggtggaactcttggctggtccgcttcagaagggcgatgacctcctggctggttttggaatccaggttgccggtgggctcgtcggccaagacaatggccggtttggaagccagggcccgggcgatggccacccgctgctgctgccccccggacaactggttgggcatgctgttcagttttttctccaagccaagcagggtgacgactttttccaggaacctttcgtcgggacgtttccggtccaactgcatgggcagaacaatgttttcataggcactgagaatcgggaccagattataattctgaaaaataaaaccaattctctgccggcggaagacggtgaggtcttcatcctttagctttcccagttcgaagcggtccaccttgacactgccgctggtgggacggtccaatccgcccagcatattcagcagtgtggattttccgctgccggaagtaccgatgatagcgacaaattcaccttggtgaatggagatggagacatcatccaatgccttgaccagattcggcccttggccatactgtttggttagatgcgatgcggttaagatttccatggtttctccctcgtttctttggtttcaacggtaggtacagaataccatctgccgcaaaaaccacaagagaaaatgcgtaaattaacacggagaaggtaaaatctaaaaaacatgaatgcagcgccgccccaaaggaaggggcggcgctgcaaaatgttatgagggaatcggcaggagaatttttaaggtaaagattccgtcctttccatgggtgagacaatgcccgccgtatttttccacggtacgttggatgtttgccaagccgaagccgtggaggaaggggtcttccttggtggtccgaccgttccagacaagggaagaagacatggtgttttccaccaaaaccagaagcatgtctcgaacccgggaggttttcacagtcaccaggcgctgtgcgtctggaagttgcatacaggcttcgatggcgttgtccagggcatttccgaaaagcgtgctgatatccaaagggtccaagaagtgaccggcttcaaaatggatgaccgaggtaaagtcaatggacttttcccgggccagcctggctttgtcccgaatgattgcatccagatactcattcccggtatgctgataactctcatacgcctggagctggtcctggagggtctgagcggcttggtgaagaacaggactgttttcggattgggactgcaaaaccaaaagatggtttttcatgtcatggtagatctgacggactcgttcctcatcttgaaggcggtccttgtagtaggttttctgtttctccagggcctgggcccggtaggtggtttggaccgaggtacagatataggcggccagatagatgcagccaaagctggaaaagatggaggcaaaacagatggggtagacgatagcaatgttttccggcaaaaagcaaaggatggtaaagatagccacaaatggagccagcatcagggtatctacaatcagccacatggaggacgtcaaactggcggaaatctgccccagatatcgccggagacagaaccaggccaacgcccaaaacagcaggcgaaggaacaaagctgcggtgtggaagagagtgctccacaggtagtcttcaggggaccaggggatcagactggagtcgccggatgcgccggtaaaggagaaaaataagcggctgctggtatcaagcatcaaatagtttatggcgatcagtgcagggtagaaaaccagtacggcagcggcttttgccatccagcggccctgatgaaacagcatgacatagagaagaaatccaaccaagacacccaatagattggataggtcgttggagtagataatcacatctgcaatatagcagaaacagagaaaggcaggaatccgcaggccccaatgcttccggacaggcagaaaggtatgcagcatccagaagaaaagaaaggtgtacagaagagataaaatggtggaaagcacttccagacatagaatcacagcaaatccccccagtattccgtcaggcgctccataaattcctttcgtttgggctggctgatggggatggtttctcctgtgaccagtgtgatctccagctttttgaccccttttacgaaaaagagattcaccaggtaactggtatgacaccgggcaaacccctgtccctgcaaggtgctctccatctctttcatacttttgtaagataggatattttcctgttctgtatggcagagcaagttccggttaaaggtctcgatgtagcgcaggtcccgcagaaataccttatatttccctgtgtcattgacgatgagcagaaacgggtctggttctgtttgccgacgggccaggaatttatccatctcggccttgagacggatgtattgaagcggctttatgatgtagttggttgcctggtattggtagccctccagaccgtattgggtcagtgtggtgagaaaaatgattgccaccttgctatccagctttcgaatctgctcggcagcccgcagaccatccatagcgcacatttgaatatccaggaaaatgaggtccaaggaggcatcatagggatcgaccagatcggcgccgtcccgataggtgctgattttaagggcaatcccggtttcctgtgcgtaacgggtgagcagggcattcaggtgctggacaaaggtttcctcgtcgtcacaaattgctacatgaagcaagcagatcatcttctttcattcgaggttcgccctattatataaaattttcaggagattctcaagagagaaccagggaagagagaactggagaaaatgaagaaatcgcagaccgttttgaaacggtctgcgatggaaggaacagggactcagttggcctgctggctgctgaatttttgtctcacagaatcaatttttttctgttccgcctgttctgccgggtaccagcctttctctgccatcatgtcatagatggtgtcctgcattccaagggaatcatgcagcgcagtgctgaaggcctggtggacgctgctggtggaggattcaatggtgccatggaggaagagatcacaaacgcccttttccagcagaaggatattttccattaagtttttatcacccatgcttgtgccctcccttacagtaagccatagaaacgctgaaaaatttgttggtgcttctgcgccatttgctcgatgcaggttttcagctcaatgtcctggagctggctggcggtctctttgcacttgctctgaaaatacttctcatggcccagtgcatcttctaaatacagtagttctttggatgtcatgggatcacctcttccattgtagttgtaccccccgccgctggggatcaggtacatggatattttgccagcgttggagaggattattcattctaagctgcatgaggaggaacgcgtcagaggaagcgggaagggaccggtgacgggcaagacggtgtcaagggaggaggggttcctgagaggcctgaatcgcgtgaaactggaattgcagggaggtgacgccgcggaatgtattttcgccgatcgaccccaataggtccacggtgctggggcagcctaaggactggtaggcctccgcgagctggaatcctacggcgtccgcaaaccggccaaacagcttaatgtgttcctgctgttttcccatctggcgatgggtttgggtacctttggagaccaggcagtagtttcgcagcgcaaatactggcttttcaaccccctgcccgtagggggcatgggatttgagggtttccagtgcggcgggaagttcatcctcggaaagatccaggtcatagtacagcacgtcttcctgttcgggcaaagggttatcttccatgtactggaccatggcgcgtaccatttggggataatgtgcctgggaaacggtgatgcctgcggcgccggcgtgtccgccggctgtttccacatagggagaaatgagagggaggagcggggagaggtcaaaatcaaggtaagttcgtccggagcccttgagcagttcagggtttcccatcacactggagaagagaaacgccggacgatgaaaggattccgccagtttgccggcaaggatacccagaattccctccggcatgccaggacagcaaacggtaagaaggggcgcttggctttgttcttctgcggctgcggcggcaatggtgagccagtgagtgaccaggcgtttcctctcttcattgatctgcttcattttagaggcaaagacgagagactgggtatcatcttctgagagaagggcttttagaacggaggaacttccggcattgtataaacggcctgccgcgttcaggattggagcaatttgaaatttaatggtatcctcatcataggggcggtccgccaggttgagaatggcctggatgccgctggagagctgatagaaccaagttttatggttgatgacccgaagccctgcgatcacgagataccggttgtcccctgtcaatggcaccacgtcggccaaggtaccaatgcaggccaaaaccagcaggtcgaaaaatagacccttcttctgctgggaagactccgaggcgcataggaattcggccagtttataggccagtcccgcgccgcagtaatgttcgtacccatttttttctgggaagatatgggggtctacaatgagatctgcttccggcagcgtatcctgtgggaggtggtggtccaggacaatcacagtgtttccggccgctttggcggcgcggatgggctctatggcggatacaccgttgtcaatggtgataatgagagaatttgttatgccttgaatcagagactccgagataccgtacccatcggtaaagcgttttggaatgatggtctttgtacgcacgccaaaatggccgagcagcttgaccagaatggcggtggaggtgattccatcggcgtcgtaatctcccacaatgacaacaggcatgccctgcgttatcgcacaggcccggatacattctgctgcctctgggatgttctgaattctattgggttctatgtgggaaggagagagcagttcctcttctgtcaggccggacatctcctgaatggcttccaagacagaatgataggttccccgttttttccattgttgcatattcgttccctcattttatacctatgttattttgacggggcaaattataccatacaatgggaaagaaggtcaaatcctggcagagtagcaatgtttctctcaaactgtgcagaaggtctggtcaggaacataaaatttgtgatacaatacattattattttatcctaagatgatgaggttaggagagaaaaccatggttgttttaattgcgggagcttcccacactgggaaaaccgcattggcccagagcttgttggagcagaagggatatccctatctgtcgatagacctgctgaaaatgggactgattcgaagcggacagaccaacttatccccggaggatgacgcggaattaacggagtatctatggcccattgtgcgggagatgatcaaaactgccatcgaaaaccgacagaatttggtggtggaaggcggctatattccatttgactggaaacgcggctttgacacagtgtatttgaaagagatccgctattgctgtctggtgatgacggagagatatatcgaccaccattttgatgaaattaaggcatttgccaatgtaatagagcatcgaggggatgattcctggtgtaccaaggcacggctccaggaagaaaatcaacataaccttgcaatgtgtaagaagtatggcctggactatagtttgattgaagattcataccaggtgacgttctttttgtgacaaggcaaaggactggtgggggagagaccttgactcgcttcccatcagttttttatttggtcgggctatcattgacaaaaaagttcgtccatggtaatatgaagctgccttcacgagaagcgagcttcatattttaggaggaggcgcccatgaagacaagggtaaaagaactgcgaacagcagccaaaatgacgcagcagcagttggcggatctggttcgggtttcttcgcggaccattatttccattgaaaaggaacagtataatccttccttgatgcttgcctatcgcatagcgcaggtctttgggacaacagtagaggacctctgctgcttgcaggagaacaaagcactggaagatcagcaatatgaggaagaatgacaggagaacagaaaggaggaactgttgtgaaaatatataacaaaaagggatgggttctcgggatgggagagattctgctgggaatcgttggtgtgtgcatctatgttcaaacggggtttcagacttttgattggaaggctggaactctgctgattcttctcttttcgtttggcgtaagcggtattgtgagaagctgttccaaggaagcgtccagagaggaccggattacacagcgggatgagagaaaccagtacattgcactgcggtgccgggcaaagacgatggagattatgacctatttcctgtttgccatggtggccggatgtatgattggctatggaataacaaaggacacagcgttcctgtggctgctcataggagcgggaattccctttggcgtgctgcagattgtctccattgtgctcggactttattatgagagaaatcagtaaatgaggaggattgtgatgaagatttatgataaaaagaaattctggagtgggcttggaattcttgcgattggaatacttttctttttctacgatctttcttctccttctgcaaatgggttccaggcaaagtggaacctcattctcggcctgattgtcatggcgtttgggatagcggacagcgcccgggcgctgtccagaaaaaagacgcgggaagcgcgaatcgagcaaatggacgagcggaatcagttggtgcggcttgccagcaaagcgaagactttggacattatgcaggtgttactgtttgtggttatggtggcttctttggtaggtctgaagaaaacagggtatctcccctttgcaggcatggccctggccgcgggacttttcgtggtgctggtcatttttatagagctttttgtgggaatgtactacgaagagaagaaatagggaaggggagaagaaccatgtcaaagcatatgcgccctgtttacgatgaacgggatgacgaaattgatgcccattccaaaagccgtgcgtgggattttgtggtggtctgtattgaagtctttacaattttgtgtgtggtaaaaggaaacacagcctggatcgggtgccttgcgctactttttgcaggaatggcggcgaacatgatgtaccgttttgacgaatatgaggaaagggcatactttcacggcggattgatcttgggggccattggcctcgctctgctgatctggtttggggtctgtggatagaaaggggatgtgcagcggatggagatgctgggggcgattgttctggtttttgcattgcagaaaatagcggctttgctgtctattccggttattttgggtatgatttgggtcaaggggaaggcgagcagaatggatggagaggcgtgggagcaatattttcgacaggtcagtaaccggcagtatgtggttttcctgcttgtttcctacgggatacctctgcttttgctctctgcccttgggtactgtctctatgattttctttccctgacagatcctctcattttagcgagtctgacctttttgttcggcatctttcatatgatccggaaattggatgatcacaaacgagagttatgggagaaacttagaaaattgggatgatgagaaagaagaggcgcaacgacaatcgttgcgcctcttttttgataaaatgcaaaattaaacccgttcagacaccaaatgaaagccagcttgggtcaattccttttgaatttgcacaatttgggcatgatcccttgtttccagtcccagcttgaggaagcagctggtgatggccatgttggcatcggagcggtcgtggtgtacagagaccacatttccaccgcagcgggcaatgatttcagagacttcctgcagctggcccggtttgtctgtcagggcaatggtgagactgacgtttcgtccgctggtcagaagcccccgggtaatcacgcggctgagaatattgacgtcaatgtttccgccggagacgatacaaaccacctttttcccttctaccggcagtttatgaaacaggacagcggcaacactgacggcgccggcgccctctgcgatcactttttgcttttcgatgagggccaggatggcggcggcaatctcatcttcactgacagtaacgatctcatccacgtattgttccaccaactggtatgtaatgtctccgggatgcttgactgcaatgccgtcggcgaaggtctctgcctggtccagcgtgatcggggtgccttcttgctggctttttaccatgctggcggcgccggcggcctggaccccgtagatttttacattgggattgaggtgtttgatggcgtaggccaccccggaaatcagtccaccgccgccgatggggaccacaacggcgtcgggattttccagttcatccaagatctccaagccgatggtgccctggccggcaatgacttcgtcgtcatcaaagggatggatgaatgtggcgccggtatcttcctggagctggagggcagtggcataggcgtcgtcataggcgccttttaccaggcggacttccgctcccagctgttttgtggcttccaccttgctgatgggagcaccgtccggcatacaaattaaggactggataccgctttgcgttgccgccatagcgaccccctgggcgtgattgcctgcactgcatgcaatgatgccgcggctcttttcctcctctgtcagctggctgattttgtagtaagcgccccgtagcttaaaacttcctgtctcctgtaagttttccgttttcagatagagctcacattgcttggagagctttgtggctctgatgaggtcggtttttcgggccacttttttgagcacaaaagcggcgtgatatattttgtcaagggtaagcatcctgtttcctccgtaccgtttattgtttgaatatctcttgattttttagtatatagtattttggggcggggtgcaagagaaaggagcatggaaggggaggtatctctgcatgagaagaaagagatggcatcctttcttttgattgccctatttactttttgacaaaaaaagagtatactacgattgttagcttatgctaatcaaaagacaatcccgtataccataggaggtaaccttatgattgcacagacgacctatccgttcgcgcttcctccgctgccgtatgcctatgatgctttggagccttatgtggatgaagcgaccatgcattttcaccatgataagcatctgaaaacctatgtggataacctcaacaaggcactggaggcctatcctcaatatcacacctggacattggagacacttttgacaaagctggaggaactgcccgatggtctgcgaaccgcagtgcggaacaatggaggcggggtctataaccatgatcttttctttgatcttatggcgcctgccgggcagaaaatgtcacccgcggttgcagagcatttcggtggggaggaagcttggcagaaagagatgaaggctgcggcgctgggacagtttggttctggatttgcgtggttggtggctgattcctctggggaccttcatatcattgccctgccgaaccaagataatccgctgtctcaggggttgacgcccattcttcccctggatgtttgggagcacgcttattacctgaagtaccaaaatctgcgggcagattatattgatgcctggttccatgttatcaactgggatggcgtaaataaaagactgcatcgagggtaaaagaaatgacacgacgtacgtcgtgtcatttcttttacagacccaaaatgaaaaaagagacgtatttacacagggggtgcctcttcctcttcctcgacaggctgccatgccgcgccgaagtcgatctcttgaaagagcgcggccaggccggtaatctgcttcaagcggagaatttcgtccttctccatgcccaagtgtttggaaatccatgcgtctgaccgccccaattcatgcagttccttgatgatattgctcatcaaatccacgttgtgggtaccacgggctcggttgtggcggatggtgctggccatccggtggtccaagggcttgtcgatgatgctgactggcagcattccgttctcccgcgcatagatgtctgggtaatccagcataatgcggtagcggtgaaatccgtctaccaggatgtacttgtcccgctccttatcataatagcagacaaccggcatcgtgtagccatcttgtttgatgctgtcatacagcagcttgagctcaggcggggcaacggcgttgggattgtatgtatttggctcgatcttttccacaggaactgcggtcacgtgatacacagggcttctaaacctcattttgagtcaccacctgtttgtattttgccttcagcgcgtctatctgccgtttctgttcccgcgttaggccaaaccccataaagcggcaagtatgatcgttgcggagaatgcagtagcacatgcgcttccagctgggaacgtcctttgtggatttaatgtcgtcggtatgatccgggattttccctaaaaaaatgacccgggagttgcgcatcaccgtgtaattggacacaccgttgcgccggatatggtagccatgggcgaggagttcttgaatggttttctcctccagaccacctcctgttttgtgccagaagttcagagaagtctggaacttcttgatgtagttattgcgcagtctggcagggagcgtcgccaataagaatttggtgtaggactcccaggtatggccatccggcagggagagtccccgataggccagtgctttggttttgccgtaaatggcaccgaaatttgccccccgaacccggcccaccagcctggtccaaatctccggatcgattacgcggtaaaggttcaggctgtcttttgctgcgtcgttaaaaggggaagccacccgcatttggctcggtttcaagccggccatataatataaatcgtatagccgattgtaatcatagccgaacaaggcgttggcgtgccagatatcgtcgatggaccagtcatagagaggggaggcggcataggtgtccttgaactgcttggagatccagcactgttctcgataaccgtattttttattcagaatgccgctgtaccgctgcagcgattcatcggcgcggatgcccagcagacagacggttttctgctttccatgagagagccggtaccagcggccaaactgcttggccaagtcctcctgatgcatccgatattggtaggtcgttatggggttgttctgtaggtgaattacatagggatgctgcggcatgggacggacccagagttcttgcttggtatcatcccacggataccagtacatttggtagctgctgaagcaggtccgggccgccatgggaaggcagacccagtacagttccaccattggatcttgggacagtctctggaaggttcgctccacatattccgttgtaacggtgtattgggcttcaaaatcctgatgaaataccccgatgggtttacttgggtagtattttttttggaaatccagagttaagtttaagagaagaccgctatctttcccaccggaaaacgagacaaaaatattatcaaattctgtaaaaataaagtgcatccgctgctgaaaggcttcatatacgttttgcgttaggtactgccgtgtcatacaatcataaccttttctattccagagacaggaaaaatcatccagtttatgttgcagtttattgtatcacactttgtcgaattgtgaaatatattgtcgaaaagtattttaagaaatttaatgtcgcccagacaagctatctggaatgcctgcttggacgagtatgccaatgggtatttttgatgcaaaaatataaaaaagaaccacggcagaataactgcagtggttctcttcttggtggacctgatcggattcgaaccgacgacccccacaatgcgaatgtggtgcgctcgcaaggtggtaagttttctgcccacggaccgcagtgtatggtttgatgaaaatgctatcagaccatgcgggtcaagatggccgaggagcagaagaatctgaggcagaagcaaaaaatgtgggcattgaggaaaccaatcctcgacacccacatttttgcgttacaggagaaaattcaaaaattagagctggaaatcgatagaattgtgatagaaaaaattatatgtcaaatctaatttgatttatcttgcaactcataacttttcgttccgttattttatcatcggagccgacttcgccaaaaagcaagggcgagtcgggaatgtgcttggcgaaatttgaacgcactgttttttcactataatttgcgtaacaatacttacagccattacggcatgaattatatgctccgatatcaatgctttcaatgcaaccgcactcaagacgttgacttttatctttccctatgtcgagaggacattctaacagtttgcttagtaagcgatcatctatacatctggcatgttcaataccgtattcctgtaattcaataccttctgcacaagtatcaattagtagaccatagctatgggcaattgcagctaactctttcgcaagactcttttgagtttcttctggaaaatcacgtagagataagccagaaacattttttgaggtatttcggtagaaatcgataaagctgatggtacatttttttgtatatgggcttaattcttttgcgattctttcgaaatatcgaatatggtattctggagtatatgtgtcgtttagaaaaatagggtcatatctccagataacacgatcaggaccaatcatatccgatagttttttaaatgcaggaataatatgtttctgcttattaggaacatgcgcctcaacatcctgtgcatacgaattaagtgtaaactgaaaataatacatataatcgtgtaaaatcttcaattcattgagcattggaattgggtttttggtccaaaaaacaatcccatcaacaacatcagggttcagagctatcttgcttatctggtgcgcattcatgggatttcgaaccagtacatagccatccataactcgattgaaaaaccaatttgaatagtatgttggaatgtctgttcgtcgactggcgcttataatcacaaatcacacctcttttctaaactcaaatatttgccaatgagcttgcttgcaagtaagtattggccaccagctgagtcttcgctcacaatcgtcttcacagtgttctccagtatgactatatcctatgcaagacgaatgcagctcatctttcaagaaatcaacaactctccaagggtggcgaaaatcttcgtcaacgtctttgattttcttttcacgccaatcttcagaaaaatgacaatatatgttaggatcgtcatctgagtggaatccattttcaagcatagcttcaaaaagggctcttgtccgacacacatctcgttccatgctgcctctgtctgtgcgtaaggaaaacataaagaaaactgtcttgcccatcggagtcttttcgccgaagagctttccaatttgcgacattgcaatgactggaaattcgcttttagatttcgggaaaatatacacattagaagaaagtgtatgtgcccgaagcaggcagtcaatggcatcattacatatgaaacgcacatcgtcttgaatccgcgcttccatttgatacgcccagtctatcgtatctatccctctataacgaatatcacatgaccgagggacgacattcgcgagtgcccaatagtccagcatacttccgcacccaatggaagtaacagatatattttttctgaaattcgttctatcgagcagagttctatacatgcatttgtattcgaaagagtatgcatatgcataacgaagcagatacagttgctgaacatgaatatttgaataatcaggaatttttcctgcatcaaaatgaacactctttaaatcgcagagtcttatgccggaatgcacatagtcttcaaattcttccaaaatatcatccaaatagtcgttgatagtgaacatttagacaccaccattcaacatatttattaaatatctaacggaaactggctactaaaagcaaaaagctacatttcgtcttaaaatggagaaatacaacttgctgtttggtatgagtagtaggggacaaacccacacaaattactccgctgaagcctaaaggtgatgtaacctcagtgacacatttgagctataccgatgtatgaagaaagttcctgacccgttctataagtatatcttgggtattagcacagggacgcagacgatttgcccactcacgtcccggatgcaactcgtcccagggcgacttttgctgcgcatatcttccactacctggatcgtggtttccgaaaccatccaatacacgattccagataggttggaacttttcgattaacaacgattcagcaagaggaatccagatatcatccacaacaaggtatcggcagaaaaaatcggattcattcaggttctcagcggcctttacggactcaaaatgttcattaagccttttataaagcgcggtgccggggtcacctccaaggccaaacccgcccttccgggcgccaggaggaaccgctttccccacatagatggggcgggaaaacatattatcgcgattgacttcagccaggttctgataagcctcaaagtctcctgtataatatatggcatagatgccagcgcccttgaacttttccgggggcaaggggtgtattgggctttttaacattgccgaagcaacgctttcacccaagtgccgtttgtccaaggggttaaaaggagcaggcgcaagaatattttcttctggcattatttttccaccctcctaagttccttgataacagactcgccaatcatctgcgcgagtcttactggaacggcgtttccgatttgacgcatactttcggtccaagatccgaagaaaagatagtcatcagggaaagtttgaatacgggcactttcacgaacggtataataacgtactgagccgtcatccaaaacaactgtgttttcaccgcctgggacaccatgcgcacccgctttaatagttttagagggctcgtccaaaacgcttccagtatgaccagcatatgaccgagctcccgggcgaaattcatggttcgctatttttagggcggctttgctttggggatctggcaaatcgcctatcgcgtctctaaccgtttgccaaggttttggcgcctctttcacatctgcgtatttggaagcaaacagctgagctttttttaattctgatgctgttggtgtggtacgatgattggaagctactctgtgagattcccaatattcacctataatatattttttataaagaagcgcttcgcgagaatagtctccctcagggaaagaccattccacacccaagttttcgcggaaaccaacaattacaactcgatgccttgactgaggaacaccatagtcggcagcatttaaaaggcgtgagaccacattgtatttcactccggaatagtgtccgctggtgtgcaacttttctaatatcgccaaatgctcgaaccaagtttggctctccgttcgaattacatcagggtatgttaactggagaagaatgtaattaaaatatgtggaaaacgactttctcaatagaccctttacattttcaaatacaaacgctttgggttttaattctcttacagctcgtacggcctctggaaacatgtctctatgatcattgtatgcttgatgttttcctcccagagaaaaaggttggcaaggtggtcctccagaaattagttgaactgaaaaatccaaagaagagtaattaatttttcgaacatcagactgaatcacatgccagtcatgtgctggaggatatccgctggaaatgttcccgcgaagagtatcgcaggagtctttatcccattcaattaatgcacgatgatggcagcctgccagttgcatacccatggctaagccacccgcgccggtaaataactcgattgaattaatggtcatacttgtctccgtccataaaaaggtgaattcgcttttcgagggaagtacgattcgattttttcatctcgcattcccatattattaggtattcccacccaagctgtgtcaattgtttgtaaacctccctgtcatggaagacattttgagaaagtttcttttcccaaaattcaacattgcttttgggtagacgtgtattcgaacagcctggatggcgatgccaaaaacatccgtgcaagaaaactactttttttctttttacaaatactaaatccggcttccccggcaacttactccaattgctgtatcgatagtgatagccaagcttccaaaacagatgcttaagctcgacctcgggtttggtgtttttgtttttaacaagtgccatctgcttgctgcgttcttctcttgtcatgttatccgacataaaaccaccatccaagattatcatatattatatgggatttttcaagaatagacaaggaaatccgctgcaaaactttctctgacaaattccaggggcgctttttgttactcttgatgaatggctttggaactaaaaacatggtattgtcctgtctaaagaggtggttcgcaatgaatgacaaagaaatacaagaaaaatatgaacgctcttttaaagagctcacagacacactctctccccagcaaatcaaactctttgagtgttggtttgaggtagcatgcctactgtatacaaccaagatagtcgaaaatcgtagtttaggactacaagaaggactaagaatagcgagagaactgatatcaatcacaggagatgaagaatatggttttttcaacagttagccagcaaaagcatcatttgctggttaatagttctcgggaaaatacaaattatcagtaaccattttttaatcctgtggtattgtgtgttgctaccgggaggtgcaacacatgaaaacacgactcaaggatttgtataactgcttctataccccacccgagttttcggagcagaagcaggaagtggaagaatgccaccaagcactgattcaagtgctggagaagccggaacggcggctggtactacgaatcatagatgcccagagtctgatggcggaggaacgctccatcgacagctttatctctggatttgagctggcgtggcagctctccatggaactgaatcaatatgaaaatgagcgctcagtctctcgctgtacgtcgaagagatcgagctctctttccatgtccggaatggaggaagcaatatgaagaaacgaatcatcactgctgcaacattcgcagcctgtctggccctgtgtgcggctatgtggccacagaattaaccagccggggaaacaaccgcactgcccacgccagccgctgtaatcgccacacagcccgaagttccggagatagtagagatggaagaagtcataccgccagaggaagaaaaggcaggagcaacactgccggaactggtcgaggaagcggacattgtcccggagccatcgcctgctcaaatgcccccatcgagtaaagtaccggttctacctgaacaggatgtcacacccccacaagaaccagaacctaccccggcacctgacagcgaaccggacaacatggtctatgtgccggacttcggctggataaaaggccaaggacccaaccatgcggaatacgccgaggatatgtacgagaatgacaataaaatcaggatcatggaataaataaaaaacagtgcggtataaggacaaagcctggtgccgcactgcttattctgcattctgctccaatgcgtcactgaagatctcatggacgtggatcagcgaaacaacttcacagagaaaccgctccgtcagctccttttcgtccagccaggtggtctgcggcggcacatagtaaccagaatcactctccgcctccgctttagctctgtgaatggctttctggatggagagccactggccatacgcgctgccgttcaactgctttttcagtttccggatggcgctcttataagctttctccgcgctgctggggccgttgtagttgagccggatggccaattcctgaaaggtcatgctctgctcgttgggctggccgatcaccagataacagcgcaccaaattcagctctctggggctcagcacctccttcatgcgctgcaggagcagcgtccggcgcatggagcggtcgtaggccctggccgggtcgccgccataccccaggtcaaagacgccctcgcccagagactcgatatgaaacacagtgcggtattcttccagcagacgcctggcgactttggcggagaccgtcagcttctcctgaatggctggcagtagatccgtttcgacatctcgctcatgcgtggcatagagaaatgccacctggcgcagctggcggtaacggtccagcggtagcgacagagagaaagaaccctgggcggcgcagtcccgcatggccgtctcgatggcggaggtcgcataggtcagcagcttggtccccatggatgggtcaaaccgccgcgccgcgtccagcagtgccagcgcaccctcctgcttgaggtcgtccaccagaaagtcctgagaaaactgctcgcagtagcttgcggccagcatggtcaggtatccctcgttctgggagagcaggagcggtgcggcctgcggatcgccattctgtatccgcagggcaagctcctcgttgcttgggcagagatcgtcgcagcggtacatactcacggcttttcctcccgggcaaggcgcgctctcgcctgggcatagatcgcttcctgctccatatcgcgggcatagccgctggcggcatagtcgttgtccatgagtgccttatcccgcaggctctccgccacatacagcgcttcattgcgcagctcatcggagatctttggtgcttgcggatggtgttggtgcgggtggtgaacaggcggtagaccgggtgctgtttgttttgctccttctgccgcatcatggcgccgtactgccggcaggtcatgcgggggtcttggggtgcaatgccatcgcagtattttggcatatagccgttggtggtgagaaagtatgtcccgcagccgcagcaccggctgggcgcatggccgtgctgcagtccgttcatcaggtcaaaaatgtagaagcttatgacatggtcaaagaaataccggttcacaaatacggtttccttttcctgctttgggtgccgggcaaagacataggaggatctcagctctggtgtgatggtgaatggctcaatatccggtaccggcaaatcacgcatcatactccagaaccattcactgttgaagcagtcgtgggcggccatggcgaagtaggtctccgtccgcttcttcagccgccgcagatagccctcctcaaaatatcgtgccgccacagcgaagtgctggatacccagggggatactgaaagcagccaccagatagcgtaagaaaaattcccgagcaggcgaatccagcttcagcagatcgttgtgggaggctggggaaaacagcacctccaaagtgtgtaactcctgccctttgtccatcaggctgtatggcggacagcgccacagggcgtccaacagcttctccagagaggtgcgggtcccgtccagcagtttgataaattcactccgcccgaccaaggccagggccttcacctgatggctgatggccccgccgtgggtgaccagctcccgcatagtctcctcgggaacattcaacagttcggcggcaaagtggccggtcgggtagacagtctcgttgaaaaagatctgatcccgccagacatccattatcagatgcaggaaattgttgttctgcctgcttcccagtggcatagggccaccccctctgtcctatatctgttttctgcctgtcttacgatattctcattttatcaaaatacccccaataatcaagtgaaaggaaaaactcctttcgagaaaggcgctcactgcggtgggcgcctttttcatactcagaacaaaggaggaatgattcatgaacaaaaatatcctgccgcttcgcacggtggatggagcggccctgatgagccagcccctgcgtccgcccaattttgtggtggacaccctgcttgcgcagggcctgcacatcctggcaggctccccaaaggtgggcaagtcttggctggctctgtggctgtccgtcatggtggccaagggcgaactggtctgggggatgtccgtgaagcaaggcaccaccctctatctctgcttggaggattccgttctccgcatccagaaccggctctttgagatcacggaggacgcaccaagcagcgtccacttctgcacggagtgcgacctcattggacaggggctggaggagcaggtggaaacattcctcactgcccacccggacacggtactggtcatcatcgacacgctgcagatggtccgtccggctcgcgacgcaacctacgccaacgactaccgagacctctctgctctaaagcggatcgcggatgcccacggcatcgctatcctgctgatccatcatctgcggaaggaaacagctgacgatgtgttcaatcgcatctccggcaccaccgccatcagcggtgcggtggattccagcttcacgctggtggaggaacggcggggcagcggcagggcgaagctctcctgtattggccgtgacattgaatatcgggaactgacgctggagcgcaacggtgaaaatgtgtgggagctggtgtcggacagccggacacagccggagctgctgggcgaccgcatcgtctatcttctctccgaactgatgcgtgaccgaaccgaatttatcggcactcccacggatctgtctgaacgaatcgaccctgtgggcgtggagcgcatctcgcccaagaaggtgtcccgacagatcctgcaaaaccttgacgcactaagcaaaatcggcatttccgttgtggtgcgccgcagcaacggaaagcggcttatcgggctgcgccgtgccggaagtgacgatacccagggtgtcccggcggtcgaccctgttgaccctgccggggcgctgtgcggcgatttgcgggcgatttccgagtatggcgagtaaacccccgcaaagcaagaaaaacgccgtgttgggccgtttgtggccgaaggaggagtgcgggtgttcggctcgggagaatcacctccttggaggtggccagcatcgcgtttgtctggtcaccggcacagccgccgcccgtcttccgcttgtttgcggggcgctgccccacaccccatttttacgaaagactggaggaaaccacatgaaaaaagatatcaaattcagcacccggatggcatccgaagaccgggaggccatcaagaaattggcgaaacgctccgggatgtccatgagcgattatgtgacggccagctgtctgggaaagcaggtagtggtcgtcgatggactgaaagaagtgctcaaggagctgaagtccatcggcagaaatctgaatcagcttgtcaccctggcgcacatggggcgcgtcacggtgatcaatctggacagtgtgcgccaggcgttctctgaactctgtgctgctgtccggttgatcctggaacgaaagcggtggtgagaaatggcgatcatcagcttcaccaattataagcggggccagaccaccgggtgcataggagctgtgatgcggtacaccatgcagaacaagaaaaccgagtgtgacggtcaacagttggtcacaggcatcaactgccagccggaatctgtctacgcggacttcatgaccaccaagcggctgcatcacaaaacggatggcgtactgttctaccacatggtgcagagcttcccgaaaggtgaagcggtcgacccggtcaccgctcatgcagcggcattgaagctggctgagtactatgagggctatgaagtcctggtctgcacccacacagaccgggaacacatccattctcactttctcatcaactcggtcaacttcgatacgggaaagaaactgcacatcgcaaaggagcagctccaggaactgcggcagcgcaacgaccaggtctgcatagaattttctcttcctgtgttccagcccaaggacaggaggcggaaaaacaagaccatgacgatcggtgagtatcacactgcggcccgtggccagagcaagaagctgcagctcatgaatctcatcaacgactgcatgcgccacgcttccagccgggaggagttcattgcactgatggagagcgagggctatagggttcgctgggaggaatcccggcggaacatcacctacaccacgccaagcggctggcggtgccgtgaccgcttgctgttcggggacaaatatctgaaggagaagatggaatatgaattcaggattagaaaagaaattatctatggacgaactgttggaaaagaaccgtcccgcgcagatggtacagaccacgccgcagctcccggcacaggagctgacaacgcctcccgaagtgcatcccatgaaagcggagtgggaggaactgctgagcagcctctgcacgctggggtaccacaccgagagacagactggttatctgaagaaggtcaacgaactgctggcgcagcttccgactcggacgcagatggacgaactgctgaaagcggtgaagcatctggagcagatgagcgaacaggctgggaagcggaacgaaaagcgtttttctctgcccggcatcaggctgcccagactgcggctgccgcacctggatggtcctacatgggcggtcctgctgatggggacggcagcgttgcttctgctgtggtgggtcttgggtaccgtctggagcagtctcagcctgatgctcccgtgatggacagcaccaccatgcgcccgcacacagacaggaaaacactccgcaagaagcagcaaaagaaaatcgcccagggccacgcccaggacgatcacgaagaagaacagacttggcagcagactatgtaaaggaggatgatcacatgagttatcagcaggcaatgtatgatcgggagcatccccgatactctgagccgacagaatatatcacgatggaagtggacggactgattgttgctctccgcttcaaaaacaccgttacacaacctggcacagtgtcggaaattgagcagacactgttgatggcgcaggactttgaaaatctgaacaagcctgcttgattcagtagactttttaccagtggtgtgggatactgtgtgtgcatatgaaccttgacaactgaatgaacagcaaaccatatgcaccgcagtcctacaccagaaaggacaaggtgcaatcatggaaaaaaacaagagagtatattgcctctatcgagtctctaccaaaggacaggtagaaaaagatgatatcccgatgcagaaacaatactgccgtgaatttgcggaaagccagggatggacgatcatcaaagaatttgcggaaaaaggtgtctcgggtttcaaggtggctgccgctgaccgtgacgccattcaggagatccgccaggacgctgaggaacggaagtttgacatcctgctggtgttcatgttcgaccgcctggggcggcgggatgatgagacgcccttcgtggtggagtggttcatccgcaacggaatcgaagtgtggagcgcaatggaagggcagcagaagatggatgatcatatcgacaaactgctgaactacatccgttattggcaggcctccggtgagagcctcaaaacctccgcccgaacaaagacccgcctgtcgcaaatcgtgcaggaggg

SEQ ID NO: 2221 - DNA, 198576 bp, KLE1738
accacataagagaaactatgtggtcaaacgccggaaagaagaacaatacaaggaggtaaccatgacatgaaacgaaggttattggcaatggcgctttcgctggttatgctggtggggttattcccaacggcggcgatggcgacggacgatccaggtggaggaaacagcagttcagtctcagccgacacctccacgctaaccacgtgggaagctgtctttggcggcgataccctctccaccaaggatatcggccgtatttggacggataagacggtatccgaagaaaatatcaccttgagcggtgatattgggagcagtgtgacaatcgataaggagacaagcgctgatttccttgtagggctttccgccttgggttccgctgcggacattacggatgttaccaaagtcccaacggatactgtgtttgtgctggatttatccaacaatatgtgggaggatgaccagatcaatactatgattcaggcggcgaacgaggcgctgaaaatgctgctgaatgcgaatccgcagaaccgggtggctgtggtggggtattccacccagtcctccgttcttcttccgttggagcactatgagagtagtagtacattcctaacaagagacaacaacacgttaaaggcaacagcagtggtaagaggtgaaataaaggaaagctcttttgaacgcctcacgaatacctcccacaaatatacgcagcacggcatttacacaggaatgcagttgctgcagagcgaggaggaaactacggcaaccgtcggtggcacaaccgtcacccgtgcaccggtcatggtgctgatggcagagggcgaggcaaagtacggctcggagaaattcattgatccgcccgaggaagccaccattgaagaggttggccagcgagcgacaagccgttatgcccagtcctttgttgccgccatgaccgctgcttatatgaaggaacaggtaacagcgcattactatggggacagcggtcagtctgcccgggtttatacgattggtgtggatgtggacgagtgcgatgccccggcattggcttatgcttatctggaccccgcgcagacagttccaagccatttttcagcaacggacggggataaaaaagacccgactgcatcttgggcactcaactattttaaagaaaagtttaatgattacaataccggcggcacggctgctattcatactggaagttatgacggcggaaatttgggatggaaagaaaccaagattacaaaaaatgacaatgaaaatgtcacggtaagtaagttcgagtacaacgaccagtactacgatgttaccgatgccaactggggtactattttcgaccagattgccgatgatgtgagcaatcaggcgccgacggccccgaccgatgtaaccgaaggcgctgaaggtaccggcggtgagagcggtaaactggtttttaccgatcagctgggaaagtacatgaaggtgaccggtaccccgaccatcgtctttgcaggaaaaaaatatgcagccaaaggtagccctgaaaccaaagacaatgtcaccacttatacatttgaggggactgtcgaaggaaacccggtttacggcagcgcaagcctgtccgctattaagctgaccgtgaccaacggtgatgagggacagactttggtgtgggaaattccggcgaatcttctccctctgcgtactgtgaaggtacagggtgatacagatgagcagggagagacctcctatacgatcaacttggacaaaaacgcctatccgatccgtctgttctactctgtggccaaagaggatgaacacaattggagtgaggcagataatgactatctgaagagccgctccaagaacggccagaccaattattatgaagcggtatgggatcaagagaatggcgaatacggcaccaccaccgccgtgttcaccccggcggaatccaacgccttctaccactataccgaggacaccatcctctacaatctggtgaacacaggaaatcaagatatctatctttctgaggaggacgccgaggctgcagaggtaacgactattctgccaggtgcagggacagtacaagttggcggaattgcttatcggcttgaagcagccgaaggatatgtgtctggccgtgcctattactatcagcatgtttactatcaggcagaagacagctctgacaccgctgcccaaaaacgaaccgactatcacatgctgcaggatggcagccgcattgttgtaggtggtaatgatagcaacgccgatatcgacaacggtgtcctcaagatcaaggccggaaccaataagctttcccgcgtatccgatggggatggtgtcaaggtcaaaaatacaacccaaacggccggtacctatcgtcatccggtgttcgagctgggggaaaacgagaaggtcaccgtctatctggggaacaacggtctgttgaaagaggccacgcctacgggaagtcttaccgtgaccgtaggaactactgagggagatggcgcaaattcagaccaggaatttatatacaagcttatcttagctaacctgaatggttatgataccctgactggcgaatacacaatcaagattggaggtgagagttcgggccagaagatcggcaataatgggaccttcaagctgaaagctggccagtgtgcaaccattgagggtctgcctgcaggcagtgtatggcagttacagcaggagaatgtccctggctatacgcctgcttttaccggagatgtgtatcaagagggggcgcaatccggtgcgatcctttacaaagagaaagctggcgctgcaaccttggataagaacgtgactgtcacaaatacatacaatcctgcccaagtgtcgtacctgcttacttatgatggaaacgcgatcagtggaagcttgcaggcccccccgccccaagcgcaaagtgtaaatagtggtgccagcgttacgctcccctcaagtgcaccgacccaccaggatgtggatggaaaagcggttgcgctgatcggctggacagaaactgcgacaagtaaaatatacagcttggcagacaaatcggagttcgaatccctgggcgaggacttccatgaaaaaggcggaaactacaccatgccggctaaactcacaacgctctatgcggtgtggggctatgacaccgacgaagatggcaccgccgatgtgaaggagactacttacacgctgacctacaacgccaatggcggtaaattcactgaagaaaaggagaccaaagaggtcaccgtagtggcgcaggacggctataaactgctggcatctggcgaggaagggcttcccacccatgcgaaaacgaattggaatggcacggagaccgctgtcgtgttcatgggttggtctactaccaaactcgaaaagatttacagcgtcaacgatgaacggcctgtgacagtctctgaaatagatattactgaaagtgaaaccgtctacgccgtttggggctacgatgccgatggcaatggcaccgcagatatcaacgacaatactcataagatcacggtgagcaccggtgacaacgggactgccacagtcgagtatagcatggataccacttccacccctgtaaacgctttgacgaaggcaggctccaacgattactatgtggtggacggccagaatctgacggtaaacatcacgccgaatagcggctatgcagtggacaccatcacggtggacaataatgagtacaagaataccgcaggtgcaacatccccgaatggtgagggctatacttccaacagttttaagtccgttaagttcgagaaagtgacagctggccacaccatcagcatcaccttcgccccggtaacaggcgacggtgaaatccccgacaaatacaaccgcacgctgacttatgatgccaacggtggtaaattcggggatgctgttacgggaacagataccaaggttataaccggactggaggaaagcaagtcttacagcttgtccaattccccggtgaaggtggatgcgccgacacacgagaaggagaacggtattgcggtcttgttccttggatggctgacagaggataacagcaagaagatctatggtgcggaggacaaagaggttctcgagcaacttcaaagcaaggtaacgatctcctcaaccggtacaaccctctacgcagcctggggctactccagcgacggcacgacgccggatgtggaaaaagacactgttaccgtgactgcttcggtgaatggtgacaacggctcgatcagccctgaaaataagacagtcatcaaaggcagctctgttgagttcacgatcaccgccaatgaggactatgcactggataccatcaaggtaggcagtgatattgttctcaccaatgatggtgacagcgagtataccgcagacgagaaccgccaaggcaagtggactttgaagaatgtccaggctggtacacaggtagttgtcagctttgctgaggacaaggacagagacggtatcccggataagaataaaccaatcgagcctgacccgcagccggagtcctacgctttgacctacgacaccaacggaggcttcggcgggccgggcaaggtcgaagttaaggctgacgcagcagaggactatactctggaaactacaaatgtgcccaagcacgcgccggatgaggacaacggaaccgctatgatctttatcggctggaccacggagagggacaccaaaatttacagtgcttctgacgagaaaggtccgacaaccgttgaaacccttaccctgactgccgacgatgaagtctacgcagtctggggctatgatgccaacgaagatggtaccccagatgtggaggaaacagacaagtacagcctgacctatgatacgaatgccatggaaggcgatacagtcagcggttctgtaagcgatgccaacaagtatgtctccaagcagactgtggcgctggccgatggcagcggcctgtcctatcaggaatctggagcggagaatgcaaaggttatgttcctcggttggtccacgaccaagacggatagaatcttcagcagcagcgatgaagataagacagctttcgcggaggttaccattgttcctgctgtgacctttgacagccaagacatcgaagtctatgctgtctggggttacgataaagacaaggatgaccgcccagacgtgataggcgaagactatgtgatctatcccttcgccggtcctaacggcagcatttctccggatacggcagccaccgttgagaagaacggcgaccaggcctttgcctttgcacccaacaatgggtatgcagtagatcggatcgtcattgacgataccacatacctgaacaacggcaagttggaattggaaggctatgataccgcgcaaaagacctatactttctcgaatgttcaggatgaccacagcatcatcgtgaccttttctgcggataaggacggtgacggcatcccggataagtatgacgacccagaggcgcagacctgcacggtgactgccagtgtaagcggtgccggcggcagcattgccccgtctggaacaatgaaggtgaactgcggcgagagtaagcacttcaccatcaccgctgattccggctatcacattgccgatgtcaccgtaaatggcaagagcgtgggcgcagtgagcggctatacgctgcagaacatcaccgagaatacaaccatcgtagccagctttgcccgcaatagcagcggcaccacccgttacaccatcacggccagcgccggtgccggcggcaagatcagccccagcggcagcgtgcgcgtgagccgcaacagtgacaagacctttaccatcacggcaaatgagggctatgtgatctccgacgtgctggtggacgacaagagcgtgggcgcagtggagaagtacacctttgaaaaggtgcgggaaaagcacaccattgaggcggtctttgccctggcaagcggcgtggccgacccggaggataccggggtgtccgactggctgaacaccaaggaccacaccgcctatctgagcggttacgccaacggctcctttggcccgaacaagaacatgacccgggcggaggccgcacagatgttctataacctgctgctgaaccaggaggtttccggagcggtcagcttcacagacgtggccgcagacgcatggtatgccaaggctgtgcatacactggcctctctcggcatcctccagggggtgggtgacggccggtttgccccggaccgtgccatcacccgggcggagttcacggtcattgccatgcggtttgccgacctggataccagcggcgagaacatctttaccgatgtgaatgccggcgactggttctatgaccaggtggttggctcgatccggtatggctggatcaacggctatgaggacgggactttccgcccgaacaacaccattacccgtgccgaagtgaccaccatcgtcaaccggatgctgggccgcgcggcggacaaggactatgtggacagccacaaggaccagctgcgccaattcccggatgtggcgcagacgaattgggcttattacaacatagtcgaggccaccaatgcccacgactatgaaaagtccggcgggacggaggactggaccggtctggcggactgattgacccagtgggcgcggcggaaaaaaccgcctgtgatgccccccatccaaacaagggggcagaggaaaacagcagcggtgccagacacaatgggcgcgaatgtcaagtgagacattcgcgcccatgttgcgtctgcgggagggaagggcagaccgaggcggaatggtgcagtgggccgcgcccggaaagcatgacaatgcgggatcggaacacggtccggggaaaccggactgtgttccgatttcttttcttgtagaagggattcccttccgggataaccgtatagagccgctttggcaagataaaatatggatattactttgtcaatggaggctctgcacgatgaatcaatataacctgacaatggaacaaatcacggcctatcgcacatggctgtctggggaggagaagagcgcgggaacgattgaaaaatacctgcgggacattggcgcctttgcccgctggctgaagggtgcccccgtaagcaaagaccggacatcggagtggaaaacgcatcttctggcgcaggggtatgcgcctgtcacgatcaactccatgctggcggcgctgaacggcttgttccattttttggggtgggacgagtgccggtccaagtttttgcgcattcaaaggcggttgttccgggaagagcgccgggagctgacccgcggggagtatgaccgcctgttggagaccgccaggagcctggggcgggagcggctggcgctggtgatggagaccctctgtgccactggcatccgggtgtccgaggtgtgctatatcaccgtggaggcggcccgggccggacgggcggaaatttccctcaaggggaagatacgcaccatcctattgccccaaaagctgtgccggaagctgcggaagtacgcccgtaaaaataaaattgcctctggcgagatctttctcaccagaagcaggagcgggctgtcccggaaacaaatatgggcggaaatgaaggcgctgtgcggacaggcggggattgcgcccaccaaggtttttccccataatcttcggcacctctttgcccggacgttttacaaggtttgctgtgatgtggtgaagctggctgaccttcttggtcacagctctgtcgagacgacccgcatctatctgatttccagcggtgcggaccatgcccggcagctggaacagttggggctggttcgttaaggataaaatcagcagtttgtctccaaaagattttttggtatccctaaaatatctatatctgccataaacattccccagattttttccgtaaagctgtgaggagacgcactttaacaggccgtccgagaaataagctcttgacggtcaaatttgttatgccgcaaatgaacacaccctcttgaaaaacaaggtttcttgtgataaactgactataaataatatgtagtttaagtaagggcctgcggcgctttatagacaaactgctgattttgtggcaatgcaggcagcgagagcaaatccagcggagcatcctgaacaaagatggggaaggggagttggtacaccacgggtaacacacattacgttggaactgattctcgataggggattggttaaatttatcttcacgaagggagacaaacccaatgaaaaagcagttactttccattttaacagccggctgcctgatggcagccatggtgcccgcagcgtttgcggcggacgccaacgatttgcaggcgcagatcgacgctgccgaggccggcagcacaatcaagctgaacgagaacaccacgattaccacgccgctgaacatcaacaagagcattaccctggatggaaatggctatactctgacctatacgggaaccggatacgccattcaactgaatacaaatgatgctgtgacgttcgacgacctggatttggatgccaccagcagcggcgggcgcggcctcgaaattgtcagcaacaagcccaactttaagctgaatgacagcctttggaatgtcaataaccgcgggattggttttggtagcaacggtacggtggctggcgcaaccgttacgattgatagctccatcatccaggacagcaaaaagcctgagaataaaacctatgagaattggtctgaccaggccgataccagaggcatcagcctttggaacaacaaaggactggagctgaacatcattgacaacagcgcgatccttggctttggctatcccatcaatatggcgggtgatattgtagacggtgttcgggatatggctgattccgtcattaacatcaccaactctaatatttggggctggtgtgccatgaacatctggaccattgataccactttcaacatcaagaactctaatctgaagggctttgttgagacggacaatgcttggaacagctttgccactattgttctaaacgaagacatctacaaaggcgtcaccgattccagcaaggccaacgtctttaatatttctggtgggtctgtttcctcgacctgcgtttccaatgtcgaggaagtgtatcattgcctgttccggctggacaaagagttcatgtccgagtttaattttgcacaagcaaatcggaagaaagttgctcttacctgcaccgatccgttcagtgcttttttagccacctatgaaggaatggacatccctgattttgaggattgggcagagaataagctgactggcgctgcagagaacaccacttataactggggggctattgctcctggtgtggatgcacctattcctggggttctttctatccagtcggttgatgatgtaactctgactggcgaaataggccatgaaggagggttcaatcaatgagaggaaagaagctcttatccctgctgctaagtaccacccttattgggactatgcttccaacggcggcgctggccacagtggatagcggagcggacagcagccccctcgtctgtaccacagacgaggggggtgcggcagagaatcacgaggaaaacacattggtgtctactccggcaaatactaagggcgataaaaccacccccggctgggaggacaacaatgacggccatcccaagcggattcaggaaacctttgactttgttgtagacggtattgcctacaaaaaattggatgatacaacagtagaggttgctccgtggtattggaagtggacccatagctgcaacgacggacatactgaaactgtgtttgcaggaaccgagtacagcaaccgtagcgatggtttgatgatccccaaggagattaatcacgagaatcaagcatatcaggtagtgggaatcggcgacaacgcgttctacaatatgactggcaccgaggtcaccctttccgaaggactcacctatatcggggccggggcgtttggctactccacatgcaaaactattgagattcctgcttctgtgacccgccttgataaagaagcgctccacggggattttacctctattacctttgcagaggggagtaagttggagagcattggagaccgggcatttcgtggctgtgatattaccagccttatcctgccaagcaccgtaaagtctctgggtcataaagttttccaagcctgcgactccctggtgtccgtcgaaattcccgccagtgttacggaaatccagaccgacacctttgacgagtattttgatgcggacgcaaatgaaggcagcgggaatgtcacctttgcagagggcagcatctttaagttgcaagacggcgttctctatgattccgagaacctgatccgtgtgctggactggcaggagaatgtggtggtgccggagggcatcaagtacattggtgcggatgcgtttaatgcttattctacgcagacccccaacaatatggaaactctgaaatccatcactctgccagagtctttggtcagcattggtaaaaacgctttccaagcctgtaaagcccttgagagtatcacaatccctaaaaacgtatccgaaatcggtggcggagcattttcaaactgttccagtttggctacggccgaaattctgggtcccgtcaaggaactcacgggaactaccggggtctttttggggtgtgccgcgctgaaaaatgtgacgctgcccgatacattgaccaacatcggaactggaactttcaacggatgtgcttctcttgaaaaaattgatttaccggcgggattgactgagatcggcagggaggctttcaatggatgtgagtcgctcaaagaagcgattatccccgacggagtaacagagatccccagctatgcatttactggctgtctcgctttggaaaaagtagaacttcccgaaggtatcacttctatcggcgagtatgcttttgacttaacggccgaaaatgatagcggtgaatatgttaatgagaatcccaagttggaatccatcaacattccatccacagttacttctatcgctggcaatttcttaggcggtgtaaaagctaacggcgaaaccgctctgattttcgagggtgaaaatcctccgacctttggattgggcgcgcttgacggaatcagcggagcaagtttcaataaacctactgtttactaccccgccgaggccgtagatgcttatacgtcggaggacagcgacttggttacgaacggccttgtttctgcacccgtggaaggtgaggaaaatagcaaccagtattctttggctgtttccccgtctgcaaccagtgtatatgagaataacaccattaactttaccgtggaaagcacgctgccccaggatgcgacgcttatggtagagagtagcaatactaaggttgcaacggcagcactttccagcgatcaaaagagcgtcacagttacgggcgtgaaggaaggaactgccacaatcacggtcagcattaagctgagtgacgtagttcttgcgtctgaaaatgtcaccgttactgttgacgagcgcggctcctctggtactacccggtacatggtaagcgtggaggatgcggacaacggcaccatcaaagtcagccccacccgcgcctccaagggcagcaccgtgaccatcaacgtcaccccggacgagggctatgagctggacaagttggttgtcaccgacaagaatggcgacaccgtgaagttgaccgacaagggcagcggcacatacacattcaaaatgcctgcctccaaggtcacggtagaggccacctttacccagattgccactgagccggagacgctgcccttcaccgatgtgaagacaggggattggttctatgaggcagtccagtacgtctacgacaagggcatgatgaccggcgtgtcggcggaccggtttgcccctgcctccaccaccacccgcgggatgatcgtcaccgtcctctaccggctggagaacgagcccgccgtgtccggtgatctgcccttcaccgacgtagagcgcggcgcctggtatgccgatgccgttgcctgggcggcggccaacgacattgtcaacggcaccagcgccaccaccttcgcccccaacagccccatcacccgggagcagatggcgaccatgctgtaccggtttgcccagtacaaggggatggacgcggttacccttcaggagaacctgacgggctatcccgacgggggtcaggtcagtgactacgccattccggccatgaactgggcgattggccagggcctgattgccgggatggagaacgggaccctggttccccagggcagcgccacccgcgcccaggtggccaccatccttatgcgcttttgtgagagcattggataacatcgcccgaggacacgatacggtattatgaggcccatgagaaacgcgcagacaaccaacaggttgtctgcgcgttttttctcttttggctgatgtcccacccctctctcaggatgtctgccgggaacggatgatgtacgaagcaatgatttcaatgaactcggaagcggtaggcgcggcggttaagggatagccagccatccggcagagcaaatccgggttgacctgccaagcccgggaaaccactgttcggaggttgcgctctaccgcggtccatttacatccgaagtggtcggcggtttcccgatagattttctctgtgatctcttccaaccgatcctcttccatgacggcaagatgaatggcataaactgtgaggggaaatcccttgtaacacctggtgatcccaaaggggcgcagcgtttccagaatggttgtcatagacatatcctcctaaatgaaaagatttaagaagataatagaacgaaaaacaggaaaatcgctggttgtcgctgatattcgacactttgggtttgaaaaggacaggatttctttgcagaacatgtcttcctgatgggccggtggatttccttgggaataaccgcccggctcagggcatggaacagcgccgcccggattacagggcggcgctggggagatggcggacaaaggcatccatgtgttctactttgtccagctgggagagaatggcctctttttggccgggggtgcaggcgtcgaaaaaacgggccgcctcccggtttctgcggaggcaggactgaaaaaccagtgtggcatttggctgcatcaagatcacctctccggtagcatgcccggaaatcaggggaccatccccgccaaaagaaggaaccgcgccgctgcagggggaaaagagcggcccgcttataaaaagggcttcatctgctctacgttggcctgctcggtggacagcagtttttcggccaaggaccggacctgccggtcgtttccctcatagtcgtggagatgcttgagccccttggtgatgcccatgttgttgcccttaatggtcatctccgcaattttggagtcggaggaatcggcgagggtctgcatggtggacatgacctcagaggagaggcgggccatcaggctggggtcctttggggcggtgcccttggcctgcaagagcttggcggcctcggatgcaatggtttgatattctgcaatctgcccctggagggattttttcagcttggcggtttggacctggcccacgatgtcttgcaggccgagaatccccatttccgcggtttcatggacgtactggagcagttcaatgtctttcatttggatcacctcatcgatagtatgccccaaaaaacaaggggaatgggaaagactgcctggaaaaaagaaaaaattttttggaagcgtgtatacaaacgtccccctcgcgggggtgtttccccaaagagtgagggcaaaagaaaggagggatcgtatggggacaactggacaaatgctcatcaccgcgggggcggtgctgtcggcgggcatcctgttgctgaccacctataaccgggtctaccgttggaccctgcggcagaaggcgcaggacagggaactgagcgccattcggaaagagaataccctgctgacctatggggtgctggcctgcctgaaggggctggaggagcagggctgcgacggcccggtgcatgaggccattgacaagattgagcgggacctgaatctccgggcccacgaccaggagggaaactgcggatgaaacaacagggatggaagaggtggtggcgcgcggcaggcgtccgggccatcaaaaccatggcgcagaccgccgtggcgaccattggggcggcggctgttttgtgtgaggtctcctgggatgtggtgggctctgctgcggtgctggcggggctgctgtccctgctgaccagtctggctgggctgccggaggtagaggggtaagcgggaaggtatccccgggacaggcaccaaaattccctttttttctacgatggaatggggggaatgggtgaaagatacggggttggggccgagagggagaaccccgttcagactatgatttgatccaatccagggagggaatgtatatggcggaaattacggagaccgttcttcaggcgggcgatgagattccagaaagcatgttggatgaaatgaccaacgggaagggggaggcaggcgatgagcaatagtcctctggtcagctacacgaagctctcccccaatcattccgggcggcgcaaccatgtgattgacacgatttccattcactgcatggcaggcaatggttcggtggagacctgtggggcgctgtttgccgacccggcccgcaaggccagcagcaactacggcattggaagcgacggacggattgccctgtatgtggaggaggccaaccggtcctggtgtacctccaatgccgccaacgaccatcgggccatcaccattgaggtggccaacaacggcggggcgccggactggccggtgtcagacaaggcctacgccgcattgctggacctattgacggatatctgccggagaaatgggatcaagaaactgctgtggcagggagacaaagccctgatcggccaggtggaacaacagaatatgacagttcaccggtggtttgccgccaaggcgtgcccgggagactatctgtacagacgccatggccaaattgccgccgaagtgaatcggcggctggaagaggaggaggaaactgtggatattgcgaagctgatcgcggagatgaccaacgagcaggcttatcagctgctgcaaaaggcggagctccacgccaagaccgtggccgagcccgcctggtcccaacaggagggtcattgggcaaaggccacggcggaaggggtggtggacggcaccagcccggagcgccccatgaaacgggatgaagtgatcgcggtgttgggccggaagggtctgttataaggctgaaaaaataaggaacgccctctggcgcttggccagagggcgttcctcattctaaaggggttaaggggaattgggttttcagaatttcttccaccgcttgggtgaactctcggtactcgtcaatcaggcgtctcaggtagagacggccgttttctgtgatggagaagtaaatgcgggtccggttttcgtcagaaagctcctcaaagtctttccgaataaactgaaaatcctccagacgataaatagcgatgtaaagattggtcagagaaattttcccgtcgctcatcagcttgatggtctgcatcatctcataggtgtacatgggctttctctccaagagaaacagaaccagcatttctgtggttgcttttttcagggattctcgaatcccagctggagtgcccgccactttatctcgcttgagctcttttcgctttttcatgacatcacccagttttgatactttttattaatcatatatcaggaaaagtaaattgtcaataagaaatacttggtagatacatcaccaatagaataatttatgaatactgttttgtgccgagggaaggcaaaattgagcaaaaagaacaaaataaaaacgctgccccatggataggacagcaaaaattgacaatccgcggcgcggcatggtatgatggatgtaccccaaaaggggtcagaaagaggcgctgttacatagacggcggttagccacttccctgcgaagggaggtgatgcttggatgggaaactttctctggaagttttttgtatgcttggcctttgcggcctacatactctccataaaagcgtgctgaccgcttggatggtacccaaacggtcagcatagaacatatgctactctgatgggctaaccgcagtagcagcgccctttctgtttttcattataccatcccgccccggtttgtcaagagaacaggccggagctttaccgtacctggaatgagggggcatagagcggagaaaagaaggaaatgtggaaacgctggcagaacagcggcggggcagagcgggacggttgagatacggcaacggggaatacgtcaaggcatgtcaagaaagaatcaaacaaaaaagttccgaaaatcacccaaataagatgattttcggaacttttggtccgagtgttgagattcgaactcaaggcctcttgaaccccattcaagcgcgataccaaacttcgccacacccggatgccgtttcaaacagcttagtaataataccatggggagaagaaaaaagcaagagggttttgaaaaaaagaggaaaatatatgcacaatttctttgctgtatttcgaagcaaaattgggtgatttatacagcgttgggggagatcacctcttccagcacaatttgtgaccaagtttccagacggtcaaataccgcactgagttcctgaggagaagcccaggagccggacattttttcggtctcccggacggtgacctctcctgtggtttccaggagatagaccagggcggtgtggtagtcactgacgccgccggtggtttcattgatcagacccacgcaggtcagggaggtgatctgagaaagggtgacctcctctgagagctcccgccacagaccggcggcaatggggtcgtcgtcggcttcctccgtggggttgatgtggccgcccacccccagggaaagcttttcatggaggcgggtctccgtctgctttttcaggcggcgcagaaggaaatagtgcctcccccggcgcagaatgacataggggatgatctgcctgacggtattgtcatactccgcctgttctcgggggagaaaggtatgatggtccagaatgaactgacggatggtctcgagattttgggagaggaagggaccggggcccaggcgggcttccaaggcggcgcggtttacaacgaggacttgctccatggcagtcacctgctttctgtggggtgttgtgtttattgtaccagaagtggtccagcctgaaaaggcaaacttgcccgaaggggcttcggcaaggaagggttatagggtgtctccctttcgtggcgggagaacgaagataaagagcagggagctgatgagaagcaggaaagggtaaaacagattggggatgacctggaaggcggacagttcatgtcccagttcactggcggcggagagggccaccagcatctgggcgccgtaggggaggataccctggaagatgcaggagaaggtgtccagcagggaggcggtctttcggggggagatgccgtagtcctgggacatctccttggcgatgggattggccatgacgatggcgacggtgttgttggcggtggcgatgtccatggtgcccaccagcaggcccatgcccagctgaccgcccttcttgccgtggaagacccgccggatgccgttcagaagggcgtcaaagccgccgtgggcccggatcagcgcgcagagggcggagaccaggatggcgaccatggcggtctcatacatcccagcggcgccggagcccatgttggccagcagctctgtgggggcggtggcccctgtggccagcatgataacagccccggacccaatgcccagcagcaggacgagaaagacgttggccccgagaattccccccacgagaaccagaaggtaggggaccatctgaatgaggctgtacggtgccaggaccaggggcccggtggactgcccgaaggagagaaccaggatgagcaggagggagaccagcgccgccggcagggcgatggcgaagttgacccgaaatttatcccgcatggggcagccctggccgttgcaggcggcgatggtggtgtcggagataaaggagaggttgtccccaaacatggccccgcccatgacagaggccacacacaggggaatggagaagccggaggcctctgccacagacagggcgatgggggtgatcagggtgatggttcccaccgacgtgcccatggccagtgccacaaagcagctgaccacaaagagaaccgccacggcgaactgggcggggaccagggagagcagaaaataggccacgctgtcggcgctgctccgccccaccacccccacaaaaatgccggcggtgaggaagatgagaatcataatgatgatgtttttgtcccccacgcccttccccataagaaggagcttgtcatccagggaaagggcccggttctggaggcaggccaccagcagggctgccaggaaggccaccacaatggggatgttgtagaagcccatggggatctgtaaaccgtactcaaagaggatgccaaggcccaggtaaaggatcagaaagacgccgatggggagcagtgctttgacgttgccgcgcttcatagaaagaacctccgattttcatgtctctcggacgggagcgaggctggtcgatccggggaggcgcccctggccgcctgaggcaaacaagaaaaagctacaagaaatacggggaaatgtcaaggggatttccggggcgggcgggaaaaccttgcaattgatacttgcaatttgttccgcgacctgataaaatatacggcgtctatggaaaaagggtggtcctctggggcatgcaccaagggcgtgcataggaaatttccccatgaacacctgtattacaggaggaaaaagacaatggatctcatgaaaaattttattgagaagaacatgcctgagaaggcagcccccgacgtcacagtgggtgacaccgtccgtgtccacctgcgggtcaaggaaggcaaccgggagcggattcaggtgttcgagggaacggtcatcgccaagaagcacggcggcatcaacgagaccttcaccgtgcgccggatctcctatggcgtcggtgtggagaaggtgttccctctttacagccctgtcattgagaaggtggagaccgtccggaaaggtaaggtccgccgggccaagctgtactatctgcgcgaccgcgtgggcaaggcggcaaaggtcaaggagaagctgtaattccaacgagtttccgaaaaggggagcgctccggcgctcccttttttgttggacgcgggcccgccggaaaaccagggagcaggggcgtttttccagggggtttccccgcttttttgtggaaaagccttttcagaacggggaaagtcgtgtatactaatcagttatgaaataacaccgttccagggcgggcagctgccccggcagggaagggagaggataggaacgtgaacatccaatggtacccgggccacatgaccaaaacccggcggatgatcggggagaatctcaaatatgtggacgtggtggccgaggtcattgacgcccggattcccattgccagccggaacccggacttggacgagctggtgggggggaagccccgggtggtcattctcaaccgggccgaccaggcggaccctgccgccagcaaggtctggggggcgtactttcgggcccagggaatctcggtcttggagtgtgacgcccgcagcggcgcgggggtcaagcagttttcccccgtgatgcgggcggcgctgaaagagcagatcgccaggtggaaggagaagggccaggtgggccggccggtccgggccatggtggtgggcattcccaatgtgggcaagtcgacctttatcaacaaggtggccaggaagaaatccgccaaggccggggaccggcccggcgttacccggggaaagcagtggatcacggtggaccaagggctggaactgctggatacccccggaattttgtggcccaagtttgaggatgagaccatcgggttgcatctggcctttaccggcgcggtccgggacgccatcatggacgtggagaccctggcatgccatctgatccagctgctggcccagcgaaagcccgagtctctcgcagcgcgctttaagctggttccggaggaagggatggacggctgggcgctgctggaggccggcgcccgcaagcggggctttttgatctccggcggcgaggtggacttggagcggatggcccacattctcctggacgagttccggggggggaagatgggccggatcaccctggaactgccggaggacctggagagaggagcggacccaagtggagtgccctgacctgtgggaaattgagaacagcctgtttgcccagggctgcgggtgcctgtgcggggtggatgaggcgggggcgggccccctggccggccgggtctacgccggggcggtgattctcccccggggctggggccacccctacctcaatgactccaagcaggtgacggagaggcggcgggagattctctatgaccggatctgccaagaggcggtcgcctggtccgtggcctgggcggaggtggaggagatcgaccggatcaacatccttcgggcccggctgctggccatggaacgggccatacagggcctgtcccgccggcctgatttggccctggtggatgggaaccggtccgagggcatcaccgtgccctgccggacggtggtgaagggagaccggaaaagcgcctccatcgccgcggcctccatcctggccaaggtctccagggaccggtacatgggagagatggccgcggtctatccggtctacggctttgagcggcacaaggggtaccccacccagctgcactaccagcggctgcgccagtacggcccctgccccatccaccgccggaccttcctgaaaaagctgtgaggggcggggaccgaaccagcctggggctgtggggggagaagcaggccgcccggtatttgaggaagcagggattccgggtgttggagaaccgcttccgctgccgggagggggagatcgaccttgtggtctcccggggcccctacctctgttttgtagaggtcaagctccgcaggaatgccgaaatggccgaggcccgggagtttgtcaccccgggaaagcagcggcgggtccgcaccgccgccctctattacttaatggaacatccctccccgctgcagcctcggtttgacgtggtggaggtttacgcgccccagggagagagcacccgcaagccggtggtccgccactgggagggcgtgttttgatggaagcgcccggcgctgcggtgccggggtccatagaattgtttttgcgcgcccggagcatggggcgcggcattgtctctggaaaggtatgtgaatcacatgaagtatgtcagcacaagaaatcagtctgttcgcctgcgcgccagccaggccatcgcccagggcctggcccgggacggcggcctgctgaccccggaggtcttccccaagctcacccccgccctgctggaggacctgcggggcaagacctacggccagcgggccgtggcggtgatgaagctgtttttggaggatttctccgaggaggagctgacggcctttacccaggccggctactctggggaaaagtttgacgatgcccgggtggcgccgctggaacccctgacggaggatacctattgcctggagctgtggcatggccccacttcggccttcaaggatatggccctgcagatcctgccccatctgctctcggcctctctggtcaagaatcaggaggacaaaaccgtgtgcatcctggtggccacctccggggacaccggcaaggccgccctggaggggttcaaggatgtggaccggaccaaaatcctggtgttttatcccaaggacggcgtctctgcggtccaggccctgcagatgcagacccagcaggggaacaacgtgggcgtgtgcgccgtccacggcaattttgacgatgcccagaccggggtgaagaccctcttctccgacgagaaactccgggaggacctggcccggagagggtatttcctctcctcggccaactccatcaactggggccggattctgccccagctggtctactatatctccgcctactgcgacctgctgaacctggggaagattaccatgggggagaaggtcaactactgcgtgcccaccgggaacttcggcaatatcttggcctgctggtatgccggccagatggggctgcctgtgggcaagctcatctgcgcctccaacagcaacaacgtgctcacggactttttggccaccggcacctatgacaaaaaccgccccttccataccaccatgtcgccctctatggacatcctggtctccagcaatttagagcgtctcctcttcgccctgtcgggccaaaacgaccaggaggtggccggctatatgaagcagctgggggagaagggatgctataccgtctccgaggagatcaaggccaagctccaggcggatttctacggcggcttctgcgacgaggccaagaccagcgccatcatcgcccaggtctggaaggagcatcactatctcattgatccccacacggcagtggcctatggggtgatgcaggactaccgggaggcgaccggggatgaccggaagacggtgtttgtctccaccgccagcccctttaagttctgtgacagcgtactccacagcctgggcgttgcccaggtgcgggagggcctgggcgccctggatcagctggcggaggtctccggccggcccgcccctgtccccctggccagcctccgggacaaggcggtgcgctttgaagagagcgtggacaaggagaagatgatggacgtggtcctggacatgctgcgataagcgcggggggaagccagtggcactgtacaccatcggtgacacccacctgtccctgggcagcgacaagcccatggacgtgttcggcggggcctgggagggctacgtggaaaagctggcccaagggctgtctgttctgcggccggaagataccctggttatcgccggggatatctcctgggggatgagcctggaggagtcggaagcggattttgcctggctcgatgccctgccgggaagaaagattttaatgaagggaaaccacgactactggtggaacacggcggcgaagatgacccgtttttttgccgaaaaggggttttccaccttgcacatcctccacaacaactgccacttctatggggacttggccctctgcggcacccggggttggttctatgaggaggagaagcaggggcagaatgaaaaggtgtttcgccgggagctggcccggctggagacctcgctccaggccgccgggtcccgggagaagctctgctttcttcattacccccctttttacacggggtactgctgcgcccccatcctggagctgctggagcggtaccaggtgagggcctgttactacggccacctccacggcgccagccaccgcctggcccttcagggaaggcggggcggggtggagtaccgtctggtctcggcggattacctaaagtttcgcccggaaaaaatcttggaatgaggaaaaaaagtctggtaattctggaaagaatctgataatatagcctatatatactgcaatacaatgccttttcaggctctcaagggagcaaaaagggcgtttcacaggaggaaaaaggacatgaatgtcaagagcgttgtagaaaacaaagagaagtttgaggtcgaactgaccattgaagtgggtcaggaagagttcgaagccggcctggacaaagcctatcgcaagaaccgcggcagcatctcggtccccgggttccggaagggcaaggccccccgtaaggtcattgaggggatgtacggcgctggagtattctatgaagatgccattgaggagatctatccccaggcatgcatgcaggccattgaggagaagggcctggattccgttgcccctccccgggtggaaatcaccgatctggggaaagagggcttcacctttaaggccattgtcactgtccgtcccgtgatcaccctgaagcagtataagggcctggaggccgacaaggttctgcccaccgtcaccgacgcggcggtggacaatgagctcaagcagtatgtggaccgcgccacccagctggagccggtggaccgggccgctgagatgggcgacagcatggtcatggactatgagggcgtcaaggatggcgtgcccttcgagggcggctctgccaagggctatgagctggcgctgggctcccacaccttcattcccggcttcgaggagcaggtggtcggcatgaaggcgggggaggagaagaccattgatctgaccttccccgaggactatcacgccaaggatctggccggccagccggtccagttcaaagtaaaatgcgtcgaggtgaaggagaagaaggtccccgccatcgacgatgagtttgccaaggatgtctccgagtttgagaccctggctgagttcaaagaggacctgaagcagaagatcgtggaccggaacatggcccagagtgaggcgaagttccgccaggccctgctggcccagctgtgcgagcaggtggacattgagctgcccgaggccatggtggagacccagatcgaccgcctgatggacagctatgcctcccgcctggagcagcagggcatcagcctggagctgtacctgcagtacatgcagatgagcaccgacaagctccgggaggacctgaaagaggccgctgtgacccagatcaagcagcagctggcgctggacgccgtggtggctgccgaggagatcgtggtcagcgacgaggacgtggaggaggaggtcaaaaaggccgccgccaacctgaacgttccctatgagcgggtgaccgagggcctggatcgggaagccctgaaggtggacctggcccgggaccgcgccatggccgctgtggctgtggctgccaagcccaacctgatcgcggcggatgccgaagacggggagatcaagctcaccgaagtgaccaaggatgaggagaaggcggcggaagaaaccgaggccaagcccaagaagcgcaccaccaaggccaaggcgaaaaccgaagagaccgcagaggacggtgaggagaagaagcccgccgccaaaaagcccagagcaaagaagaccaccgcagaaggggaggaagctcccaagaagaccaccacccgcaagaaaaaggcagaagagcccaagggtgaggaataattttccgtggggcgggcatactgtgctctgaatggaaaaggagatcaagctatgagtttagtgccctatgtagtcgaacaaaccaaccggggagaacggtcctatgacatcttctcccgcttactcaacgaccggatcatcttcctgtccgaggaggtcaacgataccacagccagccttgtggtggcccagctgctgtatctggagtcccagaacccggatcaggatatccagttctatatcaacagcccaggcggttctgtcacggcgggaatggccatttatgacaccatgcagtacatcaagtgcgatgtctccaccatctgcattggcatggctgccagcatgggtgccttccttctggccgcagggaccaagggcaagcggatggcgctgcccaacgcggagatcatgattcaccagccctccgccggaacccagggacagattacggacatggcgattcacctgaagcgcctggaagtgatcaagaagcggatgaaccatatcctctcggaaaacaccggaaagcccctggatgtggtcacagccgactgtgagcgggataatttcatgtccgcccaggaagccatggagtatggcctcattgataaagtgatcgataagcgctgataggacaaggaaaaaaggggggctggcgtccccctttttcctgcgttagaaagaggtgaaatggttttggccaaaaacgacgaaaaacgagccatccgctgctccttttgcggcaagcatcaggatcaggtgacaaagatcatcgccggacccggtgcgtacatctgcaacgagtgtgtccagctgtgcatggacattttagataatatggcggccccggaggagcagcttgtgagcccggatatgccggagatcattcccagccccaaggagatcaaggcctatctggatgaatatgtcatcgggcaggagaccgccaaagtggccctgtccgtggcggtttacaatcattataagcgcatttactttggcggcggggacgatgtggagctgcagaagagcaacatcctcctgctgggccccaccggcagcggaaagacgctgctggcccagaccctggccaagattttgaaggttccctttgccatcgcggacgccaccaccctgaccgaggccggctatgtgggggatgacgtggagaacatcctgctgcgcctggtgcaggctgccgactatgacatcgagcaggcggagcgggggattatttacatcgacgagatggataaaatcgcccgaaagagtgaaaatacctccatcacccgggatgtctccggcgagggcgtgcagcaggccctgctgaaaatcctggagggcacggtggccaatgtccccccccagggcggccggaagcacccccatcaggagtttatccaggtggacaccaagaatatcctcttcatctgcggcggcgcctttgacggagtggagaagatcattgaaaagcgggtcaatcagaaaggcatcggctttggcgccgagatcatgagcaaggcggagctggaaaagcgcaatattttaagccagattcagccccatgacctgctgaagttcggcattatcccggagctggtgggacgtctgccggtgatcacctccctgtccccgctgagccgggaggatttggtgaagatcctcaccgagcccaagaacgccctggtcaagcagtaccaaaagctgctggaatatgatatggtgaagctggtcttcacccccggggccctggaggccgtggccgataagtccatggaacgggggatcggtgccagaggcctgcgggcggtgctggaagaggtgatgtcccagattatgtacgacatcccttcggacaactccattgtggaggtggatatcacccccgaaagcgtccgggacggggcggaaccgcagctgatccgcgaccccaaccggccgcctcgcccccacttgggcgctgcggccctccgggcccagagcggcggcctggcccgccaggacggtacagcctgagggcgagacaatccaattccatgcaactgacagggcggagggggaaacttctccgccctttccgtctactccagcgcggctgcgctggaatccaagttccagttttcgttgaaaggaagtgaatcggtttgccagaggaagaaaagactgaaaccgtgccaatgcaaaccatgcccgccctggccctgcggggtctgacggtatatccgaaaatgatggtccactttgatgtgggtcgggaggcctccgtgaaggccattgaagagtccatgtcttccaaccaacccattttcctggtggcccagaaggacatccgggtggaggagccggaccgaaaccatctttttgccatggggacggtttcggtggtccgtcagattctccgcctgccggggaagaccatccgggtgatggtggaggggcagatccgggcccgcctccacgagctgacccagaccgatccctacctggtggcccaggtagagccggtggagaccagcgagcactatgagggaaagaccaattccctccgggcggaggcggccattcgccaggcctatgagctctttgaccgatacagcgaactctcccccaagaacgcctcggcggagatgctgatgaatatcatgtccagcgaggacgccggctatattgccgacttccttgcccaaaatgtctccatgcgggtgctggacaagcagtccatcctggatgagctccggccggtccagcggctgaataagatgaaccgcctcctccgccgggaggtggagatcctggagatggagcagagcatccagcgccgggtccaggagaacatgacccagaaccaaaaggacgcctttctgcgggagcaggtgcgggtgatccaggaggagctgggagaggacggcgacaatgagctggccgcctaccgccggcagattgccgatgccaagttgccggaggaggtggagaccaagctgctcaaagaggtaatgcacctggagaagcagcccttcggttccgcggaggcctcggtgctgcggaactacctggatgtgtgcctggagctgccctggaccaagacctccaaggagagggtcaacgtccaggcggcccggaagattctggacgcggaccacttcggcctggaaaaggtgaaggagcggattctggagtttctggcggtcaagcagctggccccggatttgaaggggcagatcctctgcctggtgggccctccgggagtgggaaagacctccattggaatgtccatggcccgggcactgaaccggaaaatggctcgaatttccttgggcggcgtccatgatgaggcggatatccggggccaccggaaaacctatgtgggggccatgcccggccggatcatcaatgccgtccgccaggcgggcaccagaaatcctctgcttttgctggacgaaatcgacaagctgggcagcgacatgcggggcgaccccgctgcggctctgctggaagtgctggacggggagcagaacagtaccttccgggatcactttgtggagctcccctttgatctgtccgaggtgctgtttatcaccacggccaacaccacctctaccattcccaagcctttgctggaccggatggaggtcattgagctgcccagctacaccgacgaggaaaagctccagatcgccaagcagcatctgctgcccaagcagctcaagcgccacggcctaaagaagaatcagttgaagatcaccgacgacgccatccgggaggtcattgtctcctacacccgggagtctggcgtccgagtattggagcgagagctgggggccctgtgccggaaggtggccatgggcattgtctcccagcggtataagcaggcccatgtcacaggggacaccctggaggagttcctggggccccgaaagttccatccagagaagaatggcctggagaaccaggtggggctggtcaacgggctggcctggacctccgtggggggaaccctgttggaggcggaggtcaatgtggtgcccggctccggcaaagtggagctcacaggcaacctgggcaatgtgatgaaggagtcagcccgggcggccttcacctatatccgcagccgggcggtccagctgggggtggagcccaacttctacaaggaaaaagacattcacatccacttccccgagggcgcagtgcccaaggacggcccctccgccggagtgaccatcaccacggccatggtctcggccctcaccggaattccggttcggggagatgtggccatgacgggagaagtcaccctccggggccgggttctgcccatcggcggcctgcgggaaaaatccatggcggcgctgcgcaacggcatccacacggtcatcatccccaaggacaatgaatccgacctggaggagatcgaccagacggtccgcggcgccctgcagttcattcccgcctcccatgtggaccaggttctggccaacgccctggagcatccccctttggcgcagcctgcggaggacgcgggggaggcccctctgggcggtcccgggaccagttcccaggcatccattccgagaacgtgagaggaacgctgatgaagctcaacacacaaaacgcggagtttgtgctctccgcggcgaggctggcagactgtccccgggacagtctgccgcagatcgcctttgcaggccggtccaacgtgggcaagtcctctgttatcaaccgcctgctgaaccgaaagaactttgcccgggtggggtccgccccaggtaagaccacccacatcaactatttccgcattgaccgaaaggtgtactttgtggacctgccgggatatggctatgccaaggtttccaagcaggaacgggcccggtggggcaggctgattgagcagtggtttgccgacgccagcctgctgaccctggggattctgttggtggacctgcgccacaagcccaccgccgatgactgcgtcatggcccagtggtttaaggattccggcaagccctttgtggtggtggccaacaaacaggataagatcaagaaaagcgagtgggaacccaacctggcccgcatccgagagaccttggcgctggatgcacagaccccggtgatctccttttccgcggaaaagggactgggaaaagaggaactgctgggggttattctggaccacatcagcgccgacacagcccaggagtaagaaagagagcgccggcccggaggccggaaggggaggaaatggacatgaaacgagtggggggactgttcctctacgccattctggccggcttttgcatcggcctggggggcaccgtctttttgaaactgaaggatgcctttcccgggggcaacgtggtgggggcgctgctgttcaccatcggcctgtttaccgtctgcacccggggatatgccctgtttacgggaaaggcgtgctacctatttgacaatccgctgcctgcctatctgctggatctgctggtcttttgggtgggaaacctcctgggggccatgctgattgccggtctggagcatctgaccggtatggtggggggagagaccggcatcgacgccaccgccgccgccctggtggagggaaagatgggggccacctatctgggcctgtttgtgctgggcatcttgtgcaacatctgcattttcatcgctgtcaacggctatgccaacaacccccaccaggtgggaaagtacttagccctctttctgggcgtgtccgtttttatcctctgcggcaccgagcacagcgtggccgacatgtattattggtcggtctccggggtgctttatgcgcagccgggggagtcggttctccgccttttgataatctccctgggcaatgtggtggggggtgtgtttttcccgctgatggagaagggaaaaagacgcctggacctgcctgaagcgccataaaccacccaagccggggccctttggacccggcttttttcttgtagaacggcagtgggagaaaaccgcagcctttttgccctcaggtctccggtggcgccggaagagaaaggagagagacccatggtgggaaaagaagacatctaccgcatgctgcgggaggaagaaatctggcatgaaatcacagagcacccggcggtgtataacatggaggagatggcccaaatcaaactgccctatcccgaggcggacgcgaagaacctgttcgtccgggacagcaagaggcgggactactatctcattaccgtccggggagacaagcgggtggacttgaagcagttccggcagcagaatcagactcgctccctaagttttgcctcggcggaggagctgggagaactgttgggtctgatcccgggggcggtcaccccgctgggcctgctcaacgacggggacagacgggtttccttctacctggacgcatccttttgccggccggaggcacagaaaatcggcgttcaccccaatgacaatacggccaccctctggctgcaggtggaggatttgctccgcctgattcgggcgcatggcaatcccgtgcatgtggtcccaatttgacgggaggcaaaacaccggaaagagagaggagtgtcccctgtgccgtattttgttcagggccttaccatgggcctggcctatgtggcccccattggggtccaaaatctgtttgtgatccattctgccctggcccatccccggcgccgggccttggccacggcggggatcgtcatttttttcgatgtgaccctggcgctggcctgcttttttggagtaggggtggtgatggagacctttcccgtggtccgaatggccgttctgctggcaggcagcctggttgtcctggccattggcgtgggtctgctccggaccaaggaggcgggggcggaggggaggcccctccctgccacagggtccaaaacggtgtccaccgcctttgtggtcacctggtgcaatccccaggcgctcattgacggcaccatgatgctgggggcctttcgggcgaccctgcctaccgcccaggcgtcctcctttatctccggggtggccctggcctcctgcctgtggtttttgggggtgacgctggtggtctccctgctcagccgccattttaccccgggggtgatggtgtggatcaaccgggtctgcggggtggtgattctctgctacgggggaagcctgctctggtcctttctgaccatgctgggataaaggagaatgtctatgaaaaccattgcaatcattgaggacgaccagcccattggggacctgttggaggaggcgctgggccaggcgggctatgctaccttgcgggcctattccggcaccgaggctcaatacctcttggagcgggcgaagcccgacctgattctgttggatctgatgctccccggcttgaccggggaggaactgctgccctgtctgggggaaatcccggtcattgtggtcagcgccaaggtgggggtggacgacaaggtgaacgccctgctgaccggggcgtgagcaagccctttgccatgcgggagcttctggcccgcattgccgtccagcttcgggggccccggggcgaggaggtaccttgtctcgcctttgaggacttgatgctggaccccgccacccgccaggtcactgtggggggcgtgccggtgcatctcaccaggacggaatatgcgctctgccatctgctgctccagaaccccgggcgggtgttgtccaagtcggcaattctggagcgaatcagccgggacacgccggactgcacggagggttccctgaagcagcacatgagcaacctccgcaaaaagctgcgggcagcggggggacgggagtacattgaggcggtatgggggattggatttcagtggaagaaggaatcttgaccaaatcttgaccaaattcttacccatttccttgacggctacatggtaggctgtagccagacaaaggaaaggagaaatcgacatggaatactgtctgaccaccgaggccttatgtaaaacctaccgacagggcaaggctctgcacaatgtgacgatgcatgtccccaagggggcaatctatggctttgtgggaaaaaacggggccgggaagaccacactgatccgcctcatctgcggccttcaagcccccacggcggggggctacaccctctatggcgtccggaatacagacccgtctattcaccgggtccgccgccggatgggggctgtggtggaatccccggcgatctatctggacctgaccgcagaggacaatctccgccttcaggcccgtctgctggggctgccctcggaggaggggattgccccgctgctggaactggtgggcctgggggagacggggcgaaagaaggcccgaaacttttccctgggcatgcgtcagcggctggggattgccgtggccctctgtggagagccggatttcctggtgctggatgagcctgtcaacggcctggacccccagggcatcattgagatgcgggagcttattttgaagctcaatcgggagtaccagatcacggtgctcctctccagccacatcttggacgagttggcccgcctggccacccactacggttttttagaccagggaactttggtccgggaggtcagcgcccaggaattggaggctgcctgccgcaggtgtgtccgactgacagtcaccgatgccaagaccctttgccgggtgctggatggccgggggctggagtaccgtctggccggagagggggaggccgacgtctatgaggcccacgacctttcccagctgattctggacctgcaccaggcgggctgccaggtgaccgggctccaccagcgggacgagactttggagagctactatatgaatctggtgggaggtggcagggatgtctaacctcttttctcccggctccttgcggccgcgcagggaccggcgcttttggggcggcccggcgggaagcacaggggggaccgtgtcatgagaaatttatgttccgcccattggtttcatctgcttcggcataaggcattttgggtctcggtcctcttcatggcgctctatggagggatggaggcggtggggttgtaccgccagggcgcggagaaactctccgacggcctgtttgccggactgacctttctgggggtggttctggcggccttttgcagcctctatctgggcacagagtaccaggatggcacactgaggaataaggtgaccgccggataccggcgggaacagatctatttctcctgtctgcttgcctgcttagggggcggactgctgatctgggggtcctacctcgcggcctatctggccgtgggacttcctctgctgggcgggaagatgggggattgggcgctggtagggggaagctgtctggggacgctgcttctgcttatggtgtatgtctgcctgtatacctgtctggtgagctggctccaggccaaggccacggctgccgccgccgctattttgctggcctttgccatgctgtttggcgggctgtatctctacaaccgtctggacgagcctccatcttatcctgattcctatcgacaggagaatgggcagatgctccagcagccaggcggggtgaaccccaactatctgcaggggaaacagcgggtggtctatgagattttgtatgacctgctccccgatggacaggggatgcagattctcagcggagaggtggcctccccccaggcactggggagaaatgccggggcctccctgcttttgatgggtctgaccacggccctcggcctgggagaattccggcggaaggatttgcgatagaggagggaggcgtatggtaccttggctgctgtgtgccctgctggggggatgggggctgtatctgctgggcaggctgtactgcctgcaccgggccatggaggcgcttgccggccaactgaccgactggctggaccgggacaccaacaccctgctcaccctatccctgtcccgggacccctatgtccggcggctgacgtctcagctcaacgggcaactgcggcgtctgcgccggcagcggcgccggtaccagaatggagaccgggagctcaaggaggcggtgaccaacctctctcacgatctccggacccctcttactgccatctgcggctatttggagctgctggaacagacggagcagtcctccgttgccgcccggtatttggcccagattcagaatcaggtggaaaggatgaagcagctgacggaggagctcttccgatactctctcctctccaccgcccagcctctggagcgagcggatgtgatgctcaaccaagtcctggaggagagtcttttggcccaccatggggccctaacccagcggaacattgttccggacctggacctgaccactgtaccagtgcgccgtcagttggaccagggagcgctcagccgggtgtttgccaatatcctcagcaatgtcctcaagtacagtgagggggacttggcggtgcggctgacttctgagggagagatcactttttccaatgccgcttccggtctcacccccgtgatggcaggccgcctgtttgaccggttctatacggtggagtccggccgccatgccacaggactggggctgaccattgccaaacacctcaccgaggccatggggggacgcatccgggcggactgccggggagggcggctgaccattgccctgtcctttccggcggaaccttcgaaaagggagggcgcctcttgttccacaccctatttctgtgatacaatgtaaaaaacacccttgaggaggcgtgtgccatgtatcagctttccaatttcatcgacaacgacgacatccgtaccctggcccagctgggaccctttcaagttattgaataccagcgggacctcagtgtcagcccggacagcgcccagaccgcttattttagcagcgttatgcatgtgcgccggcggcaggtcctctgtgatctgaaacaagccaatatcacccttcaggccggcgccatgcagtggagcgtgggcaacgtcaacgccaccacaggggtcaagggggtaggagacctgtttgggaaagccctccggggcaaggtcacaggggagtccgccattaagccggagtacacgggagacggcctgctggtgctggagcctacctacaagcacattcttctcctggacctggccgactggaatggctcgattgtcctggatgacggcctttttctggcctgtgacgcccggctgaagcacaaggcggtgatgcggtccaacctctcttctgcggtggcgggcaatgagggcctgttcaatctgggcatcactggcaacggtgtgctctgcctggagtcagactgtccccgggaggagctggtggagatcaccctccaggacgatgtcctcaaggtggacggcaacctggcggtggcctggagcggcagcctgagctttaccgtggagcggtccggcaagaccctgatcgggtctgctgcctccggggaggggctggtcaacgtctatcggggcacggggaaggtcctgcttgccccggtgtctcccaccggcaggggttaagtggagagcacagcggcgttcgtgggaacgccgctgtttttttgaggggaaagcagacccgctgaaaaaaataggaaagagggcttgcaccgctggcccggtacggtatagaataaagaggatataaagaaatcggaatgaatcataggagggagtgctctgccaggcagaggagacagatgaaaggaacacatgatttacggcacggggtcctctggaagcagatcctgttgtttgcccttcccatcgccgccaccagtatgctgcagcagctctttaactctgcggacgtggcggtggtgggacagttttctgcccagaaggagctggctctggccgcggtgggcagcaccagctccattgtcaatctctacatcaccatttttaccggcctggctgtgggagccaatgtggtcatcgcccgcctgattggggcggaagaggagggggaagtgcgaaaagcggtccatacctctctggtggtggcggttctttgcggtgcggtgctgatggtggtgggggagtgtctggctggaccattgctgcggtggatggataccccggagaatatcattcatttggcccgccagtatctgcaaatttacctgctgggcgccatattccaaatggtgtataactttgaggcggccatcctgcgggccaacggagacacccggcgccccttgctctgcctgcttctctccggcggagtgaatgtggtgctgaacctggtatttgtcctgctgtttcacatggatgtggcgggggtggccctggccacggtgattgccgacggggtgggggcgggcctgctctggcactatctgcgccgggagaccgggccgatccgggtggagcccgccttgctgcgcctggacaggaagctgctgcggggcatcctgtatattggcatcccggcggccattcaggggatgatgttcaacattgccaatgtgatcatccagtcggggatcaaccggctgggctcggatgtggtggcggcctccaccattggcgtaactgcggagatctttgtctactatctgctcaacagctttggccaggccagcatgaccttcaacggccagaattacggggcggggaatctgcgccggtgccggagtgccacccgctggtgcctgctgctggggggaatcctgtcggaggcctttgcgctgctgctggtggtttttggtctgccctttgccgggatctacacttcggacgcgggcatcgccctgctggcgctgacgcggatgcgctgggtgctgcctttccagttgttcaatatggtcattgaggtgatgtcggggaccctgcgggggctggggtactccttcgttcccaccatcctctgcgcggtgttcgtctgtgggctgcgtattttgtgggtggcctttgtcttccccttgatgcccaccttccagggtctgctgctggtctaccctgccagctggctggcggcaggggcagcggtaactgtggcctactgggcgctgaagcgaaagctgctgacggaaaaaccgccccaggctccggtggtgccttgacaaaaaaagaccaggaacccacaaaggggtgtcctggcccattaggattcctctttcaagaattcccgccgcagggtttcgacgatgctgcgtaccgtttcctgctgactttccgagagatcatcaatgtagagggcggcacggtgctccatgcccaagatatagtcaacggaggtccggtagagcagcgccagattctccaaaacgtcaatgcggggcgtggcgatgtttcgctcatacgcactgatcgcggcgcggtccacccccagccggtcggcgactgctttttgcgataatccgcgcttttttctcagggcctttagccgccagccacgatcgtagatttccattttgggacctcctgcgcttgggttttatcgttgcaaattattgtacggcacagagaggaaactatatgtagcaaatatatgtataaaaagaaaattatattttctgtccgaaggaaggaaacgtgaggatttatggtaaaaatacttttcgtctgccacggcaacatttgccgctctcccatggcggcctgcttgttttcccagatggcaaaggcgcgggggctggactgtgtggtgtcctcggcggccaccagccgggaggagattggaaaccccatgtatccccccgccaggcgcaagctaaaggaaatgggggtgccctttggccatcatcgggcggtgcagatgaccagggaggactatggagcctatgattttctgctggccatggactctgccaacgtgaagaatatgaaggccatcgcggggggagacccggaggggaagatccgccgtctgctggacggtacgccccaccccagggacattgccgatccctggtatacaggaaattttgacgccacctatgcggacttggcagagggctgtcaggcgctgctggaccggctggagaagatgtcatatctgaaaaatccgtctgagtaagtgcgtttccagcggcgagaatggagggcgcaggaggagaacagacgtatgatttccagccaatgtgacacactatcccggtagggcgcaacctgcgccgggaaggagtcttgtcccatgaaggtgacagtaaccgacggctgcatcagctgcggcctgtgtgtggagagtttcccagacctgttccattggaatgaggagggaactgcggaggctgtgggccaggtgccagctggacaggaggatcaggcccgccaggcggtggaggactgtcctgtcagtgtcattgccgcggcggaatgaaaaaaacaccccgcttcgccagagaatctggacgaagcggggtgtttctttggggtcagtcctggaacatgggggtagagaggtagcggtcgccggtatccgggaggaggaccacgatggttttgccctggttctccggccgcttggccagctggatggcggcccagagcgccgccccggaggagatgcctgccaggacaccctcccgccgtcccagtgcccggccggcagcgtaggcgtcggcttcggtgacgggaatgatctcgtcatagatttccgtgttgagcacgctcggcacgaaattggcgccgatgccctgcaggccgtggggacctgccatgcccttgctcagcaggggagaggcggcgggttccaccgccaccaccttcaggtggggattttgggccttgaggtattcccctgtgccggtgatggtgccgccggtgcccaccccggcgacgaaaacgtccacctgtccgtcggtatccgcccagatttccgggccggtggtggtccggtgagcgtcggcgttggcggggttgtcaaactgcctggggaggaaggcgttgggaatctcccgggccagttcctccgcttttgcaatggagcctgccatcccttgggcgcccggggtgagcaccagctcagcgccgtaggcggacatgagcaggcggcgctccatgctcatggtgtcgggcatgacgatgatggtgcggtagccccgggtggcggcgactacggccaggccaatgcccgtgttgccggaggtgggttcgatgatgaccgcgccgggcttgagcagcccctttgcctccgcgtcgtcgagcatggccttggccacccggtccttggcggagccggcggggttgagatactccagcttggccagaagggtggcgttcaggccctctgcccgctggatctggcggagctccagcaggggggttcccccgatgagctgctccacagaggtgtagatagttcccatagtagacctcctgattgcaaaggtttgcacttgcatggaatacaatagatgatatcatcataggccacaggggatggtttgtcaaggcggcgtcaggttgtccttgacagactggggcaggggacttacaatgaaggaaaacaggttgggtccgatgggacggaacataccggcggaggtgggaggcatgtctgtggagtatcaggtgcaaatggtttaccggcaggaggatgtggccgcgctggttaaagtgctggagttccgccgccgaccggaaaaaaatctgcgtttggcgcgcaagatcggctaccctatttttgggttgctgcttctgggggtgggggccagcatcattgcgggcattgtcaccacaggggcctttgcccccattaccattgtcaccttggtgctctctgcgctctgcattctggggggcattgcccttctgcgccggtcggacagcaggggaatggcccgacggtcctgggcccggtaccccaacaaggggatgaccttgacctataccttttacaaggaccattttgaggagaccgatgcggcctccggacagcacaccttcccatacatcagtatcaaaagcgccaatgaggatgcggggcattttttcctctttaccgtgaccaacgcggcgcacatgctgtgcaaggagagctttgtgcagggggaccccgccacctttgccgcctttctgcgcaagaaagcggcggtgaccatggacccggtggagtgaaggacgcctggtccggcggaaagaggaggagaataggatgagtattttcaacaatgagagcatcttagcttggctcaaatatttttccgaccactcggaaattgatttgtccacggtacgcattttggacatcaccggggagaaccggaacctgctgcccacggtgcaggccaaccgctctgtgctggtgttcaccgacgggaaccacccggagattttttacagcatgtgggacgagggcatgggggactgtgagatttggtacaacgagggctccgagccccagggccctatgaagcacaatctcctctcagagatgattgaccggggggtgaacgtctccgcggccatgctgatcaacaacccccgggcccactcaggctaccggatcggcctggacaacgacagcttttctcccggcaccatccggtacgtggcgccggagattcgggcggtcattctgaaaaagctctgcctggatgagaaggagaccatttgctgtgtctccggggagagcatcgccgtggaagcggccatcgccgtccgccggggccatgtggtagcggtggagtataagccgggagaccgccagaccatggaggagaatgtggtccgctttggtctgaacaacgtgctgatcgtggacgacatggagagctactcccaccggtggccggtgcccgacgtggcgttcctggtggcctcccccaagctggagctggagctgcagacgctggtgcgggtcaacccgaagattcgggtggtgatctataccttggagttcagtttcatgagccggattcccgggatgctctgggaaaacggcatccagcccacggaggtgatgcagctggaggtctccaaggtgggccggaaggacgagatcgaggtgcagccggcgccctggattttctctggccaggcggggcaggaataacgcacaagaaaagggcccttttttcgggaaaagaggggaatttgtgccttgacaaggccccggccagtgcgtataatatcctcaattaaacaaagccaatcacaatggcgatgatggagacagtaggatctgcggaaccctgcagcgattcggggatggtgagagcccgaaggaagtagcgcggaagtctgaatatccctcctgagctgcaggccgaacaccaaagcgcggaaagtaggccctgccggtgtcccccgttacagggagcgcgtatgttggtacgcaggtaacaggtggtacagcgaagtgttttcttggccttcgtccttttacagggacgaaggcttttttctttgcccgccctccccacggggcgggggacttccgggcacaggcggtgcccatattccaaggaggtaagttccatgaaagagaacggtttggtagaattccggtggcatggccgggggggacagggggccaaaacggcctgtctcctcctggcggacgccgccttcagctcgggcaagtttgtccaggggttcccggagtacggccctgagcggatgggggctcccattaccgcgtataaccgcatcagcgacacccggtgcagcatccactgcaacatcgactgcccagactatgtggtggtggtggacgagaccctgctggacacggtggatgtcaccaagggcctgtccccgacgggggcggtgatcgtcaacacagccaagtcccccggggagattcggggcaagctccggcattggacggggccggtgtgcaccatagacgcccgccggatctccgaggagaccttgggccggaacttccccaacacccccatgctcagcgcggcggtgcgggtgagcggtgtgctggaggaagagaggtttaagcaggacatggaggagagcttccatcacaaatttgccgccaagccccaggtggtggccggaaacatggcggccctaatgcaggcgtgggaggaggtgcaggtcggatgatccgtcccgcaagagagattgacgagcataccccttggcaggagatgaccctggggggagaggtctatgaaccggccaccgcccggtatgtgaacaccggcgcctggcgcacggacaccccggtgctggaccgggagaaatgtcgcaactgcctgctgtgcgtgccctactgtcccgacagctccctgccggtggcggagggaaagctggccggcattgattacctgcactgcaagggctgcggcatctgcgcccaggtctgcccctttggggccatcacggtaaaggagggtggagaggcatgaattacaacgaacgtctttccggcaacgaggccattgcctttgccatgaagcagattgaccccgacgtgatggcggcctttcccatcaccccctccacggagattccccagtattttgcccagtacgtggccaacggggaggtcaacacggagtttgtcccggtggagtccgagcacagctccatgtccgcctgcatcggcgccgaagccgccggggcccgggcggtgactgccacctcctcagcgggcctggccctgatgtatgagatgatgtatgtggcggcctccagccggcttcccatcaccctggcctgcgtgaaccgggccctcaccggccccatcaacatcaacaacgaccactcggactccatgggcatccgggacgcggggtggattcagatttacgcggagaacaaccaggaggcctatgacaatttcctccaggccatgcccatcggagagcacccctccgtccgtctgccggtgatgatctgtcaggatggctttatcaccagccacgccttggagaatattgtgctgctggataccgactccgtcaaggcctttgtgggggagtaccgcccggagcatttcctgctcaaggcggagaatcccctggccatcggtccctatgacctgggctgccactatatggagcataaggtccagcaggccgaggccatgaagggggccaagaagcggattttggaggtggccgcccagttcgcggccctgaccggacgagaatacggcctgttcgaggcctaccgcatggaggatgccgagatcgccctggtgctcatcggctcctctgcgggcaccgccaaggtgacggtggacgcgctgcgggcgcgggggattccggcgggcctggtaaagattcgggtcttccgccccttcccggcggaggaactggcccagaccctgaagaacgtgaaggccctggccattctggacaaggcggagagcttctctgcccagggcggccccctgtttgcggaggtccgggcggccctctacgatctggagccccgtccccgtaccgtgggatatgtctacggcctggggggccgggatatcaccccggcgcattttgcgtcggtctttgcccggctggaggccattgcggccgggggcgaactgggtccggtctattcacatctgggacaaagggggtaaacggccatggaaaacacagagagaacctatcatttcaaaaagaccctggagaaaaaagaacgctttgtggggggacaccgcctctgcgccggctgcggggcgggcattgcggtccggggcgttctgcgggccctgcgggaggaggaccgggcggtggtgggcaacgccaccggctgcctggaggtcagctccttcctctatccctacaccgcctatgaggacagctacatccatacggcctttgagagcgccggcgcctccctgtccggggtggaggcggcttataacgccctgaagcggaaggggaaggtccagggggaggtcaagttcatcaccttcggcggggatggcggcacctacgacatcggctttcagtccctgtccggagccatggagcggggccacgacctgacctatgtctgctacgacaacgaggcctatatgaacaccggcattcagcgctcctcctccaccccccggtttgccaaggccaccacctctccggtggggtcggccatccccgggaagctgcagaacaagaagaatctcaccgagatcatcgccgcccaccatgtgccctacgtggcccagaccaccttccttggcaatttccgggacctttataccaaggcccagaaagcgatctatacccccggccccagttttctgaacatcatggccccctgtccccgtggctgggaatatccggcggaaaaactcccggagatctgtaagctggcggtggagacctgcgtctggccgctgttcgaggtcattgacggggtgtggcacctgagctaccagcccaagcagaagcggccggtggaggagtatctccggcttcagggccgcttccgtcacatgttcaaaccgggcaacgagtggatgatcgaagaggcccagcgaaacgtggacgagaactgggaaaagctcctggccaaatgtcaggggtaagatgtaagatgatccggctgaaaaatccttgagggcaagagatgcccccaaaaggtgagacaacgatggaacgacaaattgtttaagcagccgaaagggcttaccgtctgaaaaaagcaggcggcaagccctttcttaaaaagatagccgggtgctactcggtgtgggcgccggagccggcggcttcctgctctctgcgttccacttctgccagatggtttcgcaagatcacttcaatgtaattggtcatagatcgccggtctttgcttgccaaccggccgatttgatcgaagacttcgtcgggaagacgaagggtaaacacacgtctgattgtagccatggtaacctccatgtgacagggtttcctcttttttcggctgttccactgaggaactatgccagatcatttcagacaacaggctgctgcagatgctcagggaggagaaatccattcgcatgccggggggcctgtaccatgaactgcaagtgcggatgacctacaactccaaccacatagagggcagtaggctcagtgaggaccagacaagacggatctttgaaacgaacaccatcgatgcgggggaaggaatccctgtggatgatatcatcgaaaccgtcaatcatttccgcgccattgacttttgtattgatgtggcggaagcgccgctcacggaggagatcatcaaagaactgcaccgtattttgaagcaagggacaaaggatgcctccctttcatggtttgccgttggggattacaaaaaacgggcgaatatggtcggcggccatgaaacgacaaaaccgaaggaggtagcacagcacatgaaagagctgctgtcccggtacgaagctgagactgcggttacgatccacgatatcatccgcttccattacgagtttgcgtgcatccacccatttcaagatggcaacggcagggtcggcaggctgattgtgttaaaggagtgtctgcgctttggattgattccctttatcatcgaggacgccaagaaagggtattattaccggggactctctgaatgggaaggagaacagggatatctgacagacacctgcctggacgggcaggatacctttcggaaactgatggctctgttcgatattccgccggaaagcgatctttagagcttcctttgctggtcaaagccttctcctgcactgaaagcattctcggtggggcaaatggaaccatgacgggatacctccaatacagtttcacttagtatagagggaagcatcttattttttaaggggataaaatccccagatggaactggttgcgttgaacaaacaccccttataaggagaaaggattttctccttataaggggtgtttttgtgaatacatgtatgtttctgcggcggttaaaaggtcagcaccaacccggtggagaggggctgcacccggctgcccaagacctgggtcaggatgtccagggcctctggcccggtgcagtgtccggtgattacttgggttaccccggtctcccccagccggtgggcgaaggcccggacctcctgggcgggggtgtcgtacaggtggaagccccccacaatggcggagatgggctggccagggaaggtgtccgccacttcccggacgatgttgtccgcgcccccgtggcagcagctgttgaagatcaccaggcccttgggggtggaaaagaccagactctgctcgtgggaaaagtcatcgggaagccactggtcccccacctttcggtacatgttggcggccaggccccgctgcgccaggcccggcgtcttgtggggcaggagggtgacgccggggaggggagagaagtccccggtgacatagcggatacggggggcaaatgtggtcagaaggccccgctgaaggccttcgtaccgccagccctcgggggttttgtcatagcaggtctccccgcagccctggcggaggtagaagggggcggtggggttgcgggcaaaaaaggtacccatcccgttcccgtggtcccagtgggcgtgggagagcacgccgaaggagaccgtggacaggtcgatccccagggtatcggcgtttcgggcaaaccggtcactggccccggtgtccagcaggatggcgtgaccttggtattccacatagatggacagcccccactcggcctccagcccccgggcggcaaggttgtccacaagaatggtgacgcgcatagcgattcctctccttctctcattgtgttcctcttattataaggaaggaaaccgtttttggcaaggcgggcgtttttgaacgcatagggttcggacaggcgtgcatagaatggagacaacaacaggaggtgacagacggcatggaaggatgggacaaggtggtgccgcagtttctccgggagatgctgtccagcctggaccccaaggcccgggacgcggtggaggagctccggctgcgagagggatttcccctggcggtggtccaggcgggggaggagtggacccaccccgcctggcgggggcgcccgctgacggaggaggcgttgcgccgggtgctggagaccgcggggcggggatcggtccatacagtgctggaccagctgcgcagcggctatgtcaccgccgccggcggggtgcgggtgggaatctgcggcgagggggccacccgggagggagagctgctctcctttcgtcggattacctctctggcccttcgggtgccccacgctctgccgggggtggcgcgccctttgctgccccagctggcggaggggggagaactctccaataccctgatcctctccccaccggggctgggaaagaccacgctgctgcgggacctcatccgctgtgtctccctgggggaaggggtgcgtccccggcgggtcggggtggccgacgagcggggggagctgggcgcgggcgccctccgccgccatctgggcccccggaccgacgtgctggagaactgccccaaggccgcagccctgctgatgctcctgcgggggatggcgccccaggtgctggcggtggacgagatcaccgccccggaggacctgcgggccatacaggaggccgccggctgcggcgtgacccttttggccaccgcccacgggggaagctgggaggagctgcggctgcggcccctctaccgggaactgctggaccaggggatttttcggacctttgtggtgctctccctggcccagggcaagcgagtctatactgtgcggaaggagggcatgccatgaccgcgctgttgggaaagacccttctctttgccggctgtacagcctttggcctgctccggggcagccggctgcgccagcggaccgcctgtctgggggagtttcgccggacgctggcggggctggcccgggagctggccttttccctgcgccctgtgtcggatttgatggccagcgcggaggcggggacccaggggccaacggcggccttttttcggacctgccgccggcggtttgccgagggcggccaggagagctgggcggagagctggacagcggctctggaacaggtggcgctgcctctggaggaggcggaccttcgcctgctccaggaggccggggatgtgctgggccgctacgatggggagagccagcggcaggccctggaaggccttctccgggggctggagggacaggcggcggaggcggcggagacggcccgccggctctgccgggtctatctggcgctgggccttgcagcggggctgttttgcctgatcctcctataaaacttcctggcatagacaagctgggctgcgcatagattggaaccaacggaacagccaacagaggaaacagggacgagtccctcgtcccggggaaaggaagtcgggaatggacgtagatctggtgtttaaaatcgccgcggtgggcatcttggtctcggtgctgaaccaagtgctcacccggtccggccgggaggaacaggccaccatgaccacgctggcgggactgattgtggtgctgatgatggttgtccagaaaatcagcgacctcttcgagctggtcaagaccctgtttggactgtgatgcgctatggatatgattgcactgggcgcggcaggggtggtggcggccctctgcgcggtggtggtgcgccaaaagaccccggagatcgcggtggttttggtggcggcggcctgcgtgcttctgctgtggaataccctgcctctgctggagaccattcgggatgtgatggaggagctggccgatttggccgacatctcacccaccgttctgcggcccatgctccagaccgtgggactggccctggtgaccaagctggccgcctccctctgccgggacgcgggcgaagggggcgtggcatcctttgtggaggtggccggcgcggcggcagcggtgctggtctccctgcccctgctgaagatggtgctgcagttggtcatgggactgctgtgaggcgctgggtgctcctggtggtcctggctgcggtcctcctgatgcccacggcgcttgccctggaccaggaggaaatcctgcaggaccagagccagtccctgggcattgaggacctggaggaggcgggagaggcctacaccggccagcatgacattgaggatggcctggacgtgggcgcctccttccgccacatggccgagaccggcaaggaggccctggggggcgtggtgaagcggtcggttcgcagctgtgtgctcctgctggcggttaccctgctctgtgggctcacggaaggggtcaaggcggggacgggaggcagcggcctgggggtgaccacactggcggccaccctgtccatcaccgccatcgcggtgggggatgtcaactccctgctgtccatgggggaggaggccattttcaatatggagaccttgggggacgtgctcctgcccacggtgtccatggccaccgccgccagcggaaccccagccatggcggtggtgaagcacggggccaccatcctcttttcggacttcctgatccgcctgatcgacaccctgctcatcccgctgtgctacgcctttgtggcggccaacgtggcctgggcggccctgggcaacgatgggctcaagcggatcggcggcctgctgaagtggctgattaccattctcctgtccgtggttctgctggcctttgtggggtacctgaacctgtcgggcgtgatctccggcggggcggacgcggccacggtgaaggcggccaagttcaccatctccaacatggtgccggtggtgggcggcgtcatctcagacacggcggagaccctgctggccggcgcctccgtgctgcggaacgccgcgggggtgtttggcatgctggcggtcatcggcatctgtgtggttccctttttgaacctgggggtgcactacttaatgtataaatgtaccgcggccctggcggccacggtctccgccgacggacggatcaccggcctcattgaggccctgggcacggctttcggtctgatcctggccatgacagcctcctgcgcggtgctgctggtggtggccatggtctccacggtgtcggcggtggtgggataggaggcagcgatggagatcatacgaacctggctgctcagcgtcaccgtctcggccatggtcattgcggcggcggaggccctgatgccggcgggggcggtgaagcgggtgggcaagctcaccggcggcctgattctggtgctgggcatcctgcagcccctggtaaccatggattatgaggacctttatgacatggtgtcctccctcccggccggcgccatcagccaggagaccttggaagaaaaaacctatgaacccatgaaaggaatcatagaggaggaattgagtgcatacattgtggacaaaggggagcagctgggggcgtcctgctcggcccaggtggtttgtgccccgggggagggagagcttcccgttcccatccgggccaccgtcacaggccagctgacccaggggcaaaagcaggacctgtcccactacatggaggaggaactggacattcctcgtgaggcacaaatctatcggaatgaggaactaccatgaacgggagagaagccatgggccgcctggcccaacgagtgaaggcgtcgatgggaagataccggctggtttggctggtgattctggcagggctcatcctgctgctccttcccaccggggaaaaggagggagaggcacgggaggaaaccgagcagacgcagtcggccttcgacctggccgcgaccgaggcccgcctgtcccaggccctgtccaagatccacggggcgggggaggttacggtggtgctcaccgtggccaatggaccccggcagatcctggcggagaatgtggaccgggacgggtcccagggggaggagaagacggagaccgtggtcctctcccggggcagcggcagccaggagaccgtcaccgtccaggaaatttacccccggtatcagggcgctttgctggtctgcgccgggggagatgaccccactgtgcgcctgcagcttaccgaggccatgtcggccctgacgggcctgggcgccgataaaatttcgatcagtcaaggaaagtgaggaaaaacctatgaaactctggaaacgcaatgccatcgccgcggccatcgtcctgtttgtctgtggggcggtctatttgaactggagctattctcaggacaccgccgccgggaaaaacctgggggaggcggccctggtgggcagtcagaatgatcctctgctggagaagcagaaggagggggcggccgcagaggaaggcgccgccggggaagagggggccaagaccgaggagggcgccgcggcccaggagggcgcggacgccgagtctggtacttacttctccacagcccgcctcaaccggcagcaggcccgggacaacgccctctccctgctccaggaggccgcagaggatgagaaggccgaccagagctcggtggatcaggccaacgcggccatccagaccatggcggactataccatgaccgaggcgcagattgagaacctcatcaccgccaagggctataccgactgcgtggccttcctgggggaggacagcatcagtgtggtggtctccgccatggagaacggcatgaccgacgccgacgcggcccggattggagagatcgtcatggaacagacgggtctgaaagccgatcaaattaaaatcatcgaagcggaataatccagcataagcccctcccttacagccgaatcccctgtaagggaggggcttgttcccgttctgcccccctgttataatggagaaaacgatggatgcccagggaaagacacccccgaaacccatctgacaggaggaacccaccatgcccaacccgatgaaaaccctgctccccttggccgccggcctggtgctggggacgtggttcgccaagcggccggtcccgccccaagcccgtaccctctgcccgcccgccggccaggccggcatccgccggcagatggagcagctcaaacgggagtatgagaagcaggatcggatgcgccgggactttaccgccaacgtctcccatgagctcaagacccccctgacttccatctccggctatgcggagatcatccgggaggggatggtgaaaagcgaggacgtggggcgcttcgccggcaagatttacgaggaggcccagcgcctgatcacgttggtggaggatatcctgaacctctcccatctggacgagggcgcgcccgggcaggagcgccgccaggggattgacctctacgccctgtgtgaaagggctgtggccagcctggctgaggcggcccggcagcgggggattgccatctccctgaccgggagccgccagcgggtggacggcgcggaaaagctcctggcggagattatttttaacctctgtgacaacgccatcaaatacaaccaggagaatggccatgtggccgtctcggtgacccgggagggggaccgggtggtgctgacggtccaggacacgggcattggcatcccgcctggagagacggaccgggtctttgagcggttctaccgggtggataagagccactccaaggagatcggcggcacgggcctgggcctgtccattgtcaagcacgctgccgcctatcacgacgccaaaattcagttggatagccagctgggccgggggacacgggtgcgcgtgctctttcccttgagccagagggaggcgcagccatgatggggaccattgcccccccggcggcccgggccctggcacggctccatgaggctgggtttgaggcctggctggtggggggatgtgtccgggatatgctgctgggctgtgcccctaaggactatgatctggccacctccgcccggccggaggagaccaaggcggtgtttcagggggagacggtcctggaaaccggcatccggcacggcacggtgacggtgctgctggagggcatgcccctggaaatcaccacctatcgggtggacggagcctactccgatgcccggcacccggacggggtaacatttgctgacaatctccgggctgacgcggcccgccgggatttcaccatcaatgccatggcttatgccccggggcgggggctgcgggactattttggggggcaggccgatctgcgggcgggatgcctgcgggcggtgggggaccccggaacccggtttcaggaggatgccctgcggattctccggggacttcgcttcgctgcggtgctggatttttccctggaagaggagaccgaccgggcggcccggcggtacgcccccctgctgaccaaggtgtccgccgagcggtgtgctgcggagttgggaaagctcctctgcggcccggcggccggccggattttacgggcctaccccgccgtgctgggggtggtgatcccggagctgctgcccatggtgggctttgcccaccggaatgcccaccactgctatgacgtgtggacccacacggcggtggcagtggaccatgtgcccccccggctccctctgcgcctggcgatgctgctgcacgacatgggaaagccagataccttttctctgggagaggatgggcagggacatttctacgggcacccccggcggagcgtggagctggcggaaggaatcctcacccggctgcggtttccccggcggacccgggagcaagtgctgtgcctggtgcgctaccatgacgcggtcatcgaggagagcccccagcgggtgcgccgctggctcaacaaattggggccggagcgcttttttgatctgctggagatccagcggggggatgcctccgcccaggccccggcatattgcacaaggttggaccacctccggcgcctggaaaagattgccggggaggtcctggctgaggcgccctgtctgaccgtcagggagctggcggtggggggaagggagctgttagcgttgggttaccaaggcccggcgattggaatggctctccgccggctgctggattgtgtgctggagggaacccttcccaatgagaaaaccgcccttctgcaatatttagaacaaattgatgcaaaaaaatcagaaggaaaaagaaacaaatcctcgggcgaaacctaaaaaagaaagtgaaaaatgttcctacctgataattttgctaaaaaactaaattttctctttattttttctatacagtgtgatataatgaagccactcaaaaggtctgtggcttcgtcaaaaagacgaaaaaacagatggggagtacggctcaacctgaacccaaaaggagggatgcggtgacccgggagggtgcgtgagaggcaagaaagaaggaaaaaaatagagtgaattttcctcaaatgcaggaagacattcgaagaaagcacactcgaaacaaaagaagaagttcggcctggcgcatgaatgagccacccgccagaccggagaccgcgtgcgaatgatagttgagatgatccaattagagttcaacaagaaacgaggtaaaatgtatgagtaatcagggagagaaaaaaggcgtaagcgctattgactttttctgcattggctttggcgcaatcgtgggagtcggctgggccgtctccatcaacaactggatgagcggcagtggcggccccattcctgccggtctcggttacatcgcagcactgatcatgatggttcccatcgcgctgtgctactgcgaactggttcccgccctgcccgtcgccggcggcggcatggcattcgcattccgtgcgtttaatgacaaggtcgccgtgatttccggctgggcggcctttggcgggttcgtatccatcattccttgggaagccattcagatcaccgacgttctggggtatctgatccctgggctgaccgacggtgaacccctctactatgtggcgggcaccggcatccatctgaccaccatcatcattggcgtgatttgttctttcctgctgttcgccctgaacatgcgtggcctggctgcggcggcaggtgtgcagaagatcctgtgcttcatcctgatgggttccgctgtcgtcggcgctgtggcctctctgctccacggcagccccgagcactggcagcccctctatgacaccagcaaccccatgatctatggtgaccccagtcagggttatgttgaggcaaccaatagcagcatgtttggcggtatcctcgccatcatgtcctccgctcccttcttcctggccgggttcgagaccattccccagggcgttgaggaagctggcggcgacatcaagtccgttggtaagaccgtggtgctctccgttaccctggcctgcgtgttctatgcgttcctgctgttctccttcggctttgcttgggattggcaggagttcgcacagcccactgcggtcggcggcatcatgaccaaccctgcggcggcaaccatgctgagattgagctacggcggtgctgccggtgagttcttctactggctgatcaccatcggcgccattgccggtctgttcaccacctggaacggcttcttcatgtcctcggccatgctgctcatgggcatgtcccgtggcctgctgatgcccaagatctttgccaagcagaacaagaacggcatccccgttcccggcctgatcgtctgcctgggcctgtccctcatcggccccttcctgggcgctggcttgatcggcgacatcacttccttctcgggcgcagccttcgtgttgtcctggggcctgacctcctactccttggcgttcctgcggaagaaggagcccaacctggagcgtccttacaaggtccccggcggcgccgcaatgggctggtttgccggcatcgtgtccacggttgtcttcatcctgttgttcatccccgccagccccatgtacatgaagagcacggcttgcatcatgttcgtcggctggatgatcatcggcttgatcctttacctggccgccagcggtcagcgcagaggcaagtctcagacagagctgaaggaaggcgtgttccacggcatggaagagagaaagcaggcctaagccggattctcttagtccgttcggttaattctgtgatttgctaatttacgttttcaaaggagtaccccatgaatgaagcagcggcggccagcaaggccttagaggatgttgccaacaaccaagtgattatgatggagttggttctgtatgcgattatcagtatcgtgttgattctcctcatggatctttgggcaggaaaagtgattggaaacaagcaatcaatggagtataaggtgttgaggattccgaagtatatttctctcttcatcatctgtggctttacggtgattgttggaatcatgtgcctgtataaccaggacttttccgtgacccgcagcaccttgacctactttggggtgccgtacttcatcgggttgttctactacctgattaaaatgttgcgcagagtgcgttccgtgcagaagcggcggaagctctgagccattggaaaacgaaacaaagcgccggagtgagatcactccggcgcttttctatggggagaaccggcacccgcgcggaacgcaaaaaaccgaacgcagaggcgttcggttttttgcagtgtatttaggaagagagagaaaagagagaggtaatgttgattgacttctgtttacatgcttaggatagcatacggggggagagaagaagtggataatttactaactttaagtgaacaaattatgaacataaggatcaaaagagaggcgtcactccaccgccacgaaatcggcggcgacatagccgacctgatcgccgaactgaatcaggtaccagccatagtattcgttaatgaccgtcacctgggcgccgtcgtagagttgggcgatgggcggcgtgtcaaagtcaggccggctgtaaacatccagggcgcccagctccgcccggacttccccgggcaggggatagctgtcagggaagaagggaatgccgaaatattctgtgagggagagcacgatgctctccgccatggcgtcgatgtgggtgacgatccattgggcgtcgtccgggttgtcgtggaaccccagctccagcaggaccgccggcgcccggacccggcgaacctcgccgatggtggtggtgggttccgtgcggaccaggttgggaagggggtagatggccttgaggccatcggctaagaactgggcagcccgcattccccgggcacttcccgggaaatagaaggcgatgatcccccggttttggcccgcctggtcttcgccggaggcgttggtgtgcagggccaggtgcaggttgtagttcccggcattggaggcccggatggaggaggccgccgtcatgtcgggggtgttgcgggtgtattgaatccccgaggcaaagagcatgggctccatggcgtctgccaggcggttcatccactcctcctcatttcccaggccgttgacatattcattgtattcttgggtggaaggtgacaaatagataatgggcaaaataatccctccttttttctcatcctatgcgcggcagagatggctggtcacctctgtgctgcgaaagggagcgggggcccggacgtgtgtgccattgcaatcccggcgggcctatgctatgatgaaaaaaatgcccacaggaggtattgccaatggatctgtgcaatcccaaagagattaaggcccttttgggccgccatgggtttcggttttccaagcagatgggccagaatttcctgatccaggagtgggtcccccggcagactgcggaggcctcaggcgcagcccctggggtaggggtgctggagatcggtcccggcattggcccgctgaccgctcagttggcccggcggggcgagaaggtggtgtctgtggagctggaccgcaccctcctgcccattctggcggagaccctgtcagactatgacaacgtggagattgtcccgggggacatcttaaagacggacattgccgccctctgccgggagaggatgcccggcctgccggtggtggcctgtgccaacctgccctacaatatcacaaccccggtgatcacagccttgctccaggcccaatgctttcaggcggtgacggtgatgatccagcgggaggtggcacagcggatctgtgcccagcctggaacgccggaatacggggccttcacccttctctgccagtattacgccgactgcgcgctgctgtatgatgtgcctccctcctgctttcttcccgctcccaaggtgacctccacggtgatccgtatgacaatccgggaaaagcccccggcggtggtggaggacccggacctcttttttcaggtggtccgggcggcatttgcccagaggcggaagacccttgtcaactgtttgtatcctcttttggaaaaaagtgtggaaaagcagaccctgagtggtctgctccatgcctgcaatttgacggagaccattcgtggggagcgccttacttttgcggactttgcccaattaacgggaaaactaaaagaaatcaggggaagttgaaggatgtcacttgcataaaaagttgcaaagagatataatggaaagaagctaagggtggctctaaggagggcattttacatggaattgacaaaaaatcgagccgtgctggattggattgaccagcaggtaaagctgacccagccagaccaggtcatttggatcgacggcagtgagcagcagctggaagcgctgcggaaggaggcttgcgccacgggagagctccacgagcttaaccaggaaaaactccccggctgttatcttcaccggtccgaccccagcgacgtggcccgggtggagagccggaccttcatctgctgtaagaaacaggaggatgccggtcccaccaacaactggatggacccggaggagatgtatgccaagctgcatcgcctgtacgatggttctatgaaaggccgcaccatgtacgtgattccctattgcatgggtgttgtgggctctccctttgccaagtatggcattgagctcacggattccatttacgtggttctgaacatggccattatgacccgggcgggccagaaggctgtgccctacctggatgaacagtttatcaagggcctccacgcccgggccaacctggacccggaggagcggtatattgtgcagttcccggaggacaatgtcattatgtccattaactccggctacggcggcaacgtgctccagggaaagaaatgctttgccctgcggattgcctccaacctgggccggcaggagggctggctggcggagcacatgctgattctggggattcagaatccccagggggaggtccgttatattacaggtgccttcccctctgcctgcggcaagaccaatctggccatgctgatccccccggagggctatcagaaaaacggctggaaatgctggtgcgtgggggatgacatcgcctggattcgtgtgggagaagatggccggctgtgggcggtgaacccggagaagggcttctttggcgtagccccaggcaccaatgccaagtccaaccccaacgccttggccaccacccagaaggggaccattttcaccaacgtggccctgaatttggacgacaacaccgtgtggtgggagaaactggacaagcatcccccagagcatgccctggactggcggggcaatccctggagcccggagaccgcccagggacccgcggcccatcccaactcccgctttaccgccccggcggagaactgcccctgtatctccccggagtttaataacccccatggggtgcccatctccgccatcatcttcggtggccgccgggccaagacggcgcccctggtctatcagtcccggaactggcggcacggggttttcgtgggctccattatggcctcggagaagactgccgccgcagagggtacggtgggagagacccggcgggaccccatggcgatgctgcccttctgtggctaccacatggccgactattggcagcactggctggatatggagcgggacatcgcccatccgccgaagattttcaatgtcaactggttccgcaccgatgagaagggcgagtttatctggcccggcttcggggagaatatgcgggtggtggagtggattctcaaacgctgcttcgatgaggtgggcgcccgggagaccgagatcggctacctgcccaacccggaggacatcaacctggagggcatcgacgtgagccgggagaccttggctggcctgctgtctgtggaccgggacctctggcgcaaagagacagagggaatccacagcttctacgcacagtttggcgacaagctgccccaggcgctgcgggaagagctggcgggcctggaggaccgtctgaaggattgacagaaacaacaaagctgctggccggaggtctggtcagcagcttgtttcatggaatggaggagggaacggcagggggaattctgccctgcgggaacgcattgggattctcctggaggcggcggcgcgaaaacagaggtgaccgggttgcacccctccggattcctatgctataatgggtgccgaatgcagcagaggggaggaaagaatgtgcggattcttggcatcgacccggggtatgccattgtgggatttggcattttagaggcacagcggggacaggcccgcttgcttcggtgcggggccatcaatacccaggcaggggtccccatgccccggcgcctgctccaaatccatgaggatttggagacattgatcaagcggtttgccccggatgtcatggccattgaggagctctttttcaacaccaatgtgaccaccggcattggcgtggcccaggcccgaggcgtcatcctcatgaccgcagcccaactgggggtcaccgtgtatgaatacacaccctcccaggtgaagcaggctgtggtggggtacggcaaggcggaaaaacgccaggtgatggacatgacgagacggctgctccatctggcagctgtgcccaagccggacgacgcggccgacgcagtggccatcgccctgtgccacgcccggtcccacacctcccggctgagccggcagtgacaggaaggagagagttcccgtgttttactatctcaagggcagagcggcccacttggcccccaacttggcggtgatcgactgcggcggcgtgggctatgcctgccggaccaccagttataccctctctggactccagatgggacaagaggtaaccctctatacccatctcaatgtccgggaggacgccatggagctctacggttttggaacggaaaaggagcgcaactgctttcaactgctcattggcgtctccggtgtggggcccaaggccgcgctctccattctctccgccaccaccccggagggattggccaccgccatcattaccggcgacgaaaaggccctgacggtggcccaggggatcgggaagaagattgcccagcgcatccttctggagctgaaggacaagctggccaaaggccagctccccgccggagaggaacgctatgggggcacaggggtgacggtgatcccccagaacaagagctcggaggccacggcggcgctggcggtgctgggatacagcccggcggaaattgccgtggcgctgaagggactggatttggaggggctctccttggaggagattgtccgccaggccctgcggaaaatgatcaagtgaagggaggcagggcggcatgagcatcgacttttcccaagaggaggcccagacgacccctcttatgaccacatcccttctgggggaggacgagggggagggttccctccgtcccaagcgcctgacagagtatattggccaggaaaaggccaaggaaaacctgtccgtattcattgacgcggccaaaatgcgccaggaacccctggatcatgtgctcctccatggccccccgggactgggcaaaaccacgctgtcggggatcatcgccaacgaaatgggggtccatatccgcattacctccggcccggccattgagaagccgggagatttggcggcccttctgaccaatcttaacgagaatgatatcctgtttgtggatgagattcaccggctgaaccggtcggtggaggaaattttgtatccggcaatggaagattttgccattgatattatcatcggcaagggcccttcggccaactccatccggctggatttgccccggttcaccctcatcggcgccaccacccgggcagggcagctctccgcccctctgcgggaccggtttggggtgatgctgcggctggagctctacaccccggaggagctgggccaaattgtcacccgcagcgcggggattttaggggtccccattgaggcagccggcgcggcggaaattgcccggcgggcccgaggcaccccccggattgccaaccgccttctccggcgggtgcgggattttgcccaggtccgggctggcggcgtgatcacccagggggtggcggaccaggcgctgacggcgttggaggtggaccagctgggcctggacgcagtggaccgccgcatgctccgcagcatcattgcccactatgccggcggaccggtggggctggaaacgctggccgccacagtgggggaggaggcggtgactctggaggatgtctatgagccttacctcatgcagatgggctttctcacgcggacaccccggggacggtgtgttacccggttggcctatgagcatctggggcttcccttccatggacaggagcagctgaagctgtgaggcggcggagatgaaggaaaaaatgcaaaagcaaatggggaaaaatacacaaaaatgacggagattttttgtaatttagcattaacttgataatttgcttgacttttccttcttgttacattataataaaagtgaaatttatatgaacgctgaatatggaaaaaacaccagtattacagacgaaactctctgtgcacgggccgcgtcaggggaccgtgccgccgaggaaaccctcgttctccgctactcccgcttggtgcgtgtctgtgcgcggcccttttttctggctgggggagacagcgaggatttgattcaggaaggcatgttggggctgctctcggccattcgggagtttcgctcagaccggggcgcccggttccgcacctttgcggagctgtgtgtccgccgccggatcatctctgtggtgcgggccgccgccggcggaaagcactcaccgttgaacgattatgtttccctcgatccatccctctttttggctcaccaggattttaccttctttggcacggcatatcatcagcaaagaaaccccgaggacgttgtcatccatgaggagaatctcagcacgctggaggaggcgatccgcaagggtttgactgggctggaggcccaggttctggcctgttatctccatggcctgtcctatgccgagatcgcggaagaggtacaacggtccacaaagtcggtggacaacgctgtgcagcggattcgacgcaagattgcacagtatttatcccgcggcgaatacagcgaaagctgatcgcatatttttatccgacccaaagaaacctgggttacaatgtcaaagagagggttaacagcatgtacgaagacaagactttagtatgcaaagagtgcggcaacgagttcgtgttcaccgctggagagcaggaattctatgcagagagaggcttccagaatgagcctcagcgctgcaaggcttgccgggatgcccgcaaggccgctgcccgcggcccccgggaatatttcaccgcggtgtgtgcctcttgcggcggagaggcgagggttccgttcgagcctaagtctgatcgtcccgtctactgcagcgagtgttttgctcggatgagagaagcttaatttcttagaaattacgcccaccacgaacggcgtcagaggaatctgacgccgttcgttttttctttgtgggcaggaacgaggcggttcccggagggggagttggccgggaaaaggattggaatgggaataaaaggttaaaataagggaaaagtttaatgaaaagatggaaaaacccttgcaaatatggaaaaataacgatataatgaaaccattcgtacaacaaatcaaactgtggaggagtcgaaagccgaagtacataggagaccgatcgggaggtgaggtcaatgttccggataggagataagatcgtccaccccatgcatggcgcgggaattgtggaccagattgtgacgcggaaagtcaatggcgtcttgcgggactattacagcctgaagctgcccctgggggatatgctggtgatgatccccacggagagttgtggggagatcggcgttcgctctatcctcagcggggatgagacggagcgtgtcttgggaaagattcccgaccttcaggtggagatggacaccaactggaaccaccgctaccgagagaacatggaacgcctcaaaagcggcgacctgctggaggtggccaaggtggccaaaggtctcatgttgcgggacgcccggcggggcctgtccacaggggagcggaaaatgctccattcggcccggcagatcttgatttcagaaattggattggcccagtccatcagctaccaggaggcggaagaccgcatggaccgggcccttcactcataacatgtaggatacagagaacgtggaattgaaaaggagcctgacaggctcctttttgccgtggaaaggagaagaatatggatttgctgcggagattgtttcatcgggaagaggcggcggcttccttttgctcagcggtgattgtggccgggggccgggcttcccgaatggaggggatcgacaagattctctgtcccatgggaggggaacccctgctgctgtataccctcatgccctttcagacctcctctctggtggatgagattgtcttggtcacccgggaggacctgatggttcccattggaacgctgtgcagccagcggggaatcaccaaggtgcgccgggtggtcaaaggaggggagagccggaccgagtcggttctggcggggctgcgggagaccgatccccaggcgtcactcattgccattcacgacggcgcccggccgtttctgcccttggaggtgttggagcagaccatagagactgcccggcagagaggagccgccgcccctgcccttcccgtgaaggacaccattaaggtggcccaggaaggggtggtgcagcagacgccggaccgggcccggctctttggcgtgcaaacgccccaggtgtttgaggcctcgctcatcaaaggggcgctcaccaaagcctgggaagagggcgcggccctcacagatgactgttccgccgtggagcggattgggtttcccgtctgtttgacccagggcagtgaggagaatatcaagattacaacccccagggacctgacctggggagaggctattttagcggagaggatgggacgatgaggatcggacatggatacgatgtacaccggctggtgacgggccggaagctgattttgggcggggtggacatccctcatcatctgggactgctgggccattcggacgcggacgtggtgacccacgccttgatggatgccctgctgggcgcggcggccctgggggacattgggcagcatttcccggatacggacccggcgtaccgggacatctccagcctggacctgctgggacgggtgatggcgctgctggcagcgcaggggtggcgggtggaaaatgtggacctcaccatcctggcccagcgccccaagctgaaggactatctcccccagatgcgccagaactactcccgggcaatggggctgccggtcacggccatcagtgtgaaagccaccacagaggaggggctgggcttcacaggaacggaacaggggattgccgcccacggggtggtccttttggagccgttgggaaaatagaggcttcctgccgcagagagaggcatttggtcggggacagcaccgccctcgacacagttccgcttcccgcgcatacactggtgcgggaggagctttttatggtatatctgattatgtgccgatccctgacctacgcacaaagggtgtccaacgccctggagcgggcggggatccccgcccgggtcctccggtctccaggggagatctcacccaccggatgcagctattcggtgaagatcgccgcccggaacctggcccgggctctgaccatcctgaacggaacgcggctgccctatctgggcatctacgtgaacgcggcgggatatggttaccgggaggtggaactgtgatctatttggacagtgccgccaccacgtatcaaaagccccctgctgtattccgggcagtccggggggccatggcatccatgaccagtccgggacgagggacctatggcccggcggcccgggcctcccgaacgctgctggcctgccgggaggaggccgccgccctcttccaggtggggcagcccgagcgggtggtgctgaccttcaacgccacccatgggctgaacattgccgtgcattccctggtaaagccgggagccacggtgctcctgtcgggatatgaacacaatgcggtgacccggcctttggcgtcgattgccgatgtccgcctgcgggtggtccgggccccgctcttctgtcccaatctgtttctggaggaactggagcggcggctgaccccggaggtggatgtggtcatctgtacccatgtgtccaacgtgttcggctatgtgctgccggtggaggaggttgccgccctgtgccggcggcgtcaggttccccttattgtggacgcctcccagtcggccggggtgcttcctgtgcgtatggaggactggggcgcggcctttgtggcgatgcctggtcacaaggggctctatggtccccagggaaccgggctgctcctctgccaagctggaggagaacccctgatcgcgggaggaacgggcagtctgtcccgacagccggaaatgccggatttcctgccggaccggctggaagcgggaacccacaacgtccccggggtggccggtctgctggaagggctgcggttcctccggcggcggggaatccattcgctgttctgccacgaggcggcgctggtccggcaggcggcggaggggctggcccagctgcccagggtccaggtctactcagcgggagagaagggctgccagagcggcgtgctctccttccgggtggccggccgggacccaggctgggtggcggaggaactgggccagcgggggatcgcggttcgcgcgggactccactgtgctccgctggcccatgccacggggggaaccgaggcaaccggcaccgtgcgggtgagtttttctgccttcaacaccggccaggaggtggagcggttcctgaaaacaatgcggcggctgggataggtgcccacgaaaagcgccctggatttccagggcgcttttctcagaagaaaaggtgaaatttcctctgccggcggggttgtaaatgggagggaaatacagtataataacttgaattaccatagaaaacttggcggattataccctaaaggaggtgggagcgatgacctcgtttttgcagtactgcgtcaacacgttgggttatctgcggttgatgacagtctctgatctgatcgacatcgccatcttgtccttcctgttctataaatgcatcgggattttccagcggaccaacgcggccaaggtggccaaggcgctgctgctgattatcgttgcgatgtggatttcctaccaatttaaccttaatgccatcagtttcattttgaataaggcggtggagctggggctgctggccctggtggtcattttccagccggagattcgccggtttttggagcgcattggcagcaacaacgtctcccgaatctcccgctttttccggaatgaaaccccagtcagcgatgtggaggaggccattcaggagacggtggaggcctatggagagatgtcgaaaaaccgggtgggcgccttgatggtgttcgagcgggagaccaatctgtccaacatcatctcctcgggcactcccttccagtccacggtgaccagtgaactgctgaaaaacatcttttatcccaacgcgcccctccatgacggcgcagtggtggtccggcaggggaagatcgcggcggcggcctgcatgctccccatgtcggagagtatgaatctaagcaaagacctgggcatgcgccaccgggccggtctgggtatgagcgagcgttctgatgcggtggttgccattgtctccgaggagacaggggccatttctgttgtggtcaacggtaacctccgccggcacttgtccccggagacgctgggacggattctgcgcaatgaactgctgccccgggaggagagcgcctccggcaagcggcgcagaccttccctgccgttctggaaaggaaggggaggagaatcgtgaccaacccgaagaaaaaccgcaaaatcttcaatatcgtcctggccattgtgctggcggtgggtgtgtggatgtatgtcatcaacgtggaaaatccctccggcaccggtactgtccgggaaatcccggttaccgtggtgggagaggacagcctggctgagcgagggctgatggtgacggaacagaaccgggaccatgtctctctcaaactctccggtcgaaaaaagaccctgatgaagctcaatcggaaaaacatcaccctaaagctggatgtctcctcggttacctcggagggggagcatacgctgagttgtaaggtggacttcccagataccgtgggcgacaatgtctctatttcggattgggaggacctgcatgtcacggtgacggtggagaaacaggcaaccaaagagattccggttcgaggagagttcatcgggacggaggcggacaactgcctggccggtgcggtgaccaccgatcctgagaccctggttctaaagggcccggcaaaggagctggagggcatctcctatgccctggcaacggtggggggaaaagaggttcgggataccatagtggagcagtccagtgtggtattcatgggcccggacggaacccccgccagccggaagaatgtgaccgccagtgcggagtcggtggaggtcaccgtcccagtccggcaggtggtctccctcccgctcacggtggagatcatcgagggcggcggcgctgcccgggaggatgtggaggtgacgatttccccggaaaccatcaccgtggtggcccaggagggcgaggaagctctgcccagtgccatctccctgggaaccattgagctggaggatgttttgggcgatacctcctattccttccccatcaagctccctacgggcgtcactgcctggggagagcagagccgatacgccagagtgtctctcacctttccccagctggtaacgcggcagctggcagtggagcagattgcattgcaaaatatcccccaggggtatgacgcgacgctggtgagcaagcagctttatgtctgggtgcggggaaggcaggacctggtggaagccctcgatcccaaacagcttcaagtggaggtagacctgtccgaggcgggaaaaggggacgagcttcagcggttcccggcaaaggttacctggaagggcggcgaaccggaaggggttaaaatcatggggacgcattacagcgttgccctgcggctgaaacaataggaaaccatggtttgagaaacaggtaaggaggtttctatggaacagatcgcaatggtaaagtccattctggacaatggaatggcgcaggttgccgtacagcgggagaccgcctgcggcgctgcccacagctgcgcggactgtgcaggctgcgaaaaaatgatgacgcggacggaaaacgtcgtggtggcatacaacgatgtgaacgcgcacccgggggatgtggtgaaggtacagagtgagaatggcaatttctttaagacagcagccattgtctacctgctgcccttggtcctggccctggtgttttacggtgtggcctcggccctgtccctgggcggagagggtctgcacgccctttgcgcggggattgggtttgtcctgggcatccttgtggccgtggcctgggaccgccacatgaaaaaggtcagcggcctgcgcttccacattgtggaggtcaaacgggcatgttcgggtatgtaagagcggttaccccggttcttgcaccggaggaggcccggcggtatgaggcggtctactgtggtctgtgccgcaccctgggggagcggtacggaaagacggcccagctgatcctcaactatgactttgtcttcctggccatccttctggcccggccagagacagggggaacctttcccgactgcccctgtcccgtccatccctggcgaaagaaaacctgctggctggggtctcctgccctggacgctgcggcggacgccacggtgattctcacttggtggaagctccaggacgctctccgggacggaaagctggcccagcgaatgggcagccgggctgcggccctgccgctgagaggacattaccgggccgcggcggcccggtggccggccttcgatgagacggttcggtcctgcctggaggagctgcatcaactggagcgggatcgcgtgccgtccttggaccgcccggcggatacctttgcccggattctccaggcggcggcagtggagacggatttggccgcgcgcacccgtggggtgcagcagattctctaccacgtggggcgctggatctacctggccgatgcctgggacgacctggcggaggatcagcgcacaggaaactacaatcccctcctggcccgatttggggaccaggcagcggcatccaaggaatcgctgcgggagaccatgcgagtctccctgggcctggcaaacaccgccttttccctgctggactggggagagtgggagcctctgctgggccatattctgggcacgggactgcccgctgtggaagaggccgtttttaccggccagtggaagcagcgaaagcgcccatttcatcatcatcaagggtccgcgcctgccgcggtgcccaccaataaggagaaggaaacgtatgaatgatccctatgccgtgttgggcgtgagctcttctgccagtgaggaggagatcaaacgcgcctatcgggacctggtcaagaagtatcacccggacaactatgccaataaccctctggccgacctggccgaggccaagatgaaagaggtcaatgaggcctatgacgccatcatgaaggcccggacccagggcggataccagtcggccggcgggaacgggtatggcggtggccggacctccagccagggcggcggccgctacaacaatcccacgctgattcaggtgcgccagctcattgcccagaacaatctggcggaggcggaacggattctccggagtaccccggccaacaacggggagtggtactaccttatgggcagtatcgcctaccgccggggctggatggacgatgcccgccagaatttctggaccgcctgcaacatggaccccaacaacatggagtaccgtcaggccatgaacagtatggggatgcaggcccgacggggaacctatggagggggagacgatattgccaacctctgtaccaccctgtgctgcctcaactgtctgtgcaattcgtgcagcggctgacggcgcacggaagaaaaatgagaatgaggtgtttggcttgatacgaagtatgacaggctatggccggggggagggggtcctccacgaccgggccatcacggtggaggttcgggcggtgaacaaccgctatctggactgtgcggtgaagattccccggctctatgtatttgccgaggagagcattaaggcccaggtgcagaagcaggtgggccggggaaaggtggatgtgctgatttccattgatgccaccgctgcggacaaggtggcggtgagcctgaaccggtctgtggccgacggatattacaccgccctgacccagatgcgggatgcctataacctgaaggatgatatttcagtctctctcctctcccggttcccggatgtgtttctggtggagaaggagcagggggatgccgatgtgattgctgcggacctgctccaagtgctctcccaggcgttggagggcttcaacgccatgcgggaacgggagggccaaaagctggcggaggatatccgggccaaggccgccgccatcgccgcgctggtggaacaggtggaggttcgttctccggaaacggttgccgcgtatcgggaaaagctccgccagaggatgcaggaagttttggaaaatacccagatcgacgagagccggattctcaccgaggccgccatcttcgcggataaggtggccgtggacgaggagacggtccgcctgcgcagccacctgtcccaactggaggatatgctggagcagggaggcgccgttggccggaagctggattttctgatccaggagttcaaccgggaggccaacaccatcggctccaagtgcagcgacgtggccctgtcccgggtggtggtggagctcaagggcgagatcgagaagatccgggaacaggtgcagaacatcgaatagaggaggcgacctgttgaagctgatcaatattgggtttggaaacatggtgtcggccagccggctcatcgccattgtcagtccggaatccgcccccattaagcgcatggtccaggaggccagagaccggggggtgctggtggacgccacctatggccgccgtacccgggcggtcctcattacagacagcgaccatatcatcctctctgccctgcagccggagacggtagccggccggctcaacgggcgggaggaactggcaggggaggaagaggaatgaacaaagggaccttggtggtgatctccggcttttccggcgcgggcaagggcacggtcttgtcccaagtgctggcacgccgtcctgatctctatttctccgtgtcctttaccacccgtccccccagagaaggggaaaaagacggggtcaattaccattttgtcacccgacaggcgtttcaggagcggattgaacggggagaatttttagagtacgccgagtatgtggggaatttctacggaacctccatggcggtgatccgggagaagctggaccagggaatcgacgtgatcctggagattgagattcagggggcggccaaggttcgggagaaaatgccggaggcggtctccctgtttttggtcccgccctcctttgaagagctctcccgccggctccacggccggggaaccgactcggaggagaagatccagcagcggctggagactgcccgccgggaggcgaaggaaattgtgaactatgactacatcgtcgtcaatgacacggtggaccgggcggtgggggagatattagccattctcatcgcggagggctgccggaaggaaagacggcttcatcttgtggaaggagtgtaatggattatgatgctgtatcccgcaatgaatgaactgctggagcaggtacccagccgatatcagctggtgaatgtggtggcggcccgggcccggaagatcgccgccaaagcggaacgggaggacctcatgctggaggataagccggtgagcattgccattcgggagattgccgagggacactggaaggacccggaggaggcggccgggatggaggaaggattcccggaagaggagcatctaatccaaggggaagcgggcatcgaatgaacagcgcccgtgccgtgacggcggtatgatgctggccaaaattgccctgtcggcggccacctttgccattgatcggccctactcctatcgggttcccgcccagctggagaacctgctggagccgggcatgcgggttctggtgccctttggcaagggcaaccggtccagcgaaggcctggtgctctccctggagcaggcggaggaaacccaccggctcaaggagattcagactctgctggaccgccgccctgtcctgacccccgagggcatccagctggcgctttggatgcgggagcggtttttctgtaccgtctatgccgccgcgctgaccatgcttcccacgggactgtggtatgtgctcaaggagggatacgccctggcccccggggtggaccgggagacttgggaggccaagacggccggccatccccgggccagacaggtgatgaccctcctccacggagcaggggggcgggctgacctggcccagatcagagccattcccgacgggaaagacccccgaggggtgctgcgggagctggagaaggcgggcctggtggtccgggaaacccaggcccggcggaaggtcaaggataagacggagcagattgcctccctggctgtggacccggcggaggcgctggcccggatggagccccggcggaagacggcgcccatggggtatgaggtcacatccttgctgtgcaacctgggcagcgccagcgtgaaggagctgtgctacttcaccggggcctcccaccagacggtgaagagcctggaaaagcgggggattctccgcctgcaggagcgggaggtgttccgccaccagctgccggatatccggcaaacgcaacctttgtctcctctgaacgaggcgcagcaggcggcctatgaggggctgcgggcgctgatgaacgggggaaagccggaggcggccctcctctacggggtcaccggcagcgggaagacccaggtctacctccatctgatcgagcagaccctggcggcgggacggggggccattgtaatggtcccggaaattgccctgacccccagcctgctgcagctcttcctcacccatttcggccggcaagtggcggtcctgcacagctgcctgtccaccggggagcggtacgacgagtggaagcgggtccgggatggacaggcctctgtggtcattgggacccgttctgcggtgtttgctcccctggcggatgtgggccttatgattttggatgaggagcaggagagcagctatcagtcggagagcatggtccgttaccacgcccgggaggtggccaagttccgctgcacccaccataagggactgcttctgctggggtcggcgaccccggcggtggagagccggtatgccgcggagatgggacagtatcacctgtttaccctcaggcagcgatacaatgcccaccagatgccgaaagtgcgcctggtggatatgaagcaggaactccggcagggaaacgccacgggcctgtccggcctgctgcgggaagaactggaggaaaacctccggcggggggaacagagcattctctttctcaaccgccggggcaacagccgtatggtggtatgcagccagtgtggcgaggttcccacctgtccccggtgctcggttcatttgacctatcacagcgccaatggcaggctgatgtgccactactgcggccattcccagcccctgccggagctctgcccccattgctatggccggctccagtttgtgggcatgggcacccaaaaactccaggaggcgctggaggagagctatcccggggtggagatcatgcggatggacgcggacaccattacagccacccaatcccacgaggtgctgctggaccggtttcggtggaagcaggtccccatccttttgggcacccagatggtggccaaggggctggactttgccaatgtgaccctggtgggggtggtggacggcgatctgtccctatacgcagacaattaccgggctgcggagcgcaccttttccctgctgacccaggtggtgggccgggcggggcggggagaaaagctggggcgggctgtgattcagacctggaccccggacaacgatgtgatcaacctggctgcccgccaggattacgatacgttttacgaggaagagcgggagatgcgccggatgctccggttccccccctttctggacctgtttcggattaccctttccggtccggaggagacccaggttctccgggcctgcgcggtgatccggcgtagcttagaaccctgggtgaagccccggcagcaggggccagagggaccggaagtgctgggccctgcgccggcgcctgttttgaaggtgaacaaccggtaccggtaccgcgtgctgctgaagtgccggaacgggcgggagatccgggcggtcctcgcccagattctccaggcggcccagcaggaccgggccaaccgggggctgtccatcgcaatggatgtaaatcccatggattaaagagaaataagaggaaggaatgacccattatgatcagaaaaattctgcaaaaggaagaccctgccctgcataaagtatgccatcccgtcaccagcttcgaccggaagctgggtgctctgctggatgatctcactgctaccctgaaggatgcccagggcttgggcctggctgccccccagattgggattctccgccgggtctgcgtggtgatggacgaggatgagcagtacctggagctggtcaaccctgtcattgtcagccaggaaggcgagcaggagggatttgagggctgcctgagcttaacggggatgtacggcattgtcaagcgccccatgaaggtgacggtgaaggcccaggaccgccatggaaacccggtggaatatgagcgggaaggggtcaccgcccgctgcttctgccatgagattgagcacctggatggacacatgtactatgagcgggcgggccgcctgttcaccgaggccgaggtggatgagatgctccagaaggccgaggaagaggcgtaatgcaggcctgttggagcggtcaggaggggagagaggcatgaggattctattcatgggcacgccggattttgccgtgccctcgctggaggccctggtggccgccggacatgaggtggtgggggtgttcagtcagccggataaacccaagaaccgggggatgaagctccagcccacgccggtgaagtgctgtgcccaggcccacggcctggcggtctttcaacccaccaaactccgggacggcacggcgctggagaccattgtccagctggcgcccgacctcatcgtggtggcggcctacggccggattttgccccaggagattctgtcctatccccggctggggtgcatcaatgtgcactcctccctgctgcccaagtaccggggggcggcccccattcactgggccatcctgaacggagagcaggagaccggggtgaccatcatgcacatggctctggcgctggacgccggggatatcattgcccagcgggccacccccattgacccggacgagacggtggagaccctccatgaccggctggcccgtctgggggcggaactgctggtggagacggtggagcatctggccgacgacaccgccacccggaccccccaggaggagagtcaggtgacgttggcgcccatgctcagccgggccctgtcccccatggactggagccgccctgcccgggccctccacgatcaggtgcggggactgcttccctggcccgctgcagtgacagagctggggggcgtacgctgcaagattttggccaccaccgtgctggaagagaccacggaaaaggcgccgggcagcgtggtgacagcggacaagacgggcctgaaaattgcctgcggggaggggacgctcctccgcatcgaccggcttcaggcggacggaggcaagcgcctggcggctgcggactatctgcggggacaccccattcccgtggactgagagagaaaggagggatggggcatgtccgcccgagaggctgcgctgctgaccctggtggcgatggagcgccaaaaggcctggtccaacggccatttgaaaaaggtcatccaggaacaaagattagaccggcgggatgccgccctggccacccgcctctgctttggtgtgatccaaaaccgcatgctgctggaccactatctccagcagtactctgccatgaaactgagcaaaatggagagcaaggtacgcaacaacctgcggttgggtctgtaccagatgctttttatgaccaagattcccgtcagcgcggcggtaagcgaaggggtaaagctgaccaagaagcactgcaaaaatccccgggcgggggggatggtcaacggcattctccgcaatctggcccgccatctggacgagcttcccaccctggaccgggggaatcctgttgcatatctctccctgctgtacagccacccccagtggttggtggaggaatggagccagcagttggaagcgggggagctggaagaactgctccgctgggacaacagtgaaccccctgtgacagtacaagtaaacacttgccgattccaaacctctcaggtggcggcggcgctggaagaggaggggatgacagtgacggcccatccctggctgccggactgtctggtgctcacgggaacaggggacctgacccaggggcgcgcctggcaaaccgggatgttctacccgcaagaccctgcggcccgcctggcggttttggcggcgggcctgttgccagggaataaggtcctggacgcttgtgcggcgccgggaggaaaatcttttgctgcggctatgaccatgggagaccaaggagaactctatgcctgcgatctccatgcccataaaaaggctctcatcgaggctggggcagctcggctgggactgggttccatcacagcccaggtgctggacgccagaaagccccgtaaggggtgggaggggacctttgacacggtgctggccgatgtaccctgctccgggctgggggtcattcgcaaaaagccggagattcgctataagccccaggaagagctggccggactgcccgcgctgcagggggagattttggacaatgtggcccattatgtcaagccgggcggggtgctgctttactccacctgtacccttcgtcctcaggagaatgaggcggtggtccgggcctttttggcttcccatgggggcttttctctggagggattccggctgcctggccccatgggggaacagccggagggggtttgtaccctttggccccagcggctggggaccgatggatttttcctggccaaattccgaaggagggaagaccatgactgacctgaaatccatgacgccggaggaactgaccgcctggtgcagggaacagggccagccggcctttcgcggcaggcagctgtttcaatggctcagccggggggtggtttctacccaggagatgacggaccttcccaaggcccttcgggcgaagatcgaccaggagggcggcatttcccccccgtcggtggagcgaaaacaggtctcaaaactggatggaaccataaaatatctttggaggctgtcggacggcaactgcattgagacggttctcatgcgctaccgccatggcaactccgtctgtatttcctcccaggtgggctgcgccatgggctgtgccttctgcgcctccacagtgggggggcgggtccgcaacctgacggcgggagaactgctggaccaggtcatttttacccagaaagattccggtgtccccatctccaacattgttctgatggggattggggagccgttggacaactatgacaatgtacggcggtttttgaccctggtcaaccacccggacggtgtgaacattggcatgcgccacatttccctgtccacctgtggactgatccgggggattgaccgcctggcggaggagggacttcagctcaccctgtctgtgtccctccatgcccccgacgatgaaaccaggagcgccctcatgcccatcaaccggggcacgggggtggaggccctgcttgcggcctgccgccggtattttgccaaaaccggccggcggatctcctatgagtatgccatgatcgacggggtcaacgacaccccccgccatgccgccctgttgggggaccggttggaggggaccgttgcccatgtgaatctcattcctctcaactatgtggaggagagcagcttaaagcccagtccccatgtggccgcctttcagaggcagctggaaaagcggggtattcccgccaccgtccgccggcggctgggcagcgatatcgacgcctcctgcggccagctgcgccggaaagccctgcaaaaccgggcggaatgaggagagcaggagatgcgaaaggagatgatcccccatggtttccgtatggggactgactgacagaggaatcgtacgaagagaaaaccaggattcctgtgcctatgaaatcatagaggacggcgacctggcctggggcgttgtgtgtgacggcatgggcggggccaaggccggcgacatcgccagcaagatggcggtggagactttctgcgcccatttggagcagctgcgggatctggaggggcccccccccgcggcggacctgctgctggccgccgccgaggacgccaatcgggtggtctatctcaaggcggagaccgaccgggactgcgtgggcatgggcaccaccttggtgggaatgatcctgcggggcaccaccctgtgggtggtgaacgtgggggacagccgggcctatcacatcaccaagcaggccatccggcggattacccgggaccactctgtggtggaggatctggtggccaaaggggacctgaccccagagcaggccagaaaccacccccagaaaaatttgatcacccgggccttgggcaccgcccgccgggtgaaagccgatctctttcaggaaactgtggcggagggagactatctcctgctctgctctgacggactgatcaacgaggtcaccgaccaggaaatccaccgggaggtcttggctggggggaccccccaggagatttgtcagcggctgatgacccgcaccttggacagcggagcgccggacaacgtcaccgttgtgctgttccaactgtgaggaggcgtatattaccatgaatcaatacatcggtaaaatgcttgacaaccggtatgagatcctggatgtcatcggggtcggcgggatggcggtggtctataaggcctattgccaccggctgcaccggtttgtggccatcaaggtcttaaagcgggacctggccgccgatgcggaattccgccgccggttccatgaggaggcccaggcagttgccatgctctcccaccccaacatcgtctctgtgtacgatgtcagcaagggggatgatctggactatatcgtcatggagctcatcgacggcattaccctcaagcaatatatgcagaaaaaagaaggtcgcctgaactggcgggagtccctgtattttatcacgcagattgtccgggccctgggacacgcccacagccgggggatcattcaccgggatattaagccccaaaatattatggtgctccgggacggcagcgtgaaagtggctgactttggcattgcccggatcatgtccgccgcccagaacaccctgacccaggaggctctggggtcggtgcactatatttccccggagcaggcccgaggcagccacattgacgcccgggcggatatctactctgccggcgtggttctctatgagatgctcaccgggcgcctgccctttgatggggactccccggtgtccgtggccatccagcacatcagcgccaaacccatgtctccccgggaactcattccggacatccccttgggcctggaggagatcaccatgaaggccatggcgtcccggattgaccagcggtatatgaatgcggaagccatgctccgggacctggaggagtttcggaagaacccccaggtggagtttcactataacctggccagcttccacggcaaccagcccgtgccggatgagcccacccaggcagtggatggggccagttccctggggcggcggcagcgcccccccgcccggcccagaaccgcgccgcccccgcgacgatatccgccggaggaggcctatgaagacgcccaggaacgcaagcggaatctggtcattcccattgtggtggtggtcttcctggtgggagtgggcattttcctgtggctgacctttttcagcggcctgttcgcccaggatgacgcgctgaaagtgccgaacctgctgggggagaagatcgaagatgtcacccaggatcaggagatcctacaacattttaagattgtagaacaggccagggaacccagtgaggactatcccgagggacagatcatccgacaggaccccgacggcggcaccgaggtgactgccggggaggaacccatcaccattcaggtggtggtcagctccgggaaggagacggtggagatgattgacgtgctgggggacacctatgagaccgccgtcacccgtctgcagcagctggacctgaaggtggatacccccacccgggagccctcagatgacgtggaggaaggcaaggtgatctccagcgatcccgtggcggggaccaaagtcagcccgggagataccgtgcgtctggtgatcagctccggccctgacacccgaaacgtaaccgtccccaccctcacgggaaccacgctggagaacgcccgaaacatcgccaccagcgcggggctgaaaatctccagcgtgacggaggtaaacagcgacaagccggtgggccaggtggtttaccagagcattgcccccaacaccgaggtggaggagggcacaggcattgtcctccaggtgagcaagggaccggaaaagcaggaaccggtgaccagcaccaaaaatatcgagatcaccctgcccgatgacgagcgggagagcgtagaggtgcggattacagtggacggaaaagaggtctataagaacgacgtgagtacggagcaggggagtttttatgttcccgtcaccggctccggcgtcatggaaatctgcatctattttgacggaagtttggaaaaacggtacagtgagaattttaacgaatgagtcagacaagggtagaaggaaccatccgtaaggcattgagcggattctattacgttcagacagagcagaccctggtgacctgccgggcccggggaaagttccggtatcagaaagtgacccccctggtgggggaccgggtggccattgccctccagccggatgggtcgggctccctggtggagattctgccccgccgcaatgcctttcagcgtccggcggtggccaatctggaccagctggtcatcatcgcctccggggcggtcccggtgagcgatccttttctgctggaccggatcatctctctggccgagcgcaagggctgcgagccgattttgtgcatcaacaagtgggacctggtcccggcccagcagctgctggagacctatcgggccgcgggaatccccgcccttccggtcagcgcggttactggcctgggaatcgaccagctgcgcggcttgctggcgggaaagatctccgcttttactggcaactccggggtgggtaagtccagcctcctcaacgcgctggaccccgcctttggcctggccacgggagagatcagcgagaagctgggccgggggcgccacaccacccggcatgtggagctgttccccctggcaggagggctcattgcggacacaccgggcttttccgccttcgatcaggagaagggagaggacccggtggagcaagaggccctggcccggtctttccgggagtttcgtccttacctgggccaatgccgcttcgtgggctgtgcccatgtgaaggagcagggctgcgccgttctggcggcccgggatgcggggaagatcgtccccagccggcacgagagctatgtgcggctgtatgaactggccagggagaacaagccctgggggaaaaactgaatttccgtgtccgcaccacccgtcccctttcggcatagactgagagcggacgggtgttttcatgcccgggaagggaggggagcccatgaagatggtggtggtgagcgcacccaaagccttggcaggcttgctgaaaaagctcttccatatttgaaacggggaaccaggtctatctgccggcagttccacataggatgggacagatacttacttgacacgagaaaggattggtcacagtgatggaattggaactccggcaggagaccgtgcggggatgggagtccgtctgccgtgcgacattggaacaggaagagaccgcagagatgatcgtgccggatgcctgtccggacatttggcaggtgctggatggggaggcccgtcttctcctccagcggaaggagccccaggatgggaaaggggagttttccggcctgctgaaaaccacgatcctgtatcagccggaaggagagcagggcctgcgggccatggaagtgaccctgcccttctccgcttccccggaactgacccagctgacccggcggagcatgctccatgtgattccccgggtactgtcagtggatgtacatctgctcaacccccggaaggttctggtccgggtgggatattgcttggacatcgagggctttgagccccaggccagaagtctgacctccctggtggaggagccggaacgctatggaatccgccagaaaactggggagctgcgcagctttcagaccgtctacgcccaggaaaaggcatttacctaccaggacacggtggtgctccccgccggacgacccgacgcggtggagctcttgcggacccgggcacagtgcacctgcacagaggcacgggtcatcggcagtaagttggtgttcaaaggagaggcgatgctgcagctgctgtgccggggggaggacggagccctgtttaccggggaattccacctgccctattcccagatcatggatgccggggaggacagtgaggagggcatgtgcagcatggaccttctgttcaccgacgtaaagtgtacccctgtggaggaggaccggcggagcttccaggtggagctggcggtgcaagcccaggcggtgctgcgccgggaggtgacggtgcccattctcaccgacctgtacagcacggcctatgaggtgcagccggaggaggtaacctgtcctgtactccacctcctgggacagggagaggagcaggagagcgtccgggaggtggtgggaacccagggccttcccggcaatcttttggatgtgcaggcccggctgggccggaccggtcagagccaggaaggagaggaccaaatgctcacccaggaggtggagctggtggtgctctatgacaccgaggagggcctggcgtctgcccgccaaaaagtggtggtgcagcatcgcctgtccggccagagcggcgggaaggcggtgttctccacggagcttctccgggaacccaccgctgcgccggcgggagagggagtggaggtttctttccccctggccttccgctggatggttctggaaaaggaggaggccccggtgattggccgggtgaccttgggggaaaagcgggagctcggcgcccggcagccctctgtgattctccgggcagtccaccctggggaggacctgtggaccgtggccaaggcctacctgaccacggacagcgacattatggaggccagcggcctgacctctggggagattttcccgggccagatgctgctgatcccccggaagagcagctaaagggagcgccccggcacacagtgccggggcgctttgtctggcgttttatgatggatactggtggcagggaggcagacagctgtggtttttacagacatagtaggtggtctgttctcccagcaggggataggcgtccgtgggctgttccagaatggtgaccacggcgtccaggggaaagggccagggctgccggggcggggcctctcccggcgccagaaccaccgtgatctcctctgccggcacggcctgggccagcaaggccagcagaaagacaggataggccgtgggataggaggcggccaggggggagagaaaggccatttgggcttccgctgccctctgccacgtatcctcccgggtcagatgggacagacgaatcaggttccaggccatcatggtgtttccgctgggaagtgccccgtccgcggtgtccttggggcgaatcaacaggggatcggcgttttgaggcgtgaggaagaagccgccgctggggtcggtgaaatcagtaaggacctgccggcacagggtctgcgcttgggacagataggacggctccagggtggcttcgtaaagggacagcaggccaaaggcgcagaatgcgtagtcctctaaaaacccaatcccccgggccaacccatcccggctggtggccgacagggtaccctggctcccatgaacccgggaaaggtaggtccagatcccccgggcggcgtcccggtaaatggtctgcccggagacccgatagagccaggatagggcgcccatcagcaggccgttccacccggccagcactttatcgtcccgatgaaggctggcccgggccagccggtatgcatacagggcggggatgcaagcggcgaatcggtcccccggcaaggggctgtggagcagattggggatgctgaagccatggaagtttccctcttccgtgatgtcatagcaggcgttaaaggcggtcccctggtcttctcccagcacagccagcacttcctccgggcgaagggcgtagtaggcgccctcgctgccgtcgctgtcggcatcctgggcgctgacaaaggcgccggaggccagggacatctctttgaagagatagccggcggtctccgtggccacctggcggtaaagcgtccgtcccgtgatggcgtaggccttgcagtaggccagcatcagcagggcgttgtcgtagagcattttttcaaagtgggggatgtgaaaggcccggtcggtggaataccggcagaatccgccgccgatgtggtcgtagatgcccccgcggtaaagctgctccagagttttttccgccatggccaaggcggcggggtccgcctttttctctccataggtgagcagaaagagaagactgtgccccatgggaaatttgggggcggcgccgaagccgccgtatgtctcatcataggtccgtttccactgggccacgccctcctccaaaagggaccgggtgggggaactttgctccggaggtctctgggtaagcagctgaagaaactgccgccccggggcggtgagggcctcccggtcctgagcccaggcgtcccggatggcagacaggagctgccgcagtccggtcaggccgccccggctggtgggaggaaaataggttccggcaaagaagggaagctgttccggggtgagaaacagggtggtgggccagccgccgctgccggtgaaggcctggcaggccgccatgtagaggctgtcaatgtcaggccgctcctcacggtccaccttgatggagacaaagctctcgttgagaagccgggcaatctccaagtcctcgaagctctcccgggccatgacgtggcaccaatggcaggtgctgtacccgatgctgagaaagatgggtttgtcctcaattttggccttttgcagagcttcccgtccccaggggtaccagtccactggattgtccgcgtgctgcaggagataggggctggtttggccccgcagatggttgctcatagggatacctccgtgattagatgcggttagtatatgaaaaatccaccaaaacatgcaaaaaccgtccctttctcagaaaaaagggacggtttttgcagcttcagtccatgtcggtggtacgcactttttttaagtgggcaaactgaggcagaccatgggccagggggcgttggagctcgccctggatgagggggagggcatagtcaatgaagggctggcggatgccgttgccctcgggggtgatccagtccagggggaccttgcgctcggtgttggcggcctgggtgagggggatgagcttggtctggcagcgatagccgctggcgtcccgggtgcagtccagggccaccatttggtctgtgaggccggcggtggctgcctctactgcggcctttcccgccagataggcctcccgcacgtcggtcagggaggccagatgagaaccgcaccgctggagcagggagagttcaatcccccgtactttaacccccagggccctcttcacggactcagccagcagggcggccagcccgcccagctgggcatggccgaagccgtcggtggcggaggtcttggcctcggagacaaaggttccgtccccatagtgaatgccctcggagacggccaccaggcagttgccggtgtcctcatagacccgctttacgtcggccagaaaggcctccatggagaaatccacctcgggcaggtagatgaggtcggggccggacccggcccaggtggccagcccggcggcaccggccagccagccggcatggcggcccatgatctccacgatcaccacagtccctgtgtcatagacccgggcgtcctggtaaagctccatgcaggaggtggcgatgtacttggcggcactggcatagccggggcagtggtcggtgccggacaggtcgttgtcgatggttttggggaccccgatgatgttgcaggggtagcccacccgctgcatgtatttgctgattttgttgcaggtatccatggagtcgtttccgccgttgtaaaagaagtagcggacgtcgtatttttggaagatttccaagatccgtttatagtccgtgtcgtccacatccgggtcagccagcttgtaccggcaagaccccagcgcggaggagggggtaaactggagcagctccagctgaccggggtcttcctgtcccatgtcgtagagctggtcggccaagacccctttgatgccatgggcggcccccagaacccgggtgatctggggggaggccagcgcggtctgaatcacgccctgggcgctggcgttgatgacggccgtgggcccgccggactgcccgatgatgcaggcgcctttcaagttttccataaagaaaacctccctaataaaaaatgaatggagagcaaactcgattcctcttgagaacccatcataacatatcccatccgctcttgcaattctcaatgaatgctggtacaataatttatccgaattgtttggaaaggagcggtatctatgccgttagtgacgaccacagaaatgtttcagaaggcctacgagggcgggtatgccatcggcgcctttaacgtcaacaatatggaaattgtccagggcattacggaggcggccaaggaagtgagctctcctctgattttgcaggtgtccgccggggcccggaaatacgccaagcacggctacctgatgaaactggtggaggccgccgtagaggatacgggcctgcccattgccctgcacctggaccatggcgaggattttgccatctgcaaggcctgcattgacgggggctttacctcggtgatgatcgacgggtccaagcattcctttgccgacaatattgcgctcacccgccaggtggtggagtacgcccaccagcacggcgtggtggtggaaggggaactgggccgtctggccggcattgaggacgacgtgaatgtctcggcggaggactcctcctataccgaccccaaccaggtggaggagtttgttcgggccacgggggtggacagcctggccattgccatcggcaccagccacggcgcctataagtttaagccggggaccaagcctcagctccgctttgatatcttggaggaggtttcccgccgcctgcctgggttccccattgtactccacggggcctcgtcggtggttccccactatgtggagctcatcaacgccaacggcggccagctgaaggatgccatcggcgtgccggaggatcagctccgccaggcggccaaaatggcggtgtgcaagattaacatcgactcggacctccgcctggccatgaccgccggcgtgcgccagcagctgatggcggaccctgcgggctttgatccccggggctatctgaaggtaggccgtcagtatgtgaaggatctggtcaaggacaaaatcgtcaatgttctgggcagcgatcacaaggtctgacctgtctgtggccggcccctttgaggtccggtggaacggagaaaacggtacagcagtcgctgtaccgttttttggtaaatcgggaaggaaagagaaccatgaaagaacgctccattctgaagaacaagtattatctctacctgacggaattcttttccggcgtctccgtcatggcggtggaactgggggccagccgtctgctggcgccgtacttcagctcctcccaaattgtgtggaccatcatcatcggcaccattatgattgccttggccctgggcaacctctggggcggccggaccgcggacaggaatcccgaccctgaccggctctaccgccgtctgctcttggcggcggtctggatcgctgccattcccgtgttgggaaagtacattattttgggcatttccagtctgttggtcctcaccatcagcacccactttttggtgattgcggccttttgcgcctgtatggtcatttttgtctttcccctgttcctgctgggcacggtgaccccttccctggtgaagtacacggtggacagcctggaggacaacggcaaagtggtggggaccctgggggcctgcaacaccatcggcagcatcctggggacctttctgcccacctttgtcaccatcccggcggtgggcacggcggtgactttcttgctgttttccgggattctgctggtcattgggctggcctatttcttcagtgcgagaacctgctggagaacctgcctggcggcggggattctctttgtgctctgcaccctgttgggcggccggggcggatttgccttctgggaaaaggaccttacctatgaaggggagtcggtttacaactatctccaggtgaaagagaccgaggaccggaccatcctctccaccaatgtcctgtttggggtacagtcggtgaagatgaagcaggagggcctcaccgggatgtactacgactacgccctggcggcgccggtgatggcgggactgcaccaggggaccgcgggccgggttttggttctgggcaacggcaccggaacctatgcccggcagtgtacccgctattttccccaggttcaggtctccggggtggagattgatgacaagatcacccagctggccacgcgttattttgaccttcccgagacggtggatgtgaccacctatgacggcagggcctacctccaggcggtggacacccagtatgacgtgattcaggtggatgcctatcaggacattaccatccctttccagatgtccacggtggagttctttgccctggttcgggaccacctggcgccgggcggggtgatggtggtcaacttgaatatgcactcggacggggagggaagcatcaaccaggccctgtgcgacaccattgccagtctgtttccctatgtgtctacggtggatgtccccggcaccaccaaccgggagctctttgcggcggtggacggcgaccccgtgcagtggctggcccaacgccgggccgccctcccggcgggggagctgcgggaccagatggaacgggtgtcccaggggctgatcccctatgtgggcggggcgcatattctcacagacgacaaggcgccggtggaactgctggggatgcgggccattgatgatctgatccagcaggaactggcgtattaccaggaaatctaccgggaggaaggcctgtccggcctgctgaaccggttttgaaagggggaaggaccatgctgcatatcctcacaggccgggccggcagcggcaagaccacccaggtgcttcgccggatgagggaggcgggagagcgccggccccagctgttgctggtgccggaacaggcgtcttttgagaccgagcggcggttctgccgggaaaacggcaaccaggccgggcggtacggggaggtgctctcctttacccgtctggagaaccgggtgctctccctgggcggcggggcggcggagcctgttttggacgcagggggccggctgctggttctatacgccgcccttcgttctgtgcaggccaatctgacggtctatgccatgccctcccagaagccggcctttctgaccagtctgctgaccaccctggacgagctgaagagctactgtatcacaggggagcagctgacccaggtgggagaggagaccgagggattggacggtgagaagctccgagacctgggcctgatttttggtgcctatgaggccatgaccgcccggggcgcgctggacccccgggaccggctgacccgtttggcggaaaagctgaggcggtttccctttttccagggtcaggacgtgtatttggatgggtttaccgactttaccccccaacagggtctggtgctggcggaactcctccgccaagcccactccgtgacactggcgctgacctatggagagggggctggggaggaggcggtctttgccccggcgaggaaaactctggcttggatcaaggggctggctgccaaggtgggctgtcctgtggaggaggaagctctgcccgccggggaatgggagcggaccccgcccctgcgccatttggagcaggcgctttttgcccatcccatgccctcctataccggcccctgggacggtagtatagtggtccatgagctgccctctccccgggaggaggtggcttgggccgccggggagattcgggccctggtccggcagggccgggttcgctaccgggacattgtggtgacggcccggtctatggacccttattgggagcagctggagggggtgtttgcccagtatgacatccccctgtttcaggcggataaaaccgaccttctgcaaaagcccctgtttaccctcatcaccgccgcgctggacgcggtgaacgggggctatctctatgaggatatgtttcgctacttgaagaccggtctggccggactgagcctgccggagtgtgaccagctggagaactatgttctcacctgggacatctggggcagccgctggaccggagccggaggctggacgcgtcaccccgggggataccatcagcggtttacgccccaggacgaggagacgctggagaccctcaatgccctccgcctgcgggtgatccagcctctggaacggctgcggaagaacgccggtggcaccatcggagaacaggtgctcgccctctaccagtttctggaggagatccatgccccggagcatctggaggcgcgaagcgcggcgctgctgcaccagggtgagccggagctggcccggcaatacagccaactgtgggagattttttgccgggccctggagcagtgcgcggcgctgttgggggaggtggaggcagcgtttgccgatttttcccggctgctgcgcctccttctgtcccaatactcggtggggaccattcccgcctccctggaccgggtgaccgccggagatgcccagcggctggggggacgggcctgtaaggtgctcttcctgctgggagcggaggatggggccattccccaggtggcccccggccagggcctgctcaccgaccaggaccggctgctgttggaggactacgggctgacctgttcaccccggttggaggagaagatcagccgggagaataccattgtgtataccacctgtgcccagcccacggaacgcctctgcgtcacctggccgttccagggggcgggagggggcgagaaacgcccctccttcctggtggaacggctgaaccgtctgtttcccgcggcggcggcccaggggggggcggcgccctccctggatcagctgcgtgccatggcggccggactgccccaggtccgacaggctctgtcggacgatcccctctgcgacacgctgtttcgccgcctggatcgggcggcccactggacccggggaaggttgtcggcggaccgggtggcggcgctgtacggggagaaggtggctatgtcggcctctcggatggatcagtatcagtcctgtcactttgcctatttcctccgctacggcctgggggcaaaggaccgccgcccggcggggttccatgccccggagtacggaacctttgtccatttcgtgctggaaaccgtgctgcgggaggtccgggcccaggggggggtggcgcgggtctcccaagaggcggtccaggcctgcacggcccgggcggtggaggactatgtggcccgggaactggggggtatggagcaccagaccccccgcttccgctatctcttccgccggctggaacggaatgtccgggcggtggtggacaatgtggtggcggaactccaggcctcggatttccagccggtgctttttgagctggggtttggtccgggaaaagagctccctccggtggagatcaccgagggaggcgtaaccctccggatctctgggtttgtggaccgggtggacggatgggtcaaggacggccggctctatctgcgggtggtggactataagacgggccggaagtcctttgacctgacggaggtctggcacggcctggggctgcaaatgctgctgtacctgttcactctggaggaggagggggaccgcattttcggaacgcggcccataccggcgggggtcttgtacctgccggcccgggacgccatgatttccggcagccgttccatggatgaggcaacccgtcagcggctgctggacaaagaactggtccgtcgaggcctgctgctggaagaggaggacgtactgcgggccatggagcacggggagggcggtccccgctttttgcccctgcgggtgagcgcccggacgggaaaaatctcgggggaggctctggtcagcgcccaaaagctgggccggctgaagcagcacacccagcggatcttggcccagatctgcggcgagattgcccgggggaccattgacgctgacccggtctggcggggggaggccaggaatgcctgccagtattgtgaatttttccaggcctgccagtttgaagagcacaccgaccgccggcggtggattccgtcggtgaagaacagcgaattctggcagtggctggagcagacccaggagggagggaacacccatggcggtgaaacgaacgcctgagcaggaggaagtggtcaaaaatcgcggcggcgccctgctggtttccgctgccgccgggtcgggaaagacccgggtgctggtggagcggctgatggactacatcctccaggaggggcggaatattgacgagtttctcatcatcacctttacccgggcagcggcggaggagcttcgggcccggattgccaaggagatcgccgaggcgctggcggcccagcccgaccatgcccacctccgccagcagacggtccggctctatgagacccagatttccaccatccatgctttctgtacggtccttctgcgccagtggggccacctgctggatatcccgggggactttgccctctgcgaggatgaggaggcccaggtcctcatgacccggaccctgaaccaggtgctggaggcacggtatgaggagatcgaccccacagggccctttgccaggctgctggatgtgctctccaaagggcgggatgacagccgcctgctggagatcaccttggatatctatggaaaaattcagagctaccccgaccccttggcctggctggccagccagcgggaagccctggacctgtcggcggtgaccgatgtgggacagaccccctggggcagcctgctgctggaggaggccggccaaaccgccgcctattgggcggaccaaatggcctgggcctgtgacctggcccagaaagaggcggggctggaaaaggcctacggggacagcctccaggccacccggaggagcctggaggcctttgtccaggcagccggaaccagctgggatgaggcggcccgggtggagattgtctttcccaagctcaaagctgcccggggggtggaagacccggccctgcaggagcagatcaaaagcatccgggcccggtgcaaaaaggcggtggaggagctgacccaaaccgtgtccggccccagcgcccccctgctggcggatatggcgctggtttaccccgccatgctggggctgctggacctggtggaggatttctcccgggcctatgaggcggcgaagaagcagcgctccctgctggacttttcggacctggaacacttggcggtccgactgctggtggacgaggcgggggggcccaccccgctggcccggcagtggggggcgcggtatacggagatcatggtggacgagtaccaggacaccaatcaggtgcagaataccattttccaggcgctgtcccaggaggggagaaaccttttcatggtgggggatgtcaagcagtccatttaccgtttccgtctggccgaccccaccattttcctggagaaataccgtacctttcccccctatgaccaggcccaggtgggacaggagcggcggattacgctgtccaaaaattttcgctcccgcccccaggttttggaggcggccaacgatctgtttcgtgccatcatgtcccggcggttgggggagatggactacacagacggggaggccctgtaccctggcggcacgtttccggcgggagagggctatgagacggagtttcatgtgctggactttacagaggacccagcgtacaccgaggagaagcaaaaccgcaatgcgctggaggccaggtttgtggcgaaggagatcgcagaactgctccagtccggctttcccgtgtccgatggggccggcgggacccgtccggtccggccggatgatattgccatccttttgcgctctcccggcccggtgcggcgttattacacccaggcgttggaggagcagggggtgggctggtccgcggaagaggggggagatctgtttgctgcctcagaggtctcagtggccctctcctggcttcagatcatagacaacccccagcaggatatccccctgctggccgtgcttcgctcccccttggtggggatgaccggggaccggctggcggagattcgaggcctggcggagggcaccttttacaccgcccttcaggcggccggggcgcaggggtgggaggactgccggtcctttctgggccagctggaagccctgcggtttggggcgggagaggagagcagtcatcacctgctctggtctttgtaccggcagaccgatatgctggaggtgtattcctccctgcccggcggggaaaagcgccgggagaatctactctccttctatgaattggcccgacggtttgagggagcgggacacaaagggctcttcggctttctccttcatttggaccgggtacgggagagcgggggcctgccggcgatgccggccgcgcccaaggaggaggccggggtgaaaatcctctccatccaccgctccaaagggctggagtactcggtggtctttctctgcggcctgggacggcggatcaactatggggatttgcagaagccggttctctttcacccgcggctgggcctggggcccaagggattggaccgggagactatggtggagtttaccaccctggcccggaccggggtggcgctggccctgaagaaggaactgctggcggaggagatgcgcctgctctatgtggccatgacccgggccaaagagaagctgatcctgacccacgccctggcctatgggcggggagacctgaggaacctggcggagagtgtctcctaccccgccgacccccgggtgctggcggggtgcaccagtgtgggtcagtggctcctgctcactgcgctggcccggccggaggggggcgaactgcgggcggccatcggccgggaggagcttcccctgccggcggcagccctggggccatcctggcgcattgcctaccatggcggcggggtgtcccagagggggtcctcccgccgtggtccctgcaaggcggcgcggcatgccgctcttccgccggaggagctcctcgcgcagctgcgctggcgctatccctatgaggcgtccgccgccacccctgcgaaggtgacggccacccaggtggcggaccaagacccggaggaggccggctggtttcttctccgggaccagggatcgagggagccggccccgttctaccgcccgcaatttgcccaggcctctctggggctcaccccggcccagagagggacggcggtccacacggtgatgcagagcatccgtctggacagaacagggtctgtggagcaggtccaggcggagctggaccgcttgaccggggcccactacctcaccgaagcccaggcccaggcggtggacccagccgcagtggcccggttcttcgcaggggacctgggcaggcagctgcgggggagccggaacctgcaccgggagtatccgttctcggtcctgaccgaggcccgtcgcttctttccccaggcgccggcgggggaggaggtcctgctccaaggggtgatcgactgctggtttgagacggcggaggggatcaccctggtggatttcaagacggaccatgtctccgccgagcatctggcccagcggagccagcggtaccgggggcagatggcagcttacgcctatgccctggaggaagtgaccggaatcccggttgtccggcgggtactctggtttttggtccccaaccttggggtggagctgtcctgaatccacgaaaaaaacccaataattctgaaaaaaagagttgcatttttgctctgaaagtggtatcatgtatcatgcgcttgtgaggcgcgatcattttttgacatcagaaagaggtgaacactcatgaaggaaggcatccatcccaactacgagcagaccacaatcagatgtgcttgtggcaacgtgatcgagacaagatctactaagaaagacatccgagtagaagtttgctccaagtgtcaccccttcttcaccggcaagcagaagatggtggatactggcggacgcgtcagccgcttcaacaaaaagttcggtttggaaaactaaaagattttgtctttgaacccgtgcccttcccggcacgggtttttccgttgttcccgtcgggaaaaagtttgcccccgacggtgtctgcccctggctttttgcatagactaagccgagtaccctttcatctgcataaaaataggaggcgttaccatgtttcaatccatcgacccaaaacaactgcaggaaaacgtcttttccctcattggtgaccagtggaccctcattaccgccggcacaccggaccactgcaacaccatgaccgccagctggggcggcctgggtgtgctgtggcgtaagccggtggccaccatttatgtgcgaccccaacggtatacctatacctttttggaggagaatccatactttaccctgtcgttcttcggcccccagtggaaaaaacagctggcttactgcggcgcggtcagcggccgggaggaggacaaatttgccgcctgtgggtttcacgtgggggcggcggggcaggcgccgtatattcaggaggccgatctggtcctggtgtgtaaaaaacgctattggaatgatctgaacccggcgcacatggatgaagaggcgttgagcaactaccaggccaaggactatcaccgggtttacattggagagattacccaggtcttggtcaggcaaaagcagattccctgatcttggaaaaaggaggtccctatgaccgatcatacgatggaagaaaagagaaatcacgccgtcctggtggggctccatgccagcagcctctcccaggaggagaacgccagcgacgccaccctggaggaattggaggcgctgctggaaaccgccggcggtgtgtgcgtgggcagtgtgctccaaaatcgggagacccccgaggccagaaccttcattggagaggggaaggtggcggaggtggccgccctggtccaggcccaaggggcggacctggtggtctttgacaacgagctttccccctcccagcagcgggtcctcaccgaagaggtgggggcccaggtcatcgaccgggcggggctgatcctggacatctttgcccagcgggcccggaccaaggaggggcggctccaggtggagctggcgcagtacaaatacctgctgccccggctgacaggtatgtgggggcacctggtccgtcagactgcctccgggggaaaatcccccattggaacccgcggccccggagaaacccagctggaaaccgaccgccggcacatccgccggaagatcgccaagctcaccgaggacctggaggaggtccgccggattcgggcggtccagcgggaccgccgggagaagaatgagatccccgtggtggccattgtgggctataccaacgccggcaagtccaccctcctcaatgccctgacccacgctggaatcccggcccggaaccggctgtttgacaccttggacaccaccacccggacgctggagatctctgacacctgcacggtactgatctcggataccgtaggctttatccgcaagctcccccaccacctggtggaggccttcaaagccaccttggaggaactggcttatgctgacctgatcctccatgtcatcgacgcctccaacccggagtggcgggagcaggccgaggtggtggaggccctgattcgccagctgggggcggaggccaccccgcggctggaggtattcaacaaatcggacatctatgtgggggaaatccgcccccatggggaggatattgtctccatctccgccaagacaggggaggggctggaccaactgctggccatgatcggcaagcgtctggacaccggattttatcgggtgacgctgtctgtgccctatgacaagggcggcgtggtggacatgctctatcgggaggccaaggtggaatcggtggagtacggccagaccattcaggtggtggcggtctgcggggaaaagaccgtgggtcaagtgcgggaatacgtgattgacggctggcagcccagcaaggaattttgggaggactaaggaggcgggaaccatggcagagtattatgtcccagcccgggacagcgagacagaattcacggagaagcgatcccgcttcattggccatgtctggcgggtggagcaggaggaagaagcccgggagaagattgcccagatgaaggccaagcactatgatgcccgccataactgctggtgctacctgatccgggaaggaggcatcatccggtattctgacgatggagagccccagggaaccgcgggccagccaatgctggaggtctttcgccgggcgggagtggagaatgtctgctgcgtggtgacccggtacttcggcggaatcctcctgggcaccggcgggctgctgcgggcctataccaggtcggccaaggacgcgctggacgcggcgggcatcgcccaggtccgtcagtgggcccagacggtggtggaatgcccataccccctgctggagcgggtcaagctggagattgccgccgcccagggcattctgggggaggtttcgtatggcgcccaggtccgcctgcccgccctgctgcctgtggagcactggccggcctacgcggcccggatcacggaactgaccgcaggcaagatcgcggcggagaagctgggggagaccttccaggcggcgccggtggaggcccgctgaggggggcgtgcctctcatttttcagaaagaaaccctgatttttagaaaatattccttttattcataaaaagttttcataggaagcaggaattcgcaaattttttccgtataatttttaggaagaacaggcccttacaacacgaaacgggagggaatgcccatgttcctgcgggagatgacagaagaactggaacgacaaaccttgtccccctacgcggcgctgtctgcggactctcgggggcggcagcgccccatggaaccctgtcagatccgaacctgctatcaacgggatattgaccggattctccactccaagtcctttcggcgtctgatgcataagacccaggtgtttctccagccggagggggaccactaccgcacccgaatgacccacaccctggaggtggttcggatctcccgcaccatcgcccggggcctgcggctcaacgaggacctcaccgaggccattgccctgggtcacgacctggggcacaccccctttggccacgcgggggagcgggtgctcaacgagattcttcccggtggcttccggcacaacgagcagtcccttcgggtggtggaccgcctggaaaaagggggcgaggggctgaatctctgctatgaggtgcgccggggcattctctgccacacgggcccggaccgggccgagaccttggagggacagattgtccgggtggcggataagattgcctacatcaatcacgacatcgacgatgccatgcgaggggggatcatttatcctctggacatccccctggatatctcccaggtgctggggtttgaccacggcgggcggatcaacacgctgacgggagatgtgattcaggccagccagggaaaaggggagattgtccagtcccccgcctgcggacaggccatggcccggctgcgtcagttcatgtttgaggcggtttatcacaacccgctggccaagggggaggagtccaaggcccaggatatgatcgcccgcctgtttgagttctatcagcaaaacccggatgacttgcccccggattaccaggatatccgggcgcgggagggggtagaccgggcggtctgtgactacattgccggcatgaccgacaactacgccgtggccaagtacagcgaggcgtttattcccctggcctggtcggtgaaatgagaaaaacggaaaggaggggaccgcgatggccattccatcgtcatttaaggatgagctggtggcgcgaagcgatattgttgacgtggtctccgactatgtgaccctgactcccaagggggggagctattgggggctctgtccctttcatggggagaagaccccctccttccatgtcctgccggaccggcagctctaccactgcttcggctgcggcaaggggggcggcgtggtctcctttgtgatggagatggagaacctgccctttctggatgccctccgcctgctggctaagcgggcgggcatggagtttcccgagggggacctggacgagagcagccgccggaaacgaaaccgcctgctgaacctgaacaaggaagccgcgcgattctttcacagccagctccacagccctgtggggcagccgggcctggactatctccagcgccgggggctgtccaaagggattatgacccgcttcggcttggggtttgccccggacagctgggacagcctcattcgggccatggcccagaaagggtatgaaaagcgggaccttctggacgcgggtctggcggtgagcaaccaaaaggggagcatctatgatcgcttccgcaatcgggtgatgtttcccatcatcgacctgcggggggatgtcatcggctttggcggacgggtgctgggggagggaacccccaagtatctcaactccccggacacgccggtgttcaacaagagccgcaacctcttcgccctgaacctggccaaaaacaccaagctgggccggatcgtcctgacagaggggtatatggacaccatttccctctaccaggccgggtttgactgcgcggtggccagcttggggacctctctgacggcggaccatgccaagctgctctcccgatttaccaaggaagtggtcatctgctacgacgccgacagcgccggggttcaggcggccaaccgggccattcccatgctggaaaagacagggctgaaggtcaaggtgcttcgggtgacaggggcgaaggacccggatgagtttctccgctccttcggccgggatgcctttgcccggctgttggatcagtcggagaactatgtggagtacaatctgcggcagcttcagagcggctatgatttgacagacccgttgcaaaaggcggagtttgcccgggcgggggcggagctgctggcctccctggacagcccggtggagcgggaggtctatgccggccagctgtccgaaatgactggcgtggggaaagccgcgctgctccaggagatccagcgggtgcaggaccagcgcctgcgcgcggcgaaaaagaagcagacccggcggaatttgacccctgtggcgcagattcagcccaaggcccggcagctgcgatatgaaaatccccggtccgcccgggcggaggagggcatcctccgtctgctgatgctggacgggtccctggtaaagcagacccagggattggaacccggccagttttctgcgccggttctgggaaagatctaccaggtcctgctggagcatctgaagcaggggcggcccctccagctgggcaccctggagggagagctggaaggggaggagattgccctcctggcggacattctgggccagcccacggccctggaaaacggtgccaaggccatggcggactaccgggccgttttggagaccgagcgaatgaagcagcaaaccaccaccgatgaagcggtgcttttggccgcgcgggaaacctatcggaaaaagaaaagtatataggagatggagcacatgagcgaaaaaaaagcaccggagaataaacgggaaaaagaaaaactgattcatgttaccgaggaacagctccaagcgggcaaggcggagatcatgaagattgtggcgggcctcaacggcgcggagaagctgggggacctgctggataaaggccggaaaaagggccgcctgtcctccggagagctgatggaggccctggaggagattgacctggaatccgaacagatggacaagatctatgatgttctggagaacatgggcattgacaccgcgggggaagactacctgcctgagctcagcggggatgacatgccccccattgaggagattgaggagattcccgaggaggagattgtagaccccaataccctggtggactccttcggcatcgacgacccggttcggatgtacttaaaggagatcggcaaggtggacctgctcaccagtgagcaggaggtggccctggcccagaccatggtcaccggccaggagaccaagcgccagctggaggagatggaggccgagggtgtggccctggacccggaggcccggcgggagatggaaaagctggtcaaggcgggggagcgggccaagcagagtctggcggaggccaatctccgtctggtggtctccattgccaaacgctacgtgggccgggggatgctcttcctggatttgattcaggaggggaacctgggcctgatcaaggcggtggagaagtttgactataccaagggatacaagttctccacctatgccacctggtggattcgccaggccatcacccgtgccatcgcggaccaggcccgtaccatccgcattccggtccacatggtggagaccatcaacaaggtcatccgcgtctcccgccagctcctccaggagctgggccatgatccctcaccagaggagatttccgaggagatgaacatgccggtggacaaggtgcgggagattttgaaaattgcccaagagcctgtcagcttggaaacccccatcggagaggaggaggattcccatctgggcgactttattcctgacgaggacgcttccgagccctccgaggccgcatcctttaccctgctgaaggaacagctggtggatgtgctctccaccctcacgccccgggaggagaaagtgctgaagctccgctttggcattgaggacggccggacccgcaccctggaagaggtgggcaaagagttcaacgtcactcgggaacggattcggcagattgaagccaaggccctgcgaaaactgcgccatcccagccgctcaaagaagctgaaggattttctgaactgaacaaacacagtcccccgtggcaggcggaagccttgccgcgggggatttttgtgcccgtggacagaaccgggacaccggcagagagggaaaacaggggagggacaaaaacgcggcggcacgcatactatggagaaaaaagagacggggtgtggatgggaatggagacgctgctgcgctccctttttgagacggggctactggtcattgccttgtctgtggactcctttgtggccagcttttcctatggcgccaatcatattcggatgccatttcgttcggtggcctgcatcagcggaatttgcagcggaagcttggggctctctttgcttgtgggccgcggcctccgatcttatttgccggagggggtcctgccttggatttgctttctgctgctggccgggctgggtattgtcaagatttttgacagctccctcaaggcgctgatccggcggcaccgggacctgcatagacagtggcagttttctgcctttcactttcgcgtgattctgaacatttacgccaacccggaacaggcagatcaggaccgatccggggctttgtccgtgggagaggccacggcgctggcggtggcgttgtccctggacagcttgacggtgggggtcggggcagggttggatcagacgccggttttcgcggcggtgctgctctcttttgttctgggcctggcggccatcctgctgggccgctggctgggagataagctcatgagaggacttcagattgaggtgtcttggatcagcggcctgatgctgctggttctggcgggcctaaagctggtgtgagccagcgcgtccaaattgtatgggagggtttgtacatgaacgagattgatcagaagtttgaagcattggcggcggagattcggggactcagtgagaaggagatttactatcgcatccggaagcactttgaccaagtgccccgtgaaattcagaagagctgcatggactttttcaatcagttcaattattggggcaggcttgacccggagaaaggcgtgtacgaagagatcgaagagaaagggcaggcgctgtttgcacatatggaggactttgtctggctgtatcatcacttgggggactaccggtccaagaaaaccctctatgccattttgaacaactggtaccgctatgatttcaccaccacggcgcaggccaaggagtatctctttgacgactattttgacctggaccttgtctcctgcagcacggaggaggtggttgtggacctgggggcgtttacaggggacacggtgctctcctacctgaaaaattatggccaggactgctataaacggatttactgctatgagattacccccaagatctttgccctgctgcggaaaaatctggagcagtacagggacatcgagtttcgtatgaagggggtggcggataccgagggaaccatgttcctggtcagcaaccagaccagtgcctcggccaatacccttgggcaggagcgtggggaggaggttcctgtgaccactctggatcaggatatcaccgagccggtgacgctgatcaaagcggatattgaggggtttgaacagaaagccctggaaggggcgaagcatcatattttgaacgatcaccccaagctcctcttttccgtgtatcacaacaatgaggacctctggaagatccctcagcggattcaccagatatccccagagtatcgcttctacctgcgcttcaaaagttctcctctctatcccacggagatcacgctgttcgccctctgatggagggggaaaggggcccccgggctggtacgcctgggggccccttttttgaccaagggaaaccgctacctctggagaaactcttccagacacagaccggattgccggatggcctgggcatattcccgcccgacataccggtaatgccagggctcgtaaataatccccgtcttctcctccttgtcagggggatagcgaagaatgaagccgtactcccagcagtgctccatcagccactgctggaccgcggtgtcctcctgggctcggttcagcacttgattttgggtgtccacaatgtccacggccaggcccagctggtgctcgctggtgcccgggaccgccacctccttggccgctttggccatggcctccgaccggctgtttccccgggcgatctgcttttgcaccagattgttgtagagctgggtctgcttttcctgggtccggtaggaggaacagaggagcggtgcatgtcccgcggcgcggcagtcggccagcatggcctccaggtcggcggcgcagcgggagtctacctggtgtccgttctcgacctgggtcagctggggctggtatccttcgggcaggggatgccagggattgaccaggcacaggcgccagtccgccgggtctggggtctcctcttgggacaccggggtgggcggcacagcctgggagaccggtgcggcgttggagtcaggcgagacctcttgggagaggccgaaccagatcagtccgaccgaaagagcggccagcagccccagggaaaggagaatgcggttcttttgcatggaatcttcacctcacagtttgtaaggaaaagataccagggcgctccctccaatacgccgcatttcgacatcaaaacagcatcagacgccggcaccattgaaagaaaggacaaagaaatcccatttttcctgggaagagttggacacggaggtttgactggttcgcagactcaagttgacttgctcccccttctgatcggtaaaaggcaggagatagccggggggatagaggggcagcagggcggaaaactgtgctgcgtccaagttgtagtattgctggcagaattggcgcatttgcacggcgtcctccatggaaaaggcggcttctgcggtgtttgtcgcgggaatccgataggaaaaggccagcattttccctgtttcatcatctaaaatcaggtccaactggtggccggtgctgccggaaaaggagcagttccaaaacactgcggcggagggatttgccgtgtccgcagcgaagtagtcctgggagggggtggattcctgggaggaggtaacggagagattgctcaccgccacaaagggggtggcggaatgcagggtccacagactggggttgaagagctggtccagggagaaaaagcaaaggggatactccgccatgacattcagagccgtttgcgcggcttcctccgcctgctgggcggacagccgggtactggcctgggtcaaggcgacaacgctgtatccattggccgccagctttaagtggtctatgaggtctgccaggtgcaggggggcggtttcatactgcactgtggtgtggcccagtgcccggtcctgccaggccgcccccatccagggcaggaaaaaaccgacgctcaccagcagagcagccaggagggggagaagaaaacgaagggacttcatgggcggcctccttccaaagaaacggtcacggtggttccctgccccagggtgctctcgaaggtgatgcggccttggtgcagcacggcgatcttttcgcacagagccaggcccagccccgcgccgccctgggcccgggcccgggatttgtccacccggtagaaggcctcggtcaggtgggagaggacctccgggggcattcctctgccggtgtcctggacggtgaggcggcacccgcgctcggtcatctggcaggatatggagatggtgccctgggccccgatggccttccggctgttgtcgatgaggttcagcaccagggaacgaaacaggtcaggttccagcagacacagcccaggctcccattgggtggtgaggacaattccctgccgcgccagtccgggggacaggtgggcggtgaggtcctgcagaagatccgccggggcggcgggaaccagggaaagggcctggtgttccgccagatacagctccaagagcttgagggagagccgctccagccgcttgccctcggaaaaaatatagtctgcggcgttggcctgctcctctggggagagagtaccccggcgcagcaggtccgcgtaccccaggatggaggtcatcggggttttgagctcgtgggtaaagctcccgatgaagcggtcctgtccctccatggtggccttgagcgcggcaaaattggcctcctggcgggcggccatggcgtcaaattcccgagccagcgcccccagctcgtcctgggtctgcactccgctgcggcgggacaggtccccggcggccagcgcctgggcggtttgggagagcttgtccagggggcgggtaagaaaccaggcgatactgtacgacaggccggcgcacaccacaaagagaatagcgaaaatctttccgtgggcctgctgctgctgctggcgggtctgatagatggaggagatgtcgtaggccacattgagaatcaggggttccccctgaatctccaactggccggccagttggagatactgcttgcctccataggagaaggccgactgggcgtagtgcgtctcatccacctgctccctcaggtctaagaagccatccgatatacttccttgggagagaaactcctgctctgtctccagggagagggccgaccaggacttgttgccttgggcggacagctgctggagcacctggaccacatcctggggctgggaccagacctctaccgtttctaccaactgcaaggtgcggacgagaagcgcataggcggatctggcggcagcctgttcccgctccagagcgttctgaaaggagaaggagatcagcgcacagctgccagcgccgaagaggagagagaccaggcagaccatgcacagggtggttttcaggcgaaatttcataggggcgtctccagacggtagccgatcttgttcacagcctgcagcgccttttcccagcccacttttttccgcagacgctggacgtgcaggtccacggttttgctgccgtaggccagttctccgccccagacccgttcataaatggtgtcccggtagagggcggcgttggggttgtgaagaaagagaagcagcaggtcgtactctttgggggtcagggagacctcctcctccccccgccagactttccgggcccgggggtccacccgcacccctgccagggagagggtctcctcggttttgtgaaaccggcgcaggaccgtttccacccgggccagaagctcggccacgtcaaagggcttgacaatatagtcctcggcccccaatttcagccccttcacccggtcggccaccgccgaccgggcggtgacgaagatcacaggaagctccagggactggaagtattccaaaagggtgaagccatcggtgcggggaagcatgacgtccaccagggccaggtcatagttcccggcagccgccaggtccgcggcctgatccccatctggggcatggtcgcagagatagccggccgactttagggtcaggcggatcagatcggcaatgggcagttcatcttctacgattaaaattttaggcaatgaaaatccctccttgcttgtgtgcatagcataccacaaaaaggcatccaaacggcaacgaatggtttcccagacaaaaaaaccggagggcatgccctccggttgggtgtttaggacgcggaatccgtccagtgaatctgcgcggtgcaggagccagtttgcagggtatggagctggtccggcagcaccgggacataagacaggaattgcaggaacaatggtgggtctccttctacgccggatagttgaaagcccgggatgggttgtccggaggcatccaggagagcggtgctttccaggagagcatccgggtccaatgtgtcccccttctgtaaggtgacacaggcggagaagggagagaagaagccagttcccaccatggttccctcttggtccgtcagggtagcttcctggacgggagcctgggtctctaccgtccagtgaaacagatgggttgaggtttcaccgtagggatttgacagggacagggtgacctctttgccgggggtgagtacgggttgccggtaggtaatggagagcatatagcgtactgtattttctgagagctgaattccctgctgtccgatgccatcaggggtgttttcaaggggatcggactctgggggcgtctccatggtaaaatcaaaagtcgcgccgccataaaagggagaggaggcgtctgaaacgggaggagcggagaggtccacagggtccggaaaagtgagatccacggtcagatacagcgtcatggcatcccccacgacgctgcggagggtggctgtgacaccgttgttttcactggttatgtccagcgtctgggtgcaggcggccagggtggcctggtccagctggcttaggtccaggtaactgttcagagggtcattggggtccaggcgaatctgggcctcatccccgccgtcggcgggcatggggacggcggtttcctccttctgctgcccacaggcagcacagaacaggaaagccagcagcaagcaggcgagcagaacctttttcatgggggcactcctttctcactgggggaggggctgaacaccgggcagttcttccaacgtggcaatgccgttttccagggcgcgtgtccgcaggaaacggtacatctcggcctgggttgcgtagcagtagggattcacgtaaaagatgccaagaatacccaacgtgcatacatccagcaggtaccagcccagaaagctcaagaaagtaacaaagatgtcccacttgtagccctgggtcatatccaggctcaagcggatgacccgtctgtaatgcaggtgtgggttttccgccaggatgaaggggacggcaaagtaccctaagctgcggatgattcccgggacaatgagcagcagaaaccaaagggcattgaacaagcgccgcaggaactgggtgagcaccacattgccgtagttggcgttgaagccgaaagcaacccgagaaaaaggaactttgtgggttggggaactctccagcaggaaccggcaggcccccacttcaaagggaccgctgaccagaaacaggatcacaagccacgccgtgcccagggaaatggaaaagagggccaagggattggtgtagtattccacggtatacagaaactccaaggggccgtaaagcgcaaggtcttgacaaatcgcgatacagtttgtcaccgtctcatggatccttgtggggaggaaatcccccattagaagcagcaggagaagaatcccccctaccatgggccagtagttggcgaggaaagcggcctttcctgtctgcttatattctaagcgattccaacgggttgtctccatatatgtcctcctttgcatgcgagggggcaaatagggtcaatttcattataggggatttttctccagccgtcaatggaaggatgctgtgcgtgggttttccatgaaaaccaaggagacccttccgccctttctgtgggcttcgccacttgtaatttctgacagattgaggtaagatatggcatcctcccagcatgtggtccatcaagaggacggggaggagatgtgatgtgacaggagaggaggacgccaatgacgagagcggaatgggaagccttggtggaatataccttgaatatcggccggcagatgatggagtgcggcgcggaggcctggcgggcggagaataccatggccaggatttttcgggcctatgacctggaggtcctggatgcccatgtgatcgccacccaggcggcggtgacagtgaagacccccacgggggaacactataccagcacctgcatgatcctgccggacaagaccgggacggatttggggcgcctggagaccctcaatgccgccgcgcggcatatctgtgatgcgccgccgcccttggaggagcttcccctttgcctgaagcggccagtggcccgatggtcctggcgggagctattgggctatctgttgggcgccggggcctttgccatcttcttcggcggcgtcttcttagacggcgtggcggcaggggccatcggcggcgtggtttacctcatggagcaggtgcgccgggtccaccagcaaaacaaaattatctacactgttgtggcctgtttcctggcgggcctgctggcccaggcctgtgtcggaataggctttggggtcaacctggacttgattatgattggggacattatgctctttatcccagggctggtgatcgtcaacggcgtccgggagttcttttacgcggatatcctcaccgggctctatcgcctggtggaggcgctcctcattgcaggggccattgccgcaggctacgcggtatctttgatgatgggagggagcctgtgatgggagaaggcgcgatacagattctgtgcggcggtttggggacgctggcctacgccctgttcttccatgtccgtccccgccatctgctcctggccaccttgggcggtgcgctgtcctggctgctgtatcttctggtgctggcccgggacgggaatgtatttctcagtgcgttggtggcctccatgggggtctgcctgtggtctgagggaatggcccgggtgcgaaaagcccccgccaacatttttatgattcccggtatcatccccctgctccccggcggggcgctgtattataccatgagtgccctcatcggaggggacatggatacggtcatgctgaaggggaaagagactggactgatggccttgggaattgtggtgggcatcctggttgcctctgagttggtccgcatgatcctttgggcggagattcgccggaaaaaaatgctccgtagccgccggacgccgccggggccccggtgaggaagaatctggacttataaaatattccctttttggctctgttaaaaagaccaattcccgttataataagaaagaacggcaaatacgcccggaggaacccaaggaaaaaggaaacgcatcgaggtgtttgatatgttagagcaagtccgaaaagaagcccatgccgccgcccagcagatctgtgaggcagccaaactccgccagggccagattctggtggtgggctgttccaccagtgaggtgaccggtcataaagtggggagttattccagcccggaactggggcaggccatctatgaagggatgcaggaggttctcattccccggggaatttatttggcggcccagtgctgtgagcatctgaaccgggccatcattgtggaggccgaagcagtggggcagggagaaatctgcaacgtggtgcctcagccgaaagcgggtggctcctttgccacggccgcctaccatgggttccggcatcctgtggcgttggagcaaatccaggcggacgcgggcctggacattggagggaccctcatcgggatgcatttgaagcatgtggcggttcctgtccgcctggaacagaaacagattggagaagccattctcctggctgcgcgggtgcgccccaagttcattgggggggaccgggcggtctacgatgagacattgaaataagagaagaacccccttccccagagcggctctggggaagggggttcttcgatgcttggctgccccgctgccgcaccggcagcggggcaggggagtcaaaacaataatgaattacacgaacaatcctttgctcagtacgatcttctgaatttcgctggtgccctcgtaaatctgggtgatctttgcgtcgcgcatgaggcgttccacgtgatactccttcataaagccgttgccgcccagcatctgaactgcgtcggtggtcacgtgcatggcggtctctgcggcgatgagcttggccttggcggcggaggcggagaagggcttgtgttcgtccttgtcgcaggcggctttgtagaccatgtacttggccatctcaatctcattggccaggtccaccatccggaaggccaggtgctggttcttatagaggggctttttgaactgctcccgctgcatcaggtacttccgggcgatctcaaaagcgccctctgcaatgcccagggcctgggaggcgatgccgatgcggccgccgtccagggttttcatggcggcgacgaagcccttgcccggcggggtaatcatattggccacggggacgcggacatcggtgaagtgaagctcactgaccatggcgctgcggatgcccatggtgttgtggcgggcgccgatggtaaagcccggggtatttctctccaccacgaaggtggcgatgctcttgggccccagctcgtggtcggtgagggcgtagacgcagaagtagtcggacagggggccgttggtgataaagcacttgctgccgttgatgatgtactcgtctccgtcccgctgggcgaaggtcagcataccgctgacgtcggagccggcggtgggctcagtcagaccgaaggaacccagatgcccgtcccggagcacagggggcatgaagcgcttaagctgctcatcggtggcctcggagaagtacaggctgccgccatacagagaggtggcaacggagaaagagacacccagggaggggtccactttggagatctcttccacagccagggcgtattccatgtagcccagcccctgaccgccgtattccttggcatagggaagaccgatgaatcccatgtcgcacagatctttgtagaggttcacatcgtactcgcgggtctcgtcccgttcaaggaccttgggagccacctttttctcggtgaagtcacgggccattttctggatcgagagttgttgttcgttcagttcaaagttcatgatggtattgtctccttttttgcattggtaagaaccaactggcctgcttgactgaaagcgctgtcacggacgacagagatctcgacaatcgtttccggccaaggacaaattgtacaggtacacattaccacatggaatcacgaaaatcaacgccgtgactttaattttttcgtgcagaagaaatatttttttcttttcttgcttttcaaaattttcattgagaccggagaattgcctgagagagataaaaccaggcaagcatctttgtggatcattgccagaaccggcaaagatgcgcccaaaaagaaccggcagcgatttcccatatcgctgccggtccttttttaaaaagagagaaaagagagagaaaagagagtgtgtaagtaaagtcagaagtttttgatctctgctgcttacaggtgatatagtacaggagaattgtgaccaaaatattggaatgatatggctaaattatgaattccgtgacggttttgtaaacgatttcttaatcggacataagaaacaggagatgggcttttggatagggggcaagagacaaaaactgcggggaacctgaaatggttccccgcaggggatggacttatccggcgctgctgaccagcccttgttttacggcctgttcgtagctgtgataggcggtgtacagctccatctctgccgcggtgacatcccgcttagcggtgttcagcgtgttcttagcgtccagaagggcgttatccgagaggttgcccagctcgtgctttcgctctgccacggcgtagacctgttcctcataggccagggcactctccttggccgacagcgcggcttgggcgggggcgagggccttgtagagggattggaaggagagttcaaactccgcgatggtggcgtcgttttgatagagggtggactgataggtatactccgccatcttgtactggtagctgttctttccctcctcccgccgggcgtcgtccatggcctgcttggcgtcctccacagaccgggcagaggcatagagggtgtagctgttctccttggccttttccaggtcggaggtataggaaatggcggccagttgtccctgggtgacgtagggggtgctggtaagggtcaggcggcctgtggggacatctcccatcagggactggagggaactgtacagggtggagatggtgttctccagactgtccatggaggccttcagactgtcatagccgctttgggcctgcagcagggtcagctgggagacctgccccaattcatagcgcagctccacttcccgcagggaacgctgggtgctttccatggtctcctgcagggcctccagctgaagctgggtggagaggatggtcagatagagggactccgccccggcaatggtctgggcggcggcatagtcgatttggcgggcggtgtcctccaaggttttttggtagtcctccttctggtcctgcagatcgtctaactggtcttccatggattccaaggaggctttcaagcttgccgcttgcatttcgctatatttaccgagtgcaattaaagaaagtgaatcaaacatgccatcggtaatatcacttacgttagaaattttgccttcagttatggctatttgttttagagtatgctctaaatttttctttgcatttgctaattctccggccccgctgctcacaagcatagagatctgtagctccatggcatcaatggcatcctccatctcgtcgatggcctcatcccagtccatggcctcggcggatttcaggctctcttgcgccgccttcaaggtcaggttgttggcctttacccgagggccgatctggtcgaaggagagggtcccgtctgagggaatggtgaccgaggtgttgcctgtggaggactggggctgtccgctgtcgttgggtgcccgcaccgccgcggcgggtgcggacagggacagcagggcagagcaggttaggcacagggccgcgaaacgttttttcatagggggttcctcctggcgtggaaaagggaatcggttgttagaaaccggacgaaagtgttgctattttagcagagttctatgaagaaactgtgaacagaaggaaaaaatcgaaggtcacccagtgaccttcgatttttttcagcttgcttcgggcttaccgcagatcggtttcctggggcagctcctctggaaacgccaagcaggtgatggagatttcaaatgcggtgcgctcctgggtggtctccccgatggttttgaggtaggtgcggctctgcagccgtccgtccagccagagggcatcccctgtctgaagctggctgcactgcagagccaggctgccccaggcgatgcaggggagatagtcggcccggcggtaacggcggttgaccgccaggagcaggtcgcagatatcccgacccaggggggtgcgccgcagaaccgggggcttgcagaggaccccgtgcaggaacacctggttgcaggggtccccctctcccgggaccacagaccgggccaggacagtgatcaccagccggttgcccaccccgctgcggttgttaaaggagcgaatctccccagtcacctccacgaaggcgcccgcctgggggagggcagtctccggggaggagagggggaagagaatgttcagcaggtcctcccgccccgacaggcggggcactgccaggggaaagcgatagaagtcgatgccgtgtacctgatgggacagaactgcctctccggcgacggtcccccgcaggaccacccggttttccttttgttccatgttcagaccgcctccaaagtttgttgactgtctgaactatatgagctgccggaagaaactatgccggggttttctcagtccttggatttatagtagagcatacagtggcagaatccctcgtaattggggtcggcgatctgatcccgaaactcctgacagatacatttggtggcgggagagacctccagcttgcagggacagtgcccgccctttcgtttcagcccctctcgaatcttggccacaatctctttgtcttcattcaaacgaacgctcatatcggtgcctcctgtgatggttttcagacatagcttaccccaaagccacgtccattaccatcatgacagaaaagcccaccaatgtaaagagggccatccaatctttgttttcgttggtttggctttccgggataagctcttccaccaccacgtaaatcatagcgccggcggcaaaggccagcaggaagggcaggcaggtgcggaccttcagcaccagcagggcgcccagcacggcggcgatgggctccaccaccccgctgagctggccgtagaagaaggactgcccgcgggaatagccctcccggcggagggggacgctcaccgccatgccctccggcagattctgcaggccaatgcccagggccagcatccaggcccctgccgctgtggagccatccagcccataggccagagacccaaaggcgaccccgatggccatgccctcgggaatgttatggagggtgatggaaaagaccagcatggcacagcgtttgaagcccgcctttctgccgctgtcttcccggcggagcagggcccgccgttcgctgaaccgggtgaacagacggtcccccaaaaacagaaggacgccgccgcccatgaagccgatcagcgcggtaagccagggattcatccccagggaagcggacatatcaatggagggggagagcagggaccaaaaggccgcggccaccatcaccccgccggccaaccccagcatggcgtccatcacgttccggttgggctgccgcatgaagaaaaccacgcaggcacccagggaggtgagcgcccaggtaaacagcgtggcaatcagggcctgaaccgggaatgccagctgagaaaagctgtcaagcatagaattcctcctttggatgatttgccccggcgggcgagggggcgtctgcccggcctgggacagtgtatcctatgaagggaggaggagcggggtgcctatccctgtcggaagagaagagatcgttgatagaagcggggagaaaacacaaaaagccgcgcccgtcggagcgtccgacaggcgcggctttttgcgtgtgcatggagagaatcaatattcgacaacgccttcatagaccagtacggcgtcgccggtcaggatgacctcgtggtcggtgtacttgaccaccagatcaccgcccactaacttgactgtgatatctttgcctttctccacaaagccattctctgtggcggcaatgacagcggcgcaggcgccggtgccgcaggccacggtttccccattgccccgttcgtagacccgcatccgcagggtgtcttcgttgacgatgcggacaaactcggtgttgatccgctcggggaagtaggaggcccgctcaaacttgggccctaaggtctccaggtccagggcggagggatcgtcgcagaacaccacgcagtggggattgcccacgctggcgcaggtgatgtgataggtgcccccggcaatctccaccggccggttgatgatggtggagccggggagggtggtgggcaggctcatggcatccagatccgctttgcccatgcctacgctgatggtgttggccttgccgttgcgcgtatagagcagcagactcttgatgccgccggcggtctcaatggtcatgtactcttttttgacaatcctcttgtcatagaggtacttgcccacgcagcggatggcgttgccggccatggcaccctcggtgccgtcccggttgaagatccgcatcctggcgtcggccacccgggagtcctcaatgaggacgatgccgtagccgccaatgccgtaatgccggtcacagagactcacgcacagggagcccgggctggtaatggtgcccttccggttatcaaagaagatatagtcattgccgcagccctgcatcttggcgaagggaagcagctgccgctctttgcgcatgcggttcaggtcaaccagctcggtgttgtccaggtggaaccggctggcgatcatgttggccatggcgttggcggtgtccagcgcggtgatggaggcgatggaatgacggactgcctcccggtggagttcaatgtattcccgaatggtgtcgtcatacagtgcgccagtgtagacgatcaggccgatttttcccgcctccatgagctggtaggcctcggagcccgggacaatggggggaatctcatggacctggatgcccagggaacggatggcgctggcggtgtccgccgtggcgtacatgggcattttcaggtcgtcaaacttcttggccaggccgaccacctcgggcagctcgtggttttccacgctgagcagcacgcccttgcccatgtagtgacggtagccggcggcggcaaagcccttgaacagcgcttcgttgaaggtccggcccagacccagtacctcgccggtggatttcatctcggggcccagaatggcgttggcatcggtgatcttctcgaaggagaagacaggcactttgaccgcgtaatagggggggattttccacaggccggaggggtatcccaatgttttcagagaggcgcccatcataatcttggtggccaggtccaccatgggaatcccggtgaccttgctcaggtaggggaccgtccgggaagcccggggattgacctcaatgacaaagagctctccctggtagaccaagtactggatgttcaccagccccttggtgcccagagccagggccagcttttccgagcactccaccaccacacgcatcatcttgtcggtgaggctgtacgggggatagacggcgatggagtcgccgctgtggacgccggcccgctcgatatgctccatgatgccgggcatcagcacgtcggtgccgtcggagatcacatccacctccagctcggtgccaggcatgtacttgtccaccagaacgtcgtttttgatgccgccggagaggatgacgcccatatatttctccacgtcctcccgcccatgggcgatgaccatgttctggccgccgatgacgtaggaggggcggagcaaaaccgggaagcccaaggcttccgaggcatccagcgcctcttccagggtggtgacgctcatgcccttggggcggcggatgcccaagtcctccaacagggcgtcgaagcgcccccggtcctcggccatgtcgatgccgtcggcggaggtgcccaggatggggatgccctgctggtccaagaactccgtcagggcgatggcggtctggccgccgaaggccaccaccacacccacggggtgctccacttcaataacccccatcacatcctcaggggtgaggggctcaaagtacagccggtcggcggtgtcgtagtcggtggagacggtctccgggttgttgttgatgatgaccacgtcatagcccagctctttcagggtctggacacagtggacggagctgtagtcaaattcaatgccctggccgatccgaatggggccggaccccaggacgatgacggtgtcccggccggtccgggggaagttccgggcatcacagtgctcgtcataggtggcgtagaaatacggggtctgggcctggaattccgccgcgcaggtgtccaccatcttatagctgggggagcggtggggcagggctgctgggtccacccccgccaggcgggccagggtcttgtcagggtagccgtatttcttcgcctggagatagatctgctcggtgagcccgccctgcagggaggcctcgaaagcgaccaggttttgcagtttgcagatgaaccacttgtcaatcttggtgatgtcgtgaatgtggtccacagacaccccctgggacagggcctcaaaaatggtgaacagccgcaggtcatccatggaggccaggcgttcatccagggagcggccggtggtgtcctgggaatggaggctgtccagcttgatttccgccccccggacggctttcatcagggcggcctcaaaggtatgggcaatggacatgacttcgccggtggccttcatttgggagcccaacttccggctggccccgtggaacttgtcaaagggccacttggggaacttcaccaccacatagtccactgcgggctcaaaacaggcgaaagtctcaccggtcacatcgtttttgatctcatccagggtgtaacccagggcgatcttggcggtgatcttggcaatgggatagcccgtggccttggaggccagggcggaggagcgggagacccgggggtttacctcgatgacagcatactcaaagctgtctgggttcaaggcaaactggcagttgcagccgccctcgatgcccagctcctcgatgatcttcaaagcggctgagcggagcatctggtactccttgtcggccagggtgagcgcgggcgccaccacaatggagtcgccggtgtgaatccccaccgggtcaaagttctccatggagcagatggtgatggcggtgcccttgtggtcccgcatcacctcaaactcaatctctttccagccaaagatatacttttcgatgaggacctgggtgatgggggagtagtccaggcccacggagcccacttcccggagctcttcctcattgtaggcaacgccgccgccgccgccgcccagggtgaaggcgggccggacaatgaccgggtagccaatgcggttagcaatggcaacgcaggtttcaatgtcatgggcggtgtccgaggggatggtgggctggccgattttagccatggcgtccttgaacagctgccggtcctccgccttgtcgatggcatcggcattggtgccgatgaggcggacgttgtgctccttcaggaagccttcatggtccagctccatggcgatggtcagaccggtctgcccgcccaggccagccagcaagctgtccggctgggtttccagaatgatccgcttgatggtttccgtggtcaggggctccaggtagaccgcgtcggccatggcgttgtcggtcatgatggtggcggggttggagttgaccaggatggtctccaccccctcctgcttcagcacccggcaggcctgggtgccggcgtagtcgaactcagcggcctggccaatgacaatggggccggagccgatgaccagtaccttcttgatggatgtatccttcggcattacaagccctccttcatcatcgcagtaaagcggtcaaacgcggtcaggcagtccaggggcccgccgtgggcctcggggtggaactggagcgagaacgcgtgaaactcagggtaatctaccccttcacaggtgccgtcgttgacattgacaaaccgcagcttgcctccggtgccggccagggtggtctcgtccacggcatagccgtggttctggctggtgatggagacctcgccggtctccaggtccatggccggctggttggcaccccggtggccgaacttgagctttttggtcttcgcccctgcggccagggccatcatctggtgccccaggcagattccaaacatgggcagcttgccgaacagtttctgaatctgctggatgcagaaggggttgtccgccgggtcacccgggccattggagagcatcacgccgtggtggcccgctgaaagaatctcctccgcaggggtgttgtagggatagatggtcaccttacagccccgggccagcagagagttggcaatgctctccttggcgccgtagtccagcagcgccaccgagaaggcggcctccccttggggcatacggaccgtgacttctttttcactggtgttctccacggactgggtgacacggtaggccttcagcgcctcccagtcgggctggccctcctccgtggtaatcactgcgttgaggacgccgccatcccgaagcagctgggtgagcatccgggtatccaccccggcgatgcccaccacgttctgggctttcagaaaggcgtccaccgtttcctcacatcggaaattagagggggtttggcaatattcccggaccaccacgccgcccatctggcaatgagggctctctttgtccttgtgacagatgccgtagttgccaaactgcgggaaggtgtagaccaccagctgcccgtagtagctgggatctgtcaggctttccacgcagccggtcatgcccgtggtgaagaccagctcgcccatggcggtgccggcggcgccgaagctgtgcccttccagaacctgaccgttttccaaatagagatatgcttttttcatcgtgtccctccatccatgtatcaggaatcaaacggttgtttttttggggaaagtatcggggaaaaacgtaattttctaacgtttaagtataccggaaaattgatccggcgtcaatgtggaactggatgccccggaaaaaaacaatgcgggtaaagtttcgtatattttggtagaattgacgagaaaaagtgaataattatggaaatatacgaataaatattcaatcctcataaaaaaccgggggaaaccaacgcggtttctcccggtttgcggaacctctgtcaatagaggaccatgtattttgcgatttcccagctggaaacgcgggtgcagtactcctcccactctttttccttgccggcgatgtactgggtgtagatatggggccccagcacctccgccatcagggggtcggcctccagggcgtccagggcgtgctccagggaatcgggcaggtcctcaatgccgcaggctgcccgttcatcggcgttcatctcaaagatgttctccgtgatttcctccggaggggtgagctttctctccatgccgtccaggccggcggccaggcagacggccagcgccagataggggttgcaggaggggtcggggtttcgcagctccacccgggtggactgtccccgggcggcggggattcggatcagggccgagcggttggaggcggaccaggcggagtagcagggggcctcatagccgggaaccagacgcttgtaggagttgaccaagggattggtgatggcggtcatgcccttcacatgggtcagcaggccggcgatgaagtgataggcgtcctttgagagctgacggtctccgtcggggtcaaagaagacgtttttcccatccttgaacagggacatattgatgtgcatgcccgagccagcggtgccgtaaatgggtttgggcataaaggtggcgtgaagaccgttggcgtaggcgatttttttcaccgtctgtttgaaggtgatgatgctgtcggcggcgttcagcgcctcggcgtacttaaaatcaatctcatgctgcccggcggcgcactcgtggtgggaggcctcgatctcaaaccccagggcctccagggccaggcagatttcccggcgggtgtggtccccatggtcaatggggcctaagtcgaagtaaccagcctcgtcgttggtcttggtggtgggtttgccgtctttgtccatctcaaacaggaagaattcgcattccggccccacattgaaggtatagcccaggtcagcggcccgccggagcacccgcttcagggctccccgggggtccccgatgaagggggtgccgtccgggttgcacacgtcgcagagcagccgggccaccttgccctgctgttcgtaccaggacaggacggtgaaggtgtccagatcggggtagaggtactgatcagattcgtggatccgggtaaagccctcgatggagctgccatcaatagagatttgattgtttacggctttttggatctgcgaggcggtgatggccacgtttttggcctggccaaagatatcggtgaactgcatgcggatgaagtcaatgccctcttcctctaccatgcggatgatatcgtccttggtgtatttgctcattaagatcagttcccctttcaaacgaaaaaaggaccagtaagcttcgaattccgaagcactcgtccgctcttttaaattatagtattcccaagcaggactgtcaaggaaaaagtcatcggtctgtggtttttcttatattaaaggataggatttggacaggatggcggggaatttccccctctctgttggtaacatagtggaaaaattataaaatcccaggagaaagcggccggaccccattgcaaattccacgggtttgtgggaaaataagcgggtgcaacatggaacatcatgcgggaacccaggcccgctgcaagggaaccagatcaaaggggtcgatgaagatgacaaagctggaacagatttacgagggaaaggccaaaaaagtatttcggaccgatgacccggcgtattgcgtcgtggaatacaaggacgatgccaccgcgttcaatggactgaaaaaagggaccattttggggaagggcgccgtgaacaaccggatgaccaacctgctcatgcagatgctggagcagcaggggattcccacccatttcgtaaaggagctcagcgaccgggagaccgtggtgaaaagggtggagatcgtacccctggaggtcattgtccgcaacatttccgctggtcacttcgcccagaactatggggtggaggaggggatcgtctttgacgagcccaccattgagttttcctataaaaatgacgcgctgggggaccccctcatcaattcctaccatgcccgggccctgaaactggccacgggcgaggagatcgacaccatcgtccgcctggcctttcaggtcaacgaggctctgaaggcatttttcctgtcagtgggcattaggctggtggactttaagctggagtttggccggacgggggacgggaccatcgtcttggcggatgagatctccccggacacctgccgcctgtgggacaaagacaccaatgagaagctggacaaggaccgcttccgccgggatttgggccacgtggaaagcgcctatcaggaggtcatgcgccgcctgctggagaagcagccctaaggccccgacccgggatcagccgcgtgcgccagcacgctgaaaaaggaggaaacacacatgtgtggaattgtcggatttaccggcagccagaatgcggcccccattttgctggacgggctgaagaagctggaatatagaggatacgattccgccggcatggcggtattgggacaggatggcattcagatggtcaaaaccatcggaatgatcaaaaatctggacaacaagacgcagggaggggcggcccttccaggcaccgccggcatcggccatacccgctgggccacccatggggagcccacggatgtcaatgcccatccccacatgagcaatgatgacaagttcgccattgtccacaacggtatcatcgagaactatgcccagctccgggaggagcttaaagcaaaggggttccagttcaagagcgagaccgatactgaggtgattgtgcatctgctggacctctactatgagggtgacctgaaaaaagcggtattgaaaaccgtttcccgcctggagggcgcctatgctctgggtatcctctgcgcggaggaggggggacgcctgattgcgacccgtcacgcggcacccctgatcgtgggtgtgggcattggggaaaattactttgcctccgatgttacagccctggtggcgtataccaaaaacgtcatctacttagaagacggggagatcgcggacattactcccgatagaattaccgtatacgacagcattggtaagaacctcgaaaagtctatcacccggatcgcttgggatattgcagcggcggaaaagggtggttatgaccactttatgctcaaggagatcatggagcagcccaacgccatcaagtccaccattgagccccggattcagaatggagaggtggtgctggacgacttctccctgacggacgaagacctgaggcagatcaacaagattatgattaccgcctgtggttcggccttctatgccggcagcgtgggcaagtatgtgatggaggagctctgccggattcccgtggaggcggacttggcctccgagcttcgctaccgcaatcccctggtggatgagcacaccctgctggtggtggtctctcagtccggggagaccgcggacaccatcgccgccatgaaggagtgcaaggcccggggggcccgcatcctggccattgtcaacgtggtgggcagcaccatcgccaagctggccgaccatgtcatttacacttgggccgggccggagatcgcggtggccaccaccaagggctacaccacccaggtggcggtgctggacatgctggcggtttatttggcccgccgcctgggcaaactggatgatcagaggaacaaggaactggtggaggccattcttcagttcccgagccttattcagcgggccattgacctcaaccccaatctccccgccttggctcagaagtaccacgggcacaacgatatgtttttcattggccggaatgtggactatgccgccagtatggaggggtccttgaagctcaaggagatttcctacctccactcggaggcctatgccgccggggagctcaagcacggcaccattgccctcattgaaaaggaccgtcccgtgatcgccctggcctgctatgaggcgctgtttgacaaaatgatgagcaacatcaaggaggtcaaggcccggggcgcccaggttttggcggtggtgctggaggggaaccggcagatctttgccgaggccgacgatgtgatctttgtcccccggaccgaggccctgttcaactccctgccggagattgttcccctgcagctgtttgcctactatgtggccagagccaacggctgtgacatcgacaaacccaaaaatctggccaagtctgtcactgtggaataaaaggagaaggcgagcatgcgaaactacgcggaagaaacggagaaacgggtccaatttatccggcaggcggtggccgatgcccacgccgacggcattctgtttggcaacagcgggggcaaggactccgccctggtgggtatcctgtgcaaaatggcctgtgagaacaccgagggcatcattctgccctgcagctccaagcggaattttaccattgacaaggacgacgggatggaggtggccgagcagttcggcatcaaaacccgggtgatcgacctgaccgcccagaaggagctggccatagagaccatgtcccaggtggccaccctctcccaggccgccattggcaacctggcaccccgtctgcggatgcttaccctctacgccatcggcgccagtgaaaaccgcctggtggcagggacgggcaacgccagcgagtaccacatgggctactttaccaagtggggggatggggcctatgacctcaaccccatcgcggacctgaccgccacggaggtttttgagttcctgcgctacctgaaggctccccaggcggtgatcaccaaggcgccctctgccggcctgtttgaggggcagaccgatgaggaggacatgggggtcacctacgcggccatcgacaagtatatcaccaccggtgaggccaacgagcatgacaaggccatcatcgaccgctatcacgcccgcagcgcccacaagcggcgggacccattgcggtatcatggggaatgaaatgcgaaatccgccgtcttaagacggcggatttttgcacaagcagcaaggggaggaagcctatgaaacttttgtatgcggaggatgaggagaccatggcagaggccgtggtggatattcttacctaccacaactatttagtggacacagtggccgatggagcggaggccctggcctatgcccagaatggggactatgacggtatcatcttggatgtgatgatgccaaagatggatgggttagaggttcttagccgccttcgagagatgggatgccgtacccctattctattgttaacagccaagggggctgtggaagatcgggttgccggcctggatttgggggcagatgactatttaccaaagccatttgttatggaggaatttctggcccgggtgcgtgccatgctccggcggcgggaggcatttacgccagaaatcctccaatacgatgatgtcaccttgcatggggggacctttcagctcagaaggaatggagaagcagttacgctgcctaagttggaataccgtctcatggaggttttgatacggaaccaggggatttatctctcctcagaagacctgctggtgaaggtctggggctataataccgaggcggaactgggcacagtctgggtttacctgtcctatctgcgtaagcggctggctaagctgggatcacgggtaaagatcaaagggcgccggggcattggttataccctggaggtggggcaatgaagagaacgttacagtggaaattcatccgcaccgctatgatggcggtgactgtactgctgttggttttgctgggcgcgattaatttactcaattggtggcaagtggagcggcagactgactggatgcttcaagtgctgactcagggggatgcgcctcctgtggagccgaaacggccggagggtttcctgccgcctctggacgccgatgataagggggctgcccgattctttcaggtgttctatgatgggacgggacaggtggcctatgtagatgtcaatcagattgccacggtaacaaaggaggaggctgtggactatgctgcccaatgccagggacgggaccagggaacgatcgaccgattcgagtttcgccgggtgtctgtcccggacgggcagggagagcgtattctctttttggacatctcttcaagccggtggtccattctgacggtactggcgatttctgccgggatggggctgctgtgctggctgggaaccttgctgctggtggttctcctgtctcaccgggccattgctcccctggcccggtcaatggaaaaacagcgccagtttgtcaccaatgccggccatgaaattaaaacccccttggccattatccaagccaacacggatgcgatggagcttcatcaggggccgtccaagtggagccaaaatatccgggtacaaacgcttcgcttgacaggattgatggaaaacctattgacgttggctcggatggatgaggtcaaagcccctccggcgcaacgggtggaactgagctctctggcgcaggaggtctgccaatcctttcgggagggggcggcccaacggaatatccaaatggaggaggccattgcccctgatattgtgctacaggccaaccgggagcaaatggttcaattgctttccattcttttggacaatgggataaaatacaccgagccgggaggaaagcttgctttgtcccttcagaaggaggggaaaaaagtccgtctgcgggtgagaaacggccccacgcagattcccgagggagacctgtctcggatgtttgaccgttttttccggggagaccttgcccgcacccaaaagggaggcggatacggcattgggctttccgccgcacaagctatcgtgggggcgtggggaggaaccattactgcgacagtggagggaaagaacacgatggtgttcacagtagccttttgagggggcaaagcggttttttgtaggaagaaccttcatagtttatttacagacgcttccaagaacgttcatcttggaggcgtcttttctaagttaaatctaaagtagttttcgtaaaatttcggtgaagtcacggaaaggagtgaggtccatggacctacgccatgaatggaaacaccggatcaatgtggaggatttgattcttctgcggcagcgactacggctgctggccaagccggatccctatgcggtagggggatgctatcatatccgcagcctctatttcgataccccttcagacaaagccttgcgggagaagctggatggggtcaatggccgggagaagtttcgtatccgctgctacaacagagacttctctttgattcatctggagaagaaaagcaagcggaatggtttggggcgtaaggagaaggtacgtctgaccccagaccaggtgcaagctctgatgaacggggagacaaactggatgatggccagcggcaatcctctgctgcaagagctctgctgcaagatgaagttacaagggctgcgtccccgtactttagtggactatattcgggagcccttcgtctatggccctggcaatgtccgggtgactctggaccatcaactacgcacagggctgcggtgtgtggattttttaaatccagagtgtattaccattcccgcccgggatgccaccgccattctggaggtcaaatgggacgcgtttctccccgacgtgattcgggatgctgtgcagattccccgccgtcgggcagaggcattttctaaatatgccgtttgccgcatgtatgattgagaaaggaactgttttttatgacaacgttcagcgatattttcaagtccagctttatggagaacttgtccagcgtcagtattccagacgcccttattgccttggctctggcgtttgctctggggctgttcatttttctgatttataaaaaaacctatgctggagttatgtattcttcaggatttggggttacgctcctggctctgaccatgatcaccactttggtcattctggccgttacatccaatgtggtcttgtccctgggcatggtgggtgccctgtctatcgtgcgcttccgtacggccatcaaagagcctttggacattgcttttctcttctggtccattgcagttggcattgtcttggcggcagggatgattcctctggccgtccttggcagcggggtgattggggttattcttttggcctttgccaaccgcaaaccccatgtgcgcccctatatcgccgtacttcagtgtgacggccaggcaagcgaacaccgggcggtagagtatttgaaaacccaggttcaacggtgcgtggttaagagcaaaacggcgcagcagggaagtgtggaactcaacttggaggtccggctgaagggtgatggaacagattttatcaatgatattgctgccctggagggggtccgcagtgctgtgctggtcagctacaacggagactacatgggataaggaggcggaccaatgtcaacccacaagcacattgatcgcattgcacttctgataatcctgacggttctggctggtgttctgatcctttttgccggaatgggagccagtggcgaacggactgggatggaaaaagaatatgagaccggtctcttcagtaccgaccaggtccacaccattgagattaccatggatgactgggaaggttttctggaggactgcgagaatgaggaatacgtcatgtgcgatgtgaccatcgacggccagacagtccgggaggtgggaatccgcgccaaaggaaatacctccctgacccaagtcaaaaactatggcaacgatcggtacagttttaaactggaatttgaccattatcaagatggtatccaatatcagggattggataagttgaatctgaacaacattattcaggataacacttacatgaaggattacttgagctatcggatgatgcaggagttcggagtggacgcgcctctgtgcagctatgcgtatatcaccgtcaacggagaggaatgggggctctacttggcggtggaaggagtagaggagagcttcctggagcgcaactacggcgatggctccggggaactttacaaacctgacagcgtcatgagcatgggcgacggggaagtcgggggtgacgttgaactgccggcagacttcgacttttctcatttgacgccccccaacggacagaaagcgggagaggacagccaaacagactctgcccagacccaggcagaacagggtatctcccagggggacatccagggtacggacgactggaatcaggaggaaatgcctccagccatgccccagggagaactgccggagggaatggaagaatttgaccccggccagggcggtggtatggggggcatgagttccgacgatgtgaaactcatttatactgacgacgcgttcagcagctattccaatatctttgaaaacgccaagactgcggtaactgaccaggataaaacccggctgatccggtctttgaaaactctcaacgaaggggaagatatctcttccgtggtgaatgtggaagaggtcatgcgctactttgtggtccacaactttgtctgcaattacgacagctacaccgggatgatagtccacaactattacctctatgaagaggatggtgtgctgtccatgatcccctgggactataacctggcctttggaggcttcctggggggcagcgacgccaccagtgtggtcaatgatcccattgactccccggtctccagcggcagcaccgaggaccggcctatggtagcttggattttccaggaggagacctatacgcagcagtaccatgccctttatgaccagtttatcacgacatattttgaaagcggcgcttttgagacagagtttgaccaagtgtcggctatgattgcaccctatgtggaaagagaccccaccaagttttgtacctatgacgaatttgaaacgggggtttcaaccctgaaagccttctgccagcttcgggcccagagtattcgaggccagctggatgggaccattccttctaccacggatggccagcaggcagatgacagcgcgctggtagatgtttcttccctgtccatttctgacatgggggagggaatggaaggcgcacaggccatcggtggtatgggtcccatgggtggcgaccagggaagggaagaaagacagccgccgggcaggtctgacagcacgcaagaaagggaggcatcccagagtgagggagaaaaaccaaccgaacaagaggagggagggatagaacaggggcggtgagatggcttttcgggagggcaccccaattgacaaggggatgatttcaggggaataaaatcggatttcaaaggggtcccgcgcattgacaaggggggcggaattgagtaaaataaaagagcaagcaagctggacagccgcgggggcaggccgaaaggccgtccgtgaggaaagtccgggctccatagggcaagaataacgggtaacgcccgccgaaggcgacttcaggacaagtgcaacagagagataccgcccggctccggctgggtaagggtggaaaggtgaggtaagagctcacccgccggcgcggaagtgtccggtgctgtaaactctattcggagcaacaccgtggaggggaacatgactggcccggtctccccggggaggtggctggagcgtgccggcaacggcacgcctagatagatggctgtcaaaacagaacccggcttacaggcttacttgcaccaaacccaccattcgaaagacccacgcggtccctgccagcggcggggcctggtgggtcttttgaaaagggaaagatcatcccatgaaggaggaacggcatgcactatccagtgattaccatttccagagaatatggctccgggggccgggccatcggtgagcggctggccaaggagcttggggtcccgttctatgacaaggaactcatctttatggcggccaaggagagcggcctgtcggaggagtacatcaagaaaaccgagcagatgaagtccaccagctttctctatggcctgtacatgagcgcccagcagctgcccatgaacgaccaaatctttttggtgcagagcaagatcatccgccaggtggcccaggaggggccctgcgtgatcgtcggccgctgcgcggactatgtcctgcgggagcggaaggatctgctgagcgttttcatccacgcgccggtggccttccgggcggaccgggcccagaaggtctatgagaaagaggccggaaatatggaggactttgtccgcaaaaaggataagaagcgggccgctttctacaactatttttcccagaataagtggggggacgcccgccattaccacctggccatcagcagtgtctatggggtggattttgccgtggaagtcctgaagcatgcggcggaatccttcccgggggggacggaaaaatgaaccagcagccccaaccggcccaggaaaataaaatgggtgttatgcccgtccaccggttgctgctgaccatgtcggggcccatgatgctctccatgctcatccaggccctgtacaacgttgtagacagtatgtttgtctcttacatcagcgaggccgcgctgaccgcggtctctctggcgtatcccatgcagaacctgatgatcgccgtggccaccggcaccggcgtgggcatcaacgccttgctctcccggaacctgggggagaagaattttgtcatggcgaatcgaacggccggcaacgccatctttttggggttggtgagttacggcgtcttcgcgctcctgggggtctttggctcccgcttgtatttcacggcccaagtggaggaccctgagatcattgccttggggtgcgattacctgtccatcattctggtcctgtccattggctgctttggccaggtccttctgtcccggctactccagtccacgggcaagaccttttacagcatggtcatccagatggtgggggcgggtctgaacattgtcttggaccccattatgatcttcggcctgatgggttttccccggatgggggtggccggcgcggcgctggccacggtactcagccagatggtgggcacggggatggggctctattacaacctgcggaaaaacccggagatccgcctttccctgtccggcctgcggcccagcaagccggtgattgcccggatttacggggtgggcattccgtccattctgctccagacggtgtcctccctgctgatcttcgggctgaaccagattctggtgaccttctccgagaccgccaccgctgtgtacggggtctattttaagctccagggctttgctttcctgcccatcatcgggatgaacaacggcatggtccccatcattgcctacaactacggcgcccgaaaaccggcacgcattatgcagaccatcaagctggccattgcctacgcggtgggcatcatggtggtggccgtggtggtgtttcagatctttccggtccaactgctgggcgtgttccaggcctcggaggagatgctggccattggtgtgcctgccctgcggactttgagcctgtgctttttggtgggcggcttcaccattgtcgcctcctcggtgttccaggccctggggaaggggctgctgagcatgtccatctctattttccgccagttggtgctggtgctcccgctggcctacctgttttccctgacgggagagctcaacctggtctggtggtccttcccggtggcagaagtcctggctggggcgttggcggccttctatctcaggcgggcctaccggcgggtgatccgtccgctggcgcaggaggattaccgcttctgatccaaggggagaatttccttcaggtgtattagaaatgtgtagtataaaaactaagaatttagttaatcagtccgatttattttgttgaaattaggcagtatcattgagtatatagattaatgggtctgcggcaaaggaaagcggaaaaaacgcaaaccagcgccctttcttggctggattccccttaattatattgagaacagttgccctgcctccgggcctccggggaatgggcagtgttttagcttgctctgcacagagcgggcgattttgtcagcgcaactcgaatttattatggaggtagattatcatgcggttactgactgaagaacagaagcattgggtagaagtgattggcgatttctgcaagaaggaaattgagcccatcatgctggattgggacaaggttgttgacccttccaaggcaatcccctttgagccctatgcaaaggcgttcaagctgggcctgaactccttcgagattcccaaggagtacggcggcaacaaggtcgacctggctaccgctgaggttatgtacgaagagatgggctactatgacggcaacttcgcttccgtcatgcagaccaccaacctggctctgaagcccattctgatcggcggcacccccgagcaggttcagtacttctccaagcacatcctggagggcaagggctacgctgcgttcgctctgaccgagccccagtccggttccgacgcttccaacgtgaagaccactgctgtcaaggacggcgacgagtgggtcatcaacggtgagaagtgcttcatcaccaacggcggcgaggccgacatcgtctgcgtgttcgcttctaccgatcccaccgctggcaccaagggcatctctgctttcatggttcccaccagcacccccggcttctctgtcaccaagtatgaggacaagagcggcttccgtaccatctccacctgctccctgaagttcgacaacgtccgtgttcccgctgccaacctggttggtggtgaggctggcctgggcaagggcttcggcttcgctatgaagaccctggacaagtcccgtgcttgcgtgggtgctctggctgttggtatcgctcgccgcgctctggacgaggccattgctttcgtcaaggagagagtcaccttcggtgctcctgtttccaagcgtcagggcattcagtggatgatcgctgacatggccaccaagattgaggcttcccgtcagctggtctcccacgccaacgacctgcagagcaagggcctgcccttctccaaggaagctgctatggctaagatgttcgctacccagtccgctatggaagtctgcaccgacgccatccagctgatgggcggcaagggctacatgaaggaagactgcgtggagaagctgttccgcgacatcaaggcttactgcatcttcgagggcaccaaccagatccagaagatcgttatctctggcgctgttctgtccggcaagggccactaatttacttagtgtttcgcgcttggcgcggaaaacgtgtctaacaaaaagatccagccgatttcggctggatctttttttgctgaaacaccgccggcgcagccggaggaggggagaggttaccgctggggaagacgggctttctttccccggaggtcaaagcgatagatggccacggcaaaggaaatgagggcgcagacctccaccagagcgcagctgtacgcccctgtgatcaagttatacgccagcagcggcggggagttgagaagaaaaagcaggcgggtccggggcatgttgtgggtccacagggccaaggtggtgcaggccatggacaggcaggggagcaggcagtagaggccatcccaggtgagcagggcgcagcccgcgtacagacccagtaggagtgccacccagccccggcttttggcccagggcttatcgttatggtagcagagaacggcccgaaacaacccaacgccgttggtcagaaccgccgtgtaggcccccagcagcccatagtggcaggcccagaggaccgagcagaccatctgaaggcgcagaatccgcagccggctgccactctgcaaagaggtgaagcagacaatggaggggaccaggcccaaggcttgaatggcaaggaaggaaacagcagacataggataccccctgatcagcgtgatggttccattttacccaattttgtggtagagtcataggagaaatctcacagaggagggacgaatatggaacgaaaatccctgggtgaattgttctcttttgacatcaccccctatgccagcccggtgcgttaccccagcggcacggtcattttcccagaatggcagaaggccacccagctgttgtacctggaggagggaaaagcccggtgtaccatgagccatgagaacggcgctgtcaccatcttggactttgtggaagggccgtgttttctgggcgaaatggaacttttgggtgtgcagaaggtaaccagcggcgtcaccgccagaacggattgtgccggctggatgattcgcctggaggaatgccgggaggagatgctgaacgaccctgtttttctccggcagctctgtattttttccaatgaaaaggccatccgcgtcaccagcaccgctgcctgcaatcaaatgtatcctctgaaaaaccgcctggcgaccttccttctccagtcgcagcgccaggggctttactgtgagccccatacccagacagcggcctatttgggggtgagctaccggcatctgctctctgtcctgtccgatttcgtcaaaggcgggctgctgcgcaagaccccggcggggtatgcgattctccgccccgagggtttggaagccttgcggatcaaggacccctttcaactgtgaccgcctccccttgacaggagaagagattaaaagtataatttgtcatacaaatcatactttttggagggattgccatgaaaggacccgaggggacccatgcctggacggtcaccgttggcgccaagggtcagattgtgattcccaaggaggcccgtacgcttttttccattcagccgggggatacgttgctccttttggccgatgaaaagcgggggctcgccatcccggaaaagggatcgtttgcgtcgctgtttcagcaggttttccgggaaaatccccaggtggagccatgagtaagctggtctttttcaacatcccagcctatgggcacaccaaccccaccctgggtgtggtgcgggagctggttgcccgggggaatcaggtctggtactattccttcgcgccctttcaaaaggtcattcaagaagccggcgcgacctttgtcccctgtgacgatgccgcgttggggatgacgccctccccggaggacagcgcccgggtgggcaaggatttggccttttccattgacctgattgtccgcgccacactggccctggatgagaagatctgccgggatatggaacggattgcccccgatgggatcgtagcggattccatggcgttttggggcaagctggcggcccaaaagctggggattccctttctctcctccaccaccacctttgcctttaaccgggcctccgcgaaggtcatggggcaggggatggggaacctgttttccatggtgcgggcggtgccgaaaattcacagaagcttgcgtcgtctgcgggcatacggatatccggtgaaaaatgttttctccattttggagaatgacaacgcgacccataccatcgtctacacctcccgatatttccagccggcggcggagactttctccccgcgatatgtctttgtgggcccttccctccgtcccatccggcagcccctggcgcccagcccacaaaaaaccgtctatatttccctgggcacggtgaacaatcaaaacctgcccttttatcggtcctgcctgacggccttaggggagacgccgtaccgggtggtgatggcggtgggccgggaatcaatgcgccatgccctgggaccccttccggcgaacgtacaggcagaggcgatggtggatcaaatcggggtgctggcggcggcggatgtcttcctcacccactgtgggatgaacagtgtgagcgaggcccttttctttgacgtgcccctggtttgctgcccgcaaacccaggagcagaggggcgttgccaaccgggtgctggccttgggggcgggacttctgctgcccgatgacagcccgcaagccattgcccaagccattggtatagcgctgtccgatcccagttatcgggcccatgccgcaaccattgcccagagctttcgggaaagtggaggcgccccgcaggcggcagagaccattctccaagtgattgcccaagacagggcgacagggacctaagagggggaccgatggcgttgggctttctaccccattcccgtttgtggttccaaagtaaagtttcctgggcgaatggaatggatggattgaaaagcataaaaaggggctgacccaaagttgggtcagcccctttttattaatagatcactgcggtttctaattcacatacggacaaaaatcgtaccatttgggattcagcgcgtttttcgggaacatagactcccgttgggacgcatggaaaaaacggcaactcatgcctgcggagtcagctgccggatgccctgctggacccggcgcagggtctcctccttgcccaagatgtggcacagctccaccgcgccgccgggggtggtggccttgccggagacggccacgcgaaccggccacatgatccggccgtttttcagaccctgggcctcggccaggtggagaagggcgtcgtggatggcctggaaggaccactcggtcatggcctggaagaccggtaccaccagctggagggcctccagcgagttctcctcgttggttttcattttcttatggaggtagagcgtattgctgtattccggcagccggtcgaagaaatccaccatggggggaatctccgtcagggtattcagacgggtctgtaccaggggggccaccagtcgcaggtcaatggacggattggtgatcccctgtttcagatagggctccgccaccgccagaaaagcttccggtgagagggcctttaagtaggcgctgttgaagtagttgagcttctccaggtcaaagatcgcgggggatttggagatccctgtgatgtcaaaggcctgtaccagttcctccagggtaaagaattcctgttccgccagttctccccggggagaccagcccagcagagccacatagttgaggatggcctcggtgagatagccctgggctttcaggtcctcgtaagaggggtccccatggcgcttggacatcttgtgctgggcatcccgcatgacgggggaacagtgaatgtaggtgggaatttcccacccaaaggcctcgtagagcaagttatacttgggagaggaggagaggtattcgctgccccgaaccacatgggtaatgcccatgagatgatcgtcaatgacattggcaaaattataggtgggcaggccgtcccgcttcatcagaacctggtcgtccaaggtgctgttttccacggtgatctccccaaaggaggcgtcggagaaggtggtggtccctgtatgggggattttctgacggatgacatagggcttgccggcggccaactgggccgcgacctcctgctgggacaggcagcggcaggggtcctcagcccggtcaaaatctccgctgtcctcctcagactccgctttctcgcagaagcagtaataggcgtggcctttctccaccagcagctcggcgaatttgccatagagcccccggcgctgggtctggatatacggccccaccgggccacccacatcggggccctcgtcgtgggtcaatccgcactcggccatggtacggtagatgagctccgtggccccctccacctgccgggtctggtcggtgtcctccaggcggaagatgaattggccgccggctttccgggcgatgagccaggtgtacaaggcggtgcggagattgcccacgtgcatgtatccggtgggcgacggggcgaaccgggtgcggacagtccccttggggatctttgcctccagctcgtcaaaccaggtcatatccataggaaaggcctcccaaattaaagtatcgtttttctgggtaatattctaaaattcgcacgggaaattgtcaaggtttatcgcgggaattcttgcacggagggggttgttgtggtaagataaaaagacatgaaaattgagccggatcggctttctgacaagaaaaagggtggattcttgcccacggaggtattatggaacacgagaaaaagattattttcagcgccacacagcccagcggaaagattaccctgggaaactatctgggcgccctgcgcaactgggtttctctgcaggaggactatcacgccctttactgtgtcgcggatgagcatgccatcaccgtccgacaggacccggcggcgctccgccggcagaccctggagctctatgcccagtttattgcctgtggtctggacccggaaaagagcaccatttttattcagtcccatgtgccccagcatgcggaactggcctggaccctcaactgctataccatgtacggggaactgagccggatgacccagttcaaagacaagtcggcggcccacgcggacaacgtcaacgcgggcttgtttacctatcccagcctgatggcggcggatatccttctctaccagaccgacttggttcccgtgggggaggatcagcggcagcatgtggagctgacccggaacatcgcccagcggttcaacggcatttacggggaggtctttaccatgccggaggcctatattcccaaggtcgcggcccgggtgatgtctctgagtgagccggacaagaagatgagcaagtccagcaccaatgagaattcctacatcctggtgatggacccgccggaggtcatcctgcgcaagttcaagcgggcggtgaccgacagcgagggcggcgtctatcgttccccggataagcccggggtctcgaacctgattgagatttatgcggcggtaacgggcaagagcccggaggcggtggagcaggaattctccggccagggctatggcgcgtttaagcctgcggtaggagaggccgtggtggaggcactccgccccattcgagaggagacccagcgcctgctggcggacaaggcctatttggagagcctctaccgccagggggcggaaaaagccgctgccatggcgaaccggaccctgcgtaaagtgcataagaaggtgggcttcgttccccgctgacgggggagcggctcagacctgcctctcgcggcggtccccaacccctaagacccaaaggagtgttacaatagaatgacaatggaattgccggccatcgcgcggattgcagcggcgctggtggctgctctgctgatctccttcattgccacaccggtggtgaaatccattgcccagatggtgggcgcggtggacgtgcccaaagacaaccgacggatgcacaaccatcccatcccccggatgggcgggttggcgattttcctgggctttctcctcagtaccctgatttttgtgcccatgagctcctccatgcgggggatgctgctggggggcgtgatcatcgtgatcctgggtattttcgacgacatctacgccctgcccgccctgcccaagctgctggtgcagattgcggcggccctggtggcggtgctccatggcaacgtgatccaggttctgtccaaccccaatattttcagtgagaatccctactggaccttgggctccctggcggtccccctgtccgtcatttggattgtggccatcaccaacgcggtcaacctcattgacggtctggacggcctggcggtgggggtggcgaccatcagctccctgaccatgctggtcattgccatgctggtcagtgagaatgtggtggcgctgatgatggcggcgctggccggagggtgcattggatttatgccctataatttgaacccggcgaagatttttatgggggataccggctctaccttcctgggctttgtcctggccacggtgtccatccagggcctattcaagttttacaccatcatttcctttgcggtgcccttcttgatgctgggcctgcctctgtttgacacctgctttgctatcctgcggcggttggccaagggccagagccccatggcgccggaccgcagtcatgtgcatcaccggctgattgacatgggctttaaccaaaagcaggcggtggccatcctctacgtgatcagtgccattttgggcctgtccgcggtggtcctcaccaccagcggggccttgaaagccatggttttgctgtgtgcgctgtgcctggcggggctgatctccgggaaaatttttctcagccacaatgagaaccaccaggaaaaaacaaaagaaaaggagtccaatgaccatgccattgaaagtcatgacgatcttcgggacccgcccggaggcggtgaagatggcccctctggtaaaggaactggagagcagagctgagattcagagcatctgctgcatcaccgcccagcaccggcagatgctggacgacgtgctccagctgtttgccatccaaccggactacgatctggatatcatggaggctcgccagagcctgtacaccatcaccagcaagtgccttctgggaatggaggaggtcttttcccgggaaaagccggacctggttttggtccatggggacacgtccaccaccttttccggggcgctggcagccttttatcagaaaattgcggtgggccacgtggaggcgggcctgcggacctgggacaaatactcccctttccccgaggagatgaaccggaccctggtgggcgacttggcggagttccatttctgccccacccaggcaaaccgggagaacctgctccgggaggggctccgggaggggattttcgtcacggggaataccgtcattgacgctctgaagacgacggtccggccggactatcgcttccggagccagctgctgaataccttggactacacgagaaaacaagtgattttggtgacctgccaccggcgggagaactatgggcagcccatgaccaatatcatgcgggccctccgccggatcgtggaggatttcccccaagtggagcttgtctatccggtgcatctgtccccggtggtgcaggaggcggcccgggcccacctgtccggccacgacagaatccatttgatcgaaccccttaccccggatgaaatgcacaatgtcatggcccggtccgcctttgtgatgacggattccggcggactgcaggaggaggcccccgccttgggccggcccgttctggtgctgcgccgggagaccgagcgccctgaggccgtggcggcgggaacggtgctgctggcggggacggaggaagacgtgatttacggccatgccgcccgtctgctgaccgacccggccgcctaccgcgccatggcccaggcggtcaatccctatggagacggtcaggcctgccggcggattgtggatgccatcctgtggaagcgggggctgcgggaccagccgccggaggaattctccgccggatgatgggccatcgtctggagcagtcaggaaagggggtgggctgtgttccatggaccagaagaaccggaccattttggtcctcgccattgcggtgactgtgtttgccgcggtctttgtgagcctcggcctgcctgcgctgacaggacgtgcgccggaggtggtactccccgatgtcaatcaggaggctgtgagcacggaggggagagacttcttgccggtggaggttcggccggatacggtgcagagtgtcatcgtcagtctctcccgcccggagagttattatcgccaactgaccgtccgtctgttctgggcgggaggaagctccgccgacccggtggaaatttgggcggacggagggtatgttcgtacggccatcaccacagggggaagcacccaataccggctggtgggggagggaaagctccgcctttggtatgccggggaccgcgcctggcaggaggtggacgccggggatgacaccgctgatctggcccagcggattcccacctatgaggatgtgctggagctggatacagaacagattagcgcggccagctatgaggagaaaaacgaggcgtactgtatctttgtggaggtgaaacggtcccaggacgtcctggatcgctactggattgacacggataccgggctgctctgcgcggcggagacgtatgaggaggataccaaggtctatgagatgacggagacccagctgcgtgccccgctggaggatggcatcgtcttttctctgcctgacggcaccatcctccatgagagctcaagtgtcactgtcccggaggaatagaaaggccagggccagcaggaggaccagatcaaaatgatccccttcccgccacaggagaaagaggatcagcagaagaaggatatctccgctgtccagttttcccagccccaatttgcccagcaggccggacagcccgccggtgcctttggagcccagcagggaagaaaacatagactcaaatcccgggggatgttcctccgggattttttcatagggaccgcctcctggtatgtaggcattataaatggagctcaccctctttccataggcggtaggcctgccgggctgcccgagacagcccggccagttggatggcttggtccagctttttctggcgctcctcccgcaggaagggccggagcgcggcgatcagggcgtcggcctcctggttggactggcggctggcctggaacagctccagcaggcggcccatctgccccaactgctctggggcgaaggggggcggggcggcggattccggctggggggccgcttccccgggggaaggaggggactccgtccccatccccagctttccggccagggacatgatctgtcccatggcgtcagggtctgccagcagagagttgagtgcttcttcaaagtcggccatggggaatcccctcctttcaaacggaccaggcggattacttgtttaaggttttgttcagctgctccatggccttggcggcttgggggtctgacgagagctcctgcagaacgctgctcagggcagtggtatccccctgcagggcggactgcgccgcggcctgcaggcggcccacgttctttttttgcagggactggaggaccttgcgggtctccgggttggccagcatctggcggatggccttctggttttccaacagctgcttggcctggggattggaactgagttgatctgcgaaattttgcataacatggtctccttccgggtattgctgtcccattatatgagccgagggagatggatgtgcctgtcagagtgcagaaaaagaaaattgggtctggaaaaaccgcaaggagtgtgctatgatcgttccatcttcctgtttcccggaaattcggccagaaaaccgggaaaagggaattcctggtaaggcaataggaggaaacacgacatgctgatggccattgatgtaggaaacaccaatatggtgttcggcctattggaggggaaggaactcgtggggagttttcgcctgatgacagacgccaaccggacctcggatgagattgggctgacggtgtgtgaatactttcggcggttcaatctgtccacggaccaagtctgcgatatcatcatcgcctccgtggtgccccaggtgatgtatacgctcaccagtgccattgtcaagtattttggaaaaaagcccattctcattgatgatgatgtgtcgccgggcatccagtatgaaggggaggaccacctgggtgcggaccgggcggtctcctgtgtggcggcgatggagaagtatggaaagcctctggtggtgctggactttgggaccgccaccacagtggatgccctggatgagaaggggatctatttgggcgggagtattttggccggggtccgggtctccacggacgcgctgttccgccaggccgccatgcttcctcggattgagctcattcgtcccgcctccgtcctgggccagaacaccattgcccagattcaggccggttctgtcatgggctacatcggcgccattgagtatctcatccgccataccaaggcggagatgggatacggcgacggcgtgaaggtggtggccaccggaggcctggcccgtttgatcgcggacaatacggacctgatcgacgtggtggacagccagctcattgtggacgggctgcggatcatttatgagcggtatcagaaacaacgaggaaagtgaaaaatatgagtgacctgttctcctttttcatggagaacaggtcatttttttcttgataaactatgtcagaaataataagaagtcagctatcaaaaggtataccttttgatagctgactgtctttttgcattttacagtaaaagagctggaaaatcaaggcgctttttctttcctttgagacaaatcgataaaaattaacggtttttttcttttctttgaaaggtgtcgaaaggtataccttttgacatcaaaggactttagatagctgtggatcaaaatgcccaacagatttgatgaaagaaagggaggaaataataagatgaaaaagcgaatgctgtcaacgctcctgacactgggtatgttgttgacactgaccccggcagtgttagcggaagtcccggaggggtccgccggagatattccagaggagacttgtaaagtcgagtataaggaacagtcggatgggatagagattcaaacagagaaggattcaaataatattattcatttggatatcacaatcaatgagaccgctccctctaatgttgttctggattttagtagcgtgattcaggaggccgaaaacattacctacatgccgggtgctattcaaaagtttaaggttcatattaaaaatcaatcaggaaaaaactatcaatataaagatggcagctttgtattgagcacagcggataccgatgattttggcactttggaggaaggtgcactgcttccgttcttggggtatgatggccaatatatcccgattactgcggttggctctatgctcccccaatatttctatcaagatctttttgggaaagcgtcttcagcagcggtaacctttgaggaaatgtgtcaaatttttgataagctggaagagaaggggtatgagggagaaaacccgttggatagttatatgctggagtacttaaataagaaactcaagacggattgcggatcaatggaagaactgtatttagaaaagccaaaagaggtatcttcgatattatttagttcaggagttactcataacggcatttatacagtcaatgagcaagacttacaaaagtatattagtgagtatccttggcttaacacttacatttatgctcagaggagtgctcagggaaacttgaacgtacaaataaaatggccctcagaagtgctggcaaaaatcagctatgaccattggtatcagcgcctgttccagtttgcatttgggcaggaaaatatagaaaagctgaagactaatacagcggatgatccttttacgaacgcgcacgatgttgcggattatacgatgaatgaagaaacctatggggaagcaaatgaatattttaaagatttgctgtatgcagatgcgttaaacagcaacgaggagaccgtttttgacatggcgtttgcgttgaatggaccattgatggggaatgtctatcaaaactactcatttagttggtacaacgtgattgagcttgaggagattgaacctgtcaccataactcctgctgacatcactatctataccggcggcgagagctatgacagcgtggtaaacggcagtgggaacgaaattggcgcggtgaataatggactgccgacacctggcttctatattgatttaccggaaagtgtgaatgcgtggctgcttgaacatgttgacaaagagaatatcattacaactgagagcggaaagcaaatcgttgacctgtctaaatttttgacgttcacctataactacgctggagaaacaagaacatgggaactggaacgatacgacacgcatgacaacgaaaacaacagcacggcgtatgatcggtttatttaccgtattaagcctgctgtcgtggagaatcaggaaatcccgatccggttgcagtttacggatgaaaatggcatgttcatgaccagtgatgattttactgttgatttggaggatttgttccatgagtatgacatgacgatttattccggagatctggagacacaaaaagtaaaggctgtcctcagagttggagagcaggttgtctcgtacgctgctgaagtgggcgagggaaaactcactgtgcgcggtgtaaccgatcagaacacggcaaccacagaggtggtaacggaggtgccggtcgaagaagtggataacatcacggcgcatgtgccagaagacacactgttttacatcaatgagagtcagcttgaagtggccgaaccggagaatgtcaaactgctggtggacagcatcgtaccagacgaagacaacacgctgtataccaaagcggtggacgggtttgaggagattacatctgagcacaatgtaaaatttaactatcttgatctggtggataccggcaacggaaatgcgtatgtgacgacagcaggaaaaccgattacggtttactggccgtatccggcgggcaccgacaagatggatgagttccatattgtccattatgagggcttggatcgaaataataacacaagtcttgcggacggagaatatgatatggtcttgtattctgaggagaatggcaacttggaaaacacagatcaagggatcaggatcacggtagagtcgttttctccctttgctctgttttgggaggaggactctggcggcaacggcggtcacggcggcaatggcggcaacaagcccagcctgaacaccgaggaccactacggctacatcgtgggctaccccgtggactatgccactggcgagcccaccgacgaccaggccagaaagcccgtgaagccccaggggaagatcacccgggccgaggtggccaccatcttcttccggatgctcaccgacgagagccggaacgcgtactggagccagagcaacagcttcaccgacgtggcggcggacgcctggtacaacaacgccatctccaccatggccaacgcgggcatcctggacggctatgaggacggcagcttccaccccaacgggtatatcacccgggcggagtttgccaccatcgcggtgcggttcttcgacctgagctaccagggcgaggacctcttcccggacattgacggccactgggcccaggactacatcaaccaggccgcggatgcggggatcatcgagggctatcccgacgggaccttcggcccccagaagcagatcacccgggccgaggcggtgaccctggtcaaccggaccctggaccggcaccccgacccagaccacttcctggaggatatgctggtctggccggacaacctggacaccaaggcgtggtactatgctgacatgcaggaggccaccaactcccacgagtaccagatgaaggaggacgcccagggcaacgagtatgaggtgtggaccaagatcctgcccattcgggactgggaggccctggaaaaggagtggtcggacgccaactcctccgagaatcccggcgacgttgtctaatagcacaaattttgttttgccagaggagggccctaaaaggccctcctctatttaaggtggggaaaggaaaagcacaccacgggaaccgtggtgtgccaagaaagtagatgactatgcgtttttttgaaagtgatcgcaccagggacggagggtacagttggggcagtcgggcttgcgcgcccggcagaccgcccggccatggagcaccagacggtgacagaagtcgttggactcctccggcggcaggcaggcccgcagctgcttttccaccttgccggggtccttggtgccgtcggtgagccccagcaggccggtgatccggatgcagtgggtgtctgccaccaccacgccgggggtgtggtgaacatcgcccaaaataaggttggcggtttttctgcccaccccgggcagggagagcagctcctccatggtgcccggcaccttgccatggaattgttccagcagcatgcgggaggcaaagacaatgtccttggccttggcccggaaaaagccgcaggagtggatgtagggctccacgtcggccggctctgcctccgccagggcctccagggtggggaagcgggcgaagagggcgggggtcacctgattgacccgctcatcggtgcattgggcggagaggcgggtggcaaagagcagctcatagtccttttggtattgcagggaacagatgccatcgggatacaagtctttgagtgcctggacaatggcgtgaatatccttggaatttttcataaaaactaccgattcctttttctctatgggttgtttttcgtataaatagtatagcacaaagtggaaggatagtcattggattttttttcggtttggagtataataagctggaaaacgcaaacccgccatcatagaaatttgaatgtaaaaaggagcgagtatcgtggtcaaagatgtcatcgatttcctgatccagcaagatccccaggtgggcaacgccgtgcaggcggagtacgaccgtcagcggagaaatattgagctgattgcctcggagaactttgtcagcccggccgttctggcggctgcttcgtccgtgctcaccaataagtatgccgagggctatcccggcaagcgctactatggtggctgtgaatgtgtggacgtggtggaggacattgcccgggaccgggccaaggccctcttcggcgcggaccatgcaaacgtccagccccacagcggcgcttcggccaactacgcagtgtaccaggccctgtgcaacgtgggagacaccgtcatgggaatgaacctggacaacggcggccacctgacccacggcagccccgtgaactattcggggatcaactacaagattgtcccctatggcgtggaccccaaaacccaccgcatcgactatgaccaggtccgcgacctggccaaacagtgcaagcccaagatgatcattgccggcgcctccgcctatccccggatcattgattttaaggctttccgggagattgccgacgaggtaggcgcctatctcttcgtggatatggcccacattgccggcctggtggccgcggggctgcatccctcccccgtgccctatgccgacgtggtgaccaccaccacccataagaccctgcggggtccccggggcggcgtgattctgtgcaaggaggagcatgccaagaagattgacaaggccattttccccggctcccagggcggccccctcatgcacatcatcaccgccaaggccgttgccttcggggaggccatgaagccggagttcaagacctaccaggagcaggtgctgaagaatgccaaggtcctggccgagagcctcatggatgccggcttccagctggtctccggcggcaccgacaaccatctgatgctggtggatctgcgcccggccaacatcaccggcaaggagatggagaagcgcctggaccaggtgaacatcaccgtgaacaagaacaccatccccgacgatccccagtcccccttcgtcaccagcggcatccgggtgggggtccccgccgccaccagccgcggtctgcgggaggaggacatgaaggtcatcggccagctcatttggaagaccgccacagagtttgacaccaagcaggaggagatccgcgcggcggtggcggagatcacggccaagtaccccctctacgagtaagccctgtccgccgggggaaaattctccctttacggaaggggtcacagctgataaaataaggaggacgacgcaggtcgttctccttgtttttatttcgactatgggaaagagagatgagcgccatgtaccagcccctggcagaccggcttcggcccaattccatcgacgaggtggtggggcagcggcatatactgggggagcagggggttctgcggcggatcattcaggggggaaatatccccaatctgattttttacggtccctccggcacgggaaagaccacggtggcggagatcgccgccgcccagatgcaccggcccttccaccgcctgaacgccaccaccgcctctttagcggacatcaaggccatcaccgcggatgtggggactctgctggcaccggagggggtggtgctgtatctggatgagattcagtatttcaataagaagcagcagcagtccctgctggagtttatggaaacgggaaaactgaccctcattgccgccaccacggagaatccctatttctacatttacaacgcggtgctcagccgggccacggtctttgcctttcagcctgtgtcgccggaggaggttctgccggtggtgcttcggggaatccgggaaatgagccaggaccggcaggggcgggtccgctgggaggagggggtggccgagcacattgcccgcagctgcgggggggatgtgcggaaagccctcaacgcggtggaggccctctttgcggcccatgccatggaccggggcgagacggtcctgaccttggcggaggcccaggtggtggcccagcggtccgccaaccgctatgaccgggacggtgacagccattatgacattttgtccgcttttcaaaagtcggtccggggctctgatcccgatgccgcagtccattatctggcccggctgctggaggcgggggatctgatctccccctgccgccggctgatggtcatggccagtgaggacgtgggcctggcctatccccaggcggtggcggtggtgaaagcctgtgtggacagcgccaatatgctgggcctgcccgaggcccggattcccctggcccaggcggccattttcctggccaccgcgcccaagtccaacagcgccattctggcggtggagggggcgctggcagacctgcgggcgggacggacgggggaggtgccgccgcatctccgggacgcccactatgagggggcggcccagctgggccatgggacggggtaccagtatgcccatgggtatcccaaccactatgtgaaacagcagtatctgcccgatgccctgaaaaaccagacctattacacctatggggaaaataaaaccgagcaggccgccaaacagtattgggaccggatcaagggggaaggctaaccgaagaccgtctgtattttgtgtgccaggcgcccagggggggaatagtcccagcgggagagttgaccggatgtgataaaataggaaagaggttccggccccggctctggctccaggcggtgaatgagggtgagcttgatcttcatgcggtccggcaggatggctttgatgtagacggacacccggtcgtcttccgccagtccttcggtctggtctgccaggccggtgaggttgggggtcagctctacaaaagttccataggatttcaccccccgcacccagccggccacggtcatgccgggggaaaaccgggcgacgttctccagccaggtgcccaaaagctccttgtgggagagaaagagccgtccctggtcggggtcgctccctgtgagcacggtatagatttcctgccccacggtgaaccggcgggcagggtgagagatgcgggagacggagcagttttcaatcccgatgagagacaccaccccgcaccccacatccacaaaggcgccgaagccctccaggtgggtcacggtggcggggagaacggtgcccggcgggcagcggagcagttctgccagagccagctcctgggcccggcggcgggagagggtgagttggggcggcgcgccctcagccaccccggtgacggtgaaggagatgggctttcccacccgggagagaatggcgatttcccgggcggttccctcccggatgcccagggcggcctcctcccggggaatggttccggtgaaggggcccaggttcaccagcagatcgtggcccggggtgcacaggacggcccggccctccagcacggtttcctgctccatagcttggcggagggaggagagggtctcccaggcggcttggttttctggggtgtggagcaggcgcccttctgggagatacaggttggacatacactgccttcctttctgattccatgagtgagacgaagtctgactcaatgatattcacatgggggccaaaaattgccccttctttttccaatggaggtgttgtaccatggatattcaacccggcgacgtgctggagatgaaaaaggagcacccctgcggcgcccggcggtgggaggtactccgggtggggatggatttccgcctgcgctgcaccggctgcggccgggaggtgatgctcccccgaaaaaaggcggagaaagccctgaaaaaaatcatttccccggcggaccaggctggggaggacaggaggaatccctatgcgttatgaaggtcagatttatcggcccccaggagagtggcgcagctatctgctccaatgcaccatcggctgctcccacaacaagtgtaccttctgcggcatgtataagaccaagaaatttcacgtgcgtcccatgaaggagatcatcgaggacattgccatggcccgggagtattacggtccggagaacgtggataaggtctttctctgcgacggggacgccattgtcatgcgccaggcccacctgctgcagattttggaggccctgtacgcggccttcccccatctgcgccaggtgacggtctacgccggcacccgcagcaccatgaccaagagccaggaacagctcattgagctgcgccaggccggcctcacccgggcctatctgggggtggagagcggctgggatgaactgctgaaaaaggtcaacaagggggtcacctccgagcagatgctccaggccgctgccctgctgaaaaacgccggcattgacctgtgggtcacggtgattctgggcctggccggcccgggagagccctccaagaagcacgtggaggagaccatccgggtgctcaaccggatgcaggccaaccatgtctcctgcctgtcctacatgccggagcccaactcccccatgtaccaggatgtcaaggagggacgtttccagatgattaccccccgggagtacctggaggagacccgggccctggtggccgggctcaactatggccccttccatttcaccagcaaccacgcctccaattatctccccctcaagggaaccctgccggacgaccgggagaagttcctgtccatgatcgacaacgccctgggggggaagcagcggattcgcagcgaatattcccgcgccctttgaccccagcgaagaaaagaaaaacccacggcggtttctgtccgccgtgggtttttctatgccaaaaagaaaataatatgagatatgttggtacaatagagacaggaaaaaggagggtgctgtctatgtaccattggatgacgcaagcagagattcagcggttcctggcccatctgcgccgggaggaacggagcccggggaccctggccaaataccgccgggatttgctggcctttgccgcccggctgccccaaggggggcgggtggacaaggaacaggtgctggcatggaaggaggagatggcccggcggtatgcccccagcacggtgaacagcatgattgcggccctcaacggcttttttgcctttcagggctggcacgggtgccgggtgaaggccctgcgccagcagcgggaaatttttcgggagaaggcccgggaactggacaagggggagtacctggccctgctggccgccgcccgacggcggggcagccagcggctgtatcacgtgatgcagaccctgggggccacggggattcgggtctccgaactggtgtttgtcacggtggaggctctggctgccggccgggcgctggtgcactgtaagggcaagcgacgggcggttctgctgccccaaaaactctgccgggcactccagggatactgccgggcccggggcatcaccgccggtccggtgtttgtgacccgcaccggacgcccggtggaccgctccaacctgtggcgagagatgcaggccctctgctcccgggccggggtggaggcccggaaggtcttcccccacaactttcgtcacctgtttgcccgggccttttacgccctggacaaggacctggcgaagctggccgacctgctgggccacgccagcatagagaccacgcgcatctatattatggagagcggcgccgagcataaacggcaggtggaacggctggggctgattctgtaacaacgaaattcttattccgttgtaacaaataagccgcaagatgatatactgattgagttacttacaatatatcacagatcaaaggggaaatgcaagccagatatttgataaaacgcacaagaaaaccacctgaagaaaacagtcgatctttcttcaggacttttttgcacctatttttgcgaagaatggagaaagtcttcctctgggttatgctctcatttcttttccttggctgtcgaatgacaacggaataagaattccgttgtgcgccgcattttttcgtttggcttatttacaacggaataagaattttgttgtaaccatacggcgggatgaaaaagtaagagaagggagtttacacgatgagtacaaggaaaagacgctggggcgccatattgcttaccgtctgtatggcgctttccctgatgacgacaggggcgcacgcggcaggagaggaaccatctgcggatttttcagcccatgaagtgaatgtggaagatccttacccggaaggggtgacggtggatctgtttgattactggttggaagaccaaaacagtcccgacagtcagaggatgaaaggtggggacagtggtaaatataagaatatgggaattaaccaaaatcacgccttaaaattcctcaacgatgcaacgtggggcacctataaccagtggaccgggaatgaaggaccctataccggcattgtgtcgtccctattgggggaggacggatatccccatctaaacgaagagaaaatagaaagcggcgagtccctgtcctatttgttcaacggatttgacagtcgggacacgagggagaagaaggtcgagggaaaagccgcctatatggatgtgggcggactgctgcagcgggatcaggagggttattattactacgattgtacaaaaaactttgccagctttgatgaaaatgagaatcagtttacactttatgagaaaggcggcgtaaaagaaggcacagaggaaaacgctcgctatcagtttttcccattcaatacggcagagcaagtttttaacataagcggcggtgagttgaacgataaagaattagagggtagcgagagtgctccggcaagaaaggatatcatcaatcattatttcggcgttagcatggtgacccgttttgtacagacgaaggatggcaaatctccgtttgattctacgaagccggtaacctatgaattctctggggacgacgacgtgtggattttcattgatggtgtattggtggcggacctgggcggcatccacaatacagcatcggtaaaaattaacttctccacgggagagattgatgtgaacggaggaaaggattctgggaaggaaggggcattgtccacaacactcaaacaggcgtttaagagtgcgggaaaaaatggggacgatgatgattgggatgaaaatacctttcgggaaggcaccttccataccttgaatttcttctatctggaacgggggaacggggcgtctaacatgagcctcaagttcaatatgaaggtgatcctggagagcgagatcaaaaaggtaagtcaggattatacggctgcggggactgcggagggggtagcaggcgcaaaatttgcactctatccggcggacgagagctgggatattatagatggataccagaacgcaccctatgccacaggaacaacggatgagaagggcgagtttatcttgctggatcaggagaacgtcccgctggtacccagtgacctgcaaggggtcagttcttactgggtacttcgggagacaaaggtgccagagggctatcggggcatagaagaggttcattttcacttgcagagcaatgacagtggataccccatccttttgtctgacagcacctgggacgtgggcgcctatgccatgtctaaggtgctggcgacggcccgcacagtgagtggggaggagcccggcgcaaaatatgtggaaacaactgaagagggaaaagtcaaagtccttgatagtgagggcaaacctgtgggcaccatgttttccgtgattctaaagcggccgaatgatttccgaggaacgtgggaagaacttactttgaaggatttgacagcggtgtccgggaatccggaaaaaggttggaaaatccatccagcggggatggaaggtgttctcgaggcggcccaggagaactggtatccatttaagctgggcactgagttcacctgcgccattgaaaatctgcctggagacattgaaaagtattacttggtagcagcgaaagatcagaagcaacaggcggagtataccggcggttatttttacatcaatcaaaagattacaagtgtcgaagcgttgaaggatgtcgatgtcgaggacattgtcatgctggacccctatgacttccagcgccagtttgcgatgagcctgtatgtgcccaacatccaaaaccgcctgctggtgcagaagacggacgaggagggggtacccctggatggggcaaagttttctctgtataaacaagaggatatcacagttgatgaacagggtaattatcaaatatcagaagagaaaacaccgatcacggtggaaaatacagaaaaaacagagacgattgacttggggaatggaagcacaatcaagggtgcgatgaccttttccaagattcccaaaggagagtattacttaattgagacagaggccccgggcggatttgagaagaaccccacggcagttcccgtaatcgtggatgacaccggcgtttacgccgatgcagggaaagaagaagatatggtctctgtcaacctgggcgtgggcaaactggtcaagagcatggtgcagtttgccgcggacgatgacattgacgccaccctccacgacatcaaggcggcgctggagacggggacgtacgaaaataagaagtggaactggaccgagacagaggataacgtatggaacagtacagaccctgaaaagatcatgcacctgtcctattcttccacaaatgcagtcttagagtatggtccgattgagggctactccaatgcactgacctatgacgagggctgggggcggctgtccattcggcagtgcatggaccatgatgataccattcagtctcccaaacaggatttgaaagagcaaagcctgaacaacctcttttccggtaccaccatggtggtggtggggaaccagcgccaggcggcggggacgctctccatcaccaaaaacgtggatggtctcgacaagaacatcgcctcccagctttcctttgatattaccctgaccgcagaaccaaagaatttgaacggcgggacggtgtaccggatgaaggatggggaaacaggtgaaaaagtgcccttctcggaggaaggaaaagctacgctttcgatccatggtggggagaccatcacgctgcaagttccggcgggtgtgacgatcactgtgaaagaggatgctgtatcagggtttactgttgcatacgaagatacgtcgtttgcgtcggaggcagtatcggcttctgagcaaagtcagggcatttcggtaacgattgaagagaaggctgacaaagcaatcacgatcacaaatacgtttgatagtgggaacgctgtagcggaaatcattccagctatcaacaaaacctttaccggaagcggctggaacataggtgatgcggtatccttccagattgaggccatgacggaggatactcctgtccccaacccaaatcgaattacaatcaccaaatcctctgacagcacagcatcggcatcttttgcccccatcattttcacggaagcgggaacctatcagtacgaaattacagaagatgagggagacctaaaccgtgtcaagtatgacaccagtgtttacacgttttctgtaacggtgactgataatgaagagaggggacttaccgttagtaattggagcattgagaagaacgagaaaccagcagacgagatcgtctttaccaatcatcgaagctccggaagccaccgccctgatccggaccccgatgacgacaagcccagcctgaacaccgaggaccactatggctacatcatcggctaccccgtggactactacaccgggctgcccaccgaggaccagaccaaaaagccggtgaagccccagggcaacatcacccgggcggaggtggccaccatctacttccgcatgctcaccgatgagagccggaaccacttctggagccaggacagcggctacccggatgtggcgttggcggactggttcaacaacgccatcgccaccctgtccaacggcgggatcatcagcggctatcccgacgggacctttgaccccaacgggtatatcacccgggccgagttcgcggtgattgccgcccggttcttcgacatggactaccagggggaggacctcttcccggacatcgacggtcactgggcccaggattacatcaaccaggccgcggaagacggctttatcgaggggtacccggacgggaccttcgggccggacaagtacatcacccgggccgaggcggtgaccctggtcaaccggaccttggaccggcaccccgacccggaccacttcctggaggatatgctggtctggccggacaacctggacaccgagcagtggtattacgccgacatgcaggaggccaccaactcccatgagtatcaggtgaagaaggacgcccagggcaacgagtatgaggtgtggaccaaagtcctgcccgtgcgggactgggaggcctttgaaaaggagtggtcagacgccaactccgccgagaatcccggtgaggtggtggggaagaactgagtccccggcaccccggtaacaccagaaaagaacagccggacggtgaaaacaccgtccggctgtctgcgttcccttacacggagcagtgaagaaccgcgatctggggcttggtcccttcgtcaagggagagggtgtcggtggggtagtatacataattctccaccagggacagaaaatcctccacctggcccaccgccggcaggcccacggcgcccatccggtagtgcatgggcagaaagaccttgggccgaagatcgtccagcagggccttggcctcctggggaccaatggtgtaaaagccccccacgggcaccatggccgcgtccaggccctggagctctgccttttgcgcgggagagaggggacagcccaagtccccgaaatgggccacccgcagcttgcccacctccagcagatggatggtgttctccccccgcagccggcccccttccgggtcgtggaaggtgggaattttggtgatacggaaggggttggggcggccggtgcggagggtgacaatctccgctgcgttgtggtcgttgtgctggtgggagcacagcaccaggtccccggtcaggcgcagcgggggaaagcccgggacgtagtggtcctcataggggtccaacaccacggtgaagtcccggcaggtcagggaaaagcaggcgtggccgtgccaacgtaccgtcagttgttccatgggaaaacctccttatggtcgggtatatcccgaagtctctgcccttattgtaccatatttcctggcgttggccagaaatttccgccggaaagaggggatttccccggaaatttttccctcagaatggaaaaatgccgaagagcatagtataataaaagaaaaaccgcctgaggcggcgaaatggagagatcaacatgaaagcgactttggtaatcatggcggccggcatgggctcccgctacggcggagagaagcaaaccgacggcattggcccccacggcgaggccattatggagtattcggtctatgacgcggtgcgggccgggttccataagattgtgtttatcataaaaccggggatggagcccaccatccgcgccctctgcggggaccggatcgagaccatgcacaccccccagggagagccggtggaggtggcctatgcggtgcaggacttctccagcattccggccttctataccattcccccggagcggaagaagcccttcggcacggtccacgcggccctgtgcgcccgggatgtggtgcgggagccctttgctattatcaacgccgacgactactacggcgtctcggcctatgagaccattttgcaaaaactcctgaccctgaagcccaccggggagggggccatggtggggtaccgcttgaaaaacaccgtcagcgacaacgggacggtctcccggggggtctgccagctggacagcggcagcctgcgaaaggtgaaggagaccctgaaaattaaaaagtaccccgacggccgcattacggacacggagaacccggctcaggaggtccccttggacccggagagtgtggtgtccatgaatttctggggctttaccccctggatttttgaggagatggaggcctatttccacaccttcctccgggaactggcaccggaggagcagaaggcggaatgcctgctgccggtgctggtggaccgcttaattaccgcgggccggctggatgtggcggtgctccataccgatgcggtctggttcggcgtcacctatcaggaggaccgcccggtggtggaacaggcgctgaaagccctccacgaaaacgggacctatcccccttccctaaagggctgatccaaaacaggaaacccggcggtgccaccgccgggtttttctgagaatggaagagaaaagaggaaaaagggattgacaaatctctccagaatgagtatactatctaagcaacctaaaaatgcggatgtgctggaactggtagacaggcacgtttgaggggcgtgtgtccatgacgtacgggttcaagtcccgtcatccgcaccagatggaaaagaaccgagacttcttcagagaggatctcggtttcttttttcgttttggttatttttatctgttgtataaggaggagtaggatttatgaactcgtcactttgttcgctcttaggaatccagtatcctattatgcagggggcctttcagtggctggcaacgcctgagttggctgcggcggtatccaatgcagggggtctgggtacgatcagcgcgtctttgtatcagacgaaggaggaactgaccgaggcgattgcacgggcgaagtctctcacagacaagcctttctgcgttaatatctctatgtttcctgaagtggtggaaggggagaaaacatgggattttattgcggcctgctgccaaagccaggtccctgtggtggaattgtccggccgggacccaaaaccctttgtggaggaactccatggagcgggcgcgaagatcattcataaatcaacggccgtccgatttgcgcaaaaagcagaggctgcgggggtggatgtagtttctgtggtgggctttgagtgcggcggtgcaccggggaatgatgatgtgacctctatggtgctgattccttctgtggccagtgcggttcatattcctgtgattggcggcggcggtgtatgtgatgggcgcagctacttggccatgcgggcgctgggagcagagggcgtggtcatcgggacaaggttcatggctacgcaggagtgcgccatccatcccaactttaagaaacttttggtggacagcaatgagcgcgcgacaatggtggtgcagcggtccattgatttcccccatagaaatttgaagaatgagactacgctgcaagtggcggaactggagaaggggaaccccaagttagaggatattttcccgtatgtcagcggaaaacggcagaagaagtgctatgacagcggggacacccagggaggtgttttcccttgcggtgaagtcgtaggacgaattcacgatatcccgacggtacaacagctcataaatcgtattgttcgtgaggcggaggccatcgcccctacgcttctttgagaggctgggcagcaaagacgaggaaaaactttttggacgggaacactggcatagtgattcccgggacgtggcagacaaaggagaagaaacaggaatgaacgcatatcggcacaccgtgcagtattatgagaccgaccggatgggaattgtccatcacagcaactatatccgctggatggaggaggcccgggtggattacctggcccagctgggatggggactggagcggctggaggccatgggctcggtgtccccggcaacctatttggacgccaagtataagcagaccaccacttttccggatgtgatctccattcaggtgaccttgacgcagtttaccggggtccgactgcggcttcactatgtgatgacaaaggagggggggcctgtggtgtttgagggaaattcagagcactgtttccaggaccagcagggccatattctgcgtctgcgcaaggcatttccggcctttgcccaggccctggaccagcagctggcggccggccaggaggcgtgaggcacgcggttataggttgagaaggaaaatagaaaagttcagcactgcggcgaatccggtccagagcagataggggatttgcagccgcccggccagcgggtccgccttggaaaacgcggcgatcatccagccgatgacgcacagaagaatgaggagccaaaagaaggccagcagatactgtcccgcgccaaaaaaccagacggtccagaaaaaattcaggatgagctggagcacaaagggacgcaggcgctgcccccgcatggggtcctggctgagccacacccgggcggctccaatccccatgagaacgtagagaaggttccaaacaatgggaaagaggaaggatggtggcgtgaaaaccggtttttccagctgttcatagaccggcatcccgtgatatgtgacaagggccgccaggccgcccacggccaggggaagcaagaggaagagcaggtaagtcagaactttgtttcgtttcattgttatcacccatagatagtatgccggaaacccagggatttatgaaagacagcgcccttttttgagcatggcctggacaggggaggaaaaaattggtatactaaggcctgcctttgcgtagaagccgtatagaacaactgaacagcaaggaggattatacgtgatcgaacatggcattgaagtgctgaaggtcattttcctgggcattgtggaggggattaccgagtggctccccatcagcagcaccggccacatgcttttggtggatgagtttttacagatgaatgtcagtgaggcattcaaggatatgttctttgtggtcatccagctgggggcgatcctggcggtggtgatcctgttctgggaaaagatgtggcccttccagcgcaaaacacccacccagcccgcagtgcgctgggacaccattcagatgtggtgtaaggtggtggtggcctgtatccctggggcggtggtgaccatcctgtttgacgactatattgaggcccatctccacacccccacggtgattgcagcggcactgattctctatggtgttggatttattctgattgagaactggaacaaaacccgaacccccaaggtgcagaccttggcggagatcacctatcggaccgcctttttgattggcctgtttcaggttttgtccatcattccgggcacttcccgttcgggatcgaccatcattggcgcacttcttatcggggtttcccgggtggcggcggcggaatttaccttctttctggctgtaccggtgatgtttggcttgagtttgctaaaactgctgaagtttggtttggtgttcaccaccccggagttggtgactctggtggtaggcagcttggtggctttcctggtctctctggtggtcatcaaattcctcatggggtacattaaaaagcacgacttcaaagtatttggctggtatcgcatcgttttgggcggcgtggttttggcctattttgccttcaagtaaaaaatgatcctgccgtctcctgggcggcaggatcattttttatgttttcatagggactgtccacagcccaaagtacagcaaaggcacgtatcaagaattctgttaccaaaggcccataacgtgctgaatgagaaggctggtgccggtgatgccaacccagcagcaagcgcctaaggccaggggcgcaccgccggttttaatgagcttgacaatatcggtgttcagtccgatggcggccatggccagtacgatgaagaatttactcagtgtcttaatgggggaaaagacgctggcatccaccccaaagtggaccgcgacggtggtcagaaggctggccgcgataaaatagagaatgaaaaaggggaagatggacttgagactgacccctttcccctggcttttctgccccttccgggtatagagaaaggccagcaccaaggtgatggggatgatggccagggtgcgggtgagcttcacagtgaccgctttgtccagggtggcggttcccaatccccacatgctgtcccaggtggccgcagctgcggtgacagaggaggtgtcgttgactgcggtgccggcgaagatgccgaaagcctctccagaagtggtgctgaagccgatgaggttgcccaggatcgggaagagaatggctgccaaaacgttgaagaagaaaattacagagatggactgggccacctcttcgtcgtcggcatcaatcacaggcgcggtggcggcaatggcggagccgccgcagatggaggaaccaacccccaccaaagtggagattttggagggaatccggagggccttgtgcagcacgaaggcgatgagcagggagacggcaatggtgcagacgatgatgggaagagactgcttgccggttttcagcaccaccgtcaaatccaggccaaatcccagaagcaccacggcccattgcagcacttttttggaggtaaatttaatgccgggcgccatccgtccctggtttttcaggggaatggcgatcagcatgcccagaaggatggcaatgaccggcccgccgacaatgggaaagaaggtgcccaaaatccaggcgggaacggcgatggccaggcacagggcgatcccccggctgttggttttgaaaaattccataacaggttcctttctctctcttttttaggaaatggatttatggagggtaacatctcgccccttgcagtcgagaacgcccgcccggcgcagcttgctcagctcagccgacatggcgctgcggtccacgcccaggtaatctgccaggccctgccggtcgtatgggaggcgaaaagtggggctgcccgcccgccgggcctcttccatcaggtaagccatgagcttctccttggtggtccgcttggacaagaacgacagcttctgcgtcagcaaaagattcttggccgcgaccacatgcagcaggttggacagcaggcgctgatgaaaggcacaggcgtcgctgcacgtgcggatgacacgctgacagtccagcagcagaagggtgctgtcctgggcagcctccacactgaccggcagagacgccacaccggcgcaggcaaaagcctccccaaaaagctgaggaggctggaacgtagagacaatgctgcggttgccatagtagtcttcctgaatgacatggacagcgccggacagcaccaaaccgacccagcgtgccgggtctccggcacggaaaatcatttggtgctttttgacctgcatgtggcgggttcccagacaggggagcatctgggataactcttggggagagatcccctgaaaaagcgggcattggcgcaaaagcgcgaaatattgttccatagaatctcctattgtgttggatttccaacatacgattcccgcttatcctactaaactatgagagaaaagtcaaggacattgtaggaggtttcgtgaaatggtaagaaagatcatcaagatcgaggaggcggcctgcaacggctgcgggatttgcgctgcggcctgccatgaaggcgccattgaaatgagagaagggaaggcaaggctggtacgggaggatttctgtgacggtttgggggattgcctgcctgggtgtcccaccggcgcgatctcctttgaagtacgagaggcaccggagtacaatgcggcggcggtggctcaggccaaggctcccactgtccctgcgccgctgccttgcggctgtcccggcagccagccccgcaccataggcggaaaagaggggatgtcttctgcttttccggcgcagggggagagctgcttgggacagtggccagtccagatcaagctggtgccggttcgggcgccgtatttctccgacgcccatcttctcatagccgcagactgtacggcctatgcctatggaaatttccaccaggagtttatgaaaaatcgtattaccctgattggctgtccgaagttggatgagggggattaccgggaaaaactcacgcagattttgttggccaatgggatcaaaagtctgaccgttgcccggatggaggttccctgctgcggcggaatggagcgcgcagccaaggccgcgctgctggacagtgggaaagaccttccctggcgggtggtcactttctctggggacggacggattttggaggaacaaaaccgctgacgtttttcgacggcgtgccggataaggcacgccgtttgttttgacaggatagacaaatatccacagatgtagtacaaagattgacaattcgcatgtggtttatttgcacaaagaactactttagctctcgttttctttttgctctcccagcaggatagaaggattccaggggttttcctgcaggaagtttggatagaactttcatttacaaaaggagcccttcaatggtaggattagattgtcagaagaatacagtgggccgtttttacggcttacctctgaatatcaggaaaaatccagcaaagggtctcccgtttgcgttgggacaaggaggagtcaacgtggcaagaaagcgcaagacaatggatggcaatactgcggcggcccatgtggcatatgcctttacggaagtcgcggcaatctatcccattaccccatcctctgtgatggcagagctgtcggataaatggtctgccgaggggcggaagaatatgttcggccagccagtaaaggtctccgtcatgcagtcggagggaggcgctgccggcgcggtccacggctccctgaccgccggggcactgaccaccacgttcaccgcttcccagggccttttgctgatgatccccaatatgtacaagattgccggcagcctgctgcctggggtgacccatgtttccgcccgggcgctggcgacccatgcgctgtcgatctttggcgaccacagtgacgtgatgtcctgccgttccacgggatatgccatgctgtgcagcgccaatccccaggaagtcatggacctgggcgctgtggcccacctggccgccatcggcgggagggttcccttcctccatttctttgacggattccggacctctcatgagatcaagaaggtagaggtgtgggactacgatgagctcaagtccatggtggacatggatgcgctgcatgccttccgggcacgggcattgaacccggagcacccggtattgcggggctcggcccaaaatccggatatcttcttccaggtcaatgagacccgcaaccagtattatgatgctctccccgctgtggtggaagagtatatggggaaggtcaaccagcgcctggggaccaactaccagctgtttaattactatggcgcccctgacgcggagaccgtgatggttgccatggggtcggtctgcgacgcggcggaagaagtggtggactatatgaacgccaagggggaaaaggttggcctggtgaaggtgcgcctctatcgcccctttgccacggaccgctttgtggcggccctgcctgccacagcgaaaaatatcgtggtcatggaccgctgcaaggagccctcttccattggagagccgctgtacctggatgtggtggcggcgctggcgggcacccccttcgcggaagcgaagattgtgggcggccggtatggcttgggctccaaggacactacgccgggcggaatcctgtctgcgttccgcaatgggcagagcgaccagccggtgcggagctttaccatcaacatcaacgacgatgtgacccaccgctctctccccattctggaggagcccgatgtggccgatgaggggaccattgcctgcaagttttgggggctgggcggcgacggcaccgttggcgccaacaagaactccattaaaatcatcggcgacaacaccgatatgcaggtgcaggcgtacttccagtatgactccaagaagtctggcggtgtgaccatcagccatctgcggttcggaaagaatcagatcaaggcgtcctactatgtcaccaaggcggactttgtcgcctgtcatctggcctcttatatcgaaaagtttgacattgtacaggatattaagccggggggcactttcctgctcaactgtccctggaacttgcaggaactggaggagcatctcccggcggcggccaaacgctacctggcccagaaccatatccgggtgtacacctgtgacgccacccacaaagccattgagttgggcatgggcaaccggtccaacaccattcttcaggccgcattctttaagctggccaaggtgattccggtggaggaagcggtacagcacatgaaggacgccattgtgaagagctacggccacaagggaatggacgtcatcatgcgcaactacaacgcggtggatgccggtgtcgagggtgtccaggaaatcctgatccccagcggctgggcggaggcgcaggaggaacccacggagctttccgtgaagaccgagcgggcggaactggcgcagtacgtgaaggatattatgatccctgccaatgccatgcggggagacgccatcccggtctccaaactgatgcctggagcggatggtacccttccccaggggacagcggcgtttgagaagcgcgggattgcggtaaaggttccggcctggaaccccaacaactgcatccaatgtaatatttgttcctatgtctgcccccatgcctgtatccgtcccattgtcatggacgcggatgaagtggtgtccgcccccaaggggaccaagatgcgggatatgcgcgggaagggctgtgagatctatgcctattccatgacggtgtcggtgctggactgcacaggctgtggctcttgcgtggaggcctgcccggccaaaaccaaggctctgaccatggagcctttgagcgcccagctggatgagcagaccgtgtttgactatggaatggagcaggtgagccagaaagaacttccctttgccaaggagaccgtgaagggcagtcagttccagcagcccctctttgagttctccggggcttgtgccgggtgcggtgagacaccctatgtcaagctggtgacacagctttttggtgaccggatgtacattgccaacgccactggctgctcctccatttggggtggcagcgccccctccacgccctatacggtcaataaggaggggagaggaccggcttgggaaaactctctctttgaagacggtgcggagtttggctatggcatgaacctggcggtgaacgcccggcagaccgctgcggcggatctggctcggtcccttgcccagaaggaggacacccccgccgctgtgaccctgtgtgcccagaaatggctgaaccaccggagggaaaccgaaggctctcggaccacggggcaggcactggccgccgcgctggcaaaagccatttcggccggcacggggaaccaggaggaattgcaggccctgtacaacatgcgggacatgtttggccaaaagtcggtctgggcctttggcggcgacggttgggcctatgacatcggctatggcggggttgaccatgtgttggcctcgggagagaatatcaatattctggtcctggatactgaggtctactccaataccggcggccaggcatccaaggcgaccaataccggcgcggtggcacagtttgccgcagcgggtaaggcggtccaaaagaaggatttggcggccatcgccatgcagtatggcaatgtctatgtggcccaggtggccatgggcgcggattacagccagaccctgcgggcgctgttggaggccgagtcctatcctggtacctctatcatcatcgcctatgcaccctgtatcagccacggcattaagattggcatgaacaacaccatgctggaaatgaaggccgccgtacaagctggctactggcatttgttccgctatgatccccgccggaaggagaaggggagaaaccccttccagctggattctccggcacccattatggactaccaggagttcctcaccggagaggtccgttattcctcccttcagctcaccttcccggaacgggccacagagctctttgcccgggcggagaaggaggcgcaggagaaatatgcgcgtctggtagagctgagcaagccttgggaggccaaggacgcctaagtcctgactggaaacgtattcacatcctaaaaataaaaatccagggagaccggcagtgttctgtaaaggacctgccggttttcctgtccaccaccgaggaagtggcgggaagagaaaaagaacagagtggactggaatgtccactctgttttctttcacggtgccaacagaccctgttctatcaaaaattctcgtgccacgtcgtcaacagagcgctgctctacatcgacttcgtatgtcatactgctcatgagatcgttggtgaacagcccgttcaaggaggagagggtttcctccaaatcgggggcttcctcccggaaccgctcaaatagatcgttgcgggccaagatagtgccgtaatactctgggaaaaactgtttgtcgtcctccagaattttcagattggcccgcttgttcaggccgtctgttgcgtaaaccaccatgacctcataagagccttcttcgatggccttgtatttcagcatgatgtccacgtgcagaacctctttgaagttcagatcatagaattcaacgaagggaccaaacttcatgctgcctgcatctgtgaaaaagtcctgctccgcgccaaagcgcagggaaccggccacgggctgcagatcgctgatggttttcaggttgtactgttccgccacttggcttgtcacaccaatggcataggtgttgttgaccccgatttttcccaacatacggcagtcgtactcttcctgaaccgtttggttgacaaaatcgtagagggtcatgccgtcgggaatgtccgtggtgtccaaccccagaatggtggtgaggatcgtgccatcccagttgtacatcaagtcacagctgtgatcgtcaccgatgagcgcctggaagttgttcttcgaggtcatttggtccttgatggtcacttctaggccatagcggtcctccatgagctgctggatcatgctgttgatgagttggacttccgagaattctccctgatagaggacaatgccgttttcatcttggggaatgaagctccaggcgcccaccgcgatcacacagacggccaatccagcggcccccagacgtttgaccatacggaagcggtgagaggtggaaccggcggtgtggtgattcatccggtgctctatgagacccattaaggtgtcaagcaccaaggccatgagcatcagcacgccagtgccgccaaggatggctgccatgtcatcctgccggatgccggtgttgatgacgctccccaggccgccgccgcccacgaaggcggcaaagacggcggttcccaccgcgttgactgccgcgattcggattcccgtgaagaggatgggggtggcaaggggcatttccacccggagcagacgctgcatccgggacatgcccatgcctttccctgcttccaccaggtagtcgggaacttggttcaggccgaggcaggtatttcgtacaatgggcagcagggagtataaggccagaccgatgatgacggtcggtttgcccgcccccagaaagaccatgatgatgcccagcagggccaatgcaggggtagtctggagcaggtccaccacccgcaggataattttgcgggcggagggataaaagtaggagagaattcccagagggacgccgaccacgatggcacacagcaaggcggcgacaacgatcgagatgtggtctaaaatcatgataccggtcatagctcgtccgcctcctttcgcattcccttgggtaccactttgcgctgaagcgcgtcgatgagagagcccaagatgaaggccagcagtgctgcgggaatggcgcccatcaggatgagtccgttgtcattggcgctgattccagtgtaaatgaacgtgcccaaaccaccctgcccgatcattgcagccaggacagtccagctgaccgtgtaaatggtggacattcgcagaccgccgatgatggtaggcagcgccaggggaatttcaatcttatacaggcgctgatagggggtcatgccgcagccccgggccgcttcaatatactgcgggtccacagagaccagccctgcataggtgtttttcaggatagggaacatcgcgtagatggacagcgcgatgagcactgtggccggctgcatgcccagccagatgaacagaagccccacaaagacaatgccggggatggtattgaacaccgagagcaccggcagcacaaatttggacagcttgggcctacgggagagcagaatgcccaacaccacgcccaggatcagaccgaacagcacggaaaccaaggtgaaggcgaggtgggtcaaaatggcctggggaagatcatggtaactcattggttcacccccacagctgttccgccattgccgaagccatgctggtcttggtgacgattccggcgaccgtctggtcggggttcaggaccaccagataggagcttccgctctcaatcagctgatcgaagcaggcccgggcgttgtcctctgtctgcactgtgggcatgttgcagcggattaagggaccgatggaatccaccacatgcccggtcagacggatatcggtgatggacacggttcccagatactttttgagagagtccaccacaatcaaggtgtccacgttgtgccgctgcattttgctgatgcattcgttgatgccccgggtctgctccactgtatagacgccggtgcgcatgaactccttgaccttcaggtctgcggcggactgctccggcatgtgcttgcccaggaagtcatggatcagaccggtggccggatgggacagcatctcttccggggaagccatctgctcaattttgccgtggttcatgaaaataatgagatcagcaaggtcaagggcttcctccatgtcgtgggtgacaaagacgatggttttgttcagcttttgctgcagggatttcatttcctgctggagggtgcgccgggtcatggggtccagcgcgctgaagggctcatccatgagaacaatgggaggggaagcggccagggcacgcaggattcccacacgctgctgctgtccgccggacatttctgagggatacttgtgggcatactgttcataaggcatgtccaccatggccagcatgtcccggacgatctgctcgcaccgttccttgggatatttcaagagtttgggaaccacgcagatgttttgggccaccgtcatgttggggaacaggccgatctgctggatcacgtagccgatgcggcggcgcagggttaccttatcctgctttgcgatgtcttctccatctatgtagatgtgaccggcgtttggctgaatgagacggttgatcattttgagggtggtggttttcccacagccagatggcccgatcaggacgacaaatttaccgtctgggatctcaaaactcaagtcaaagatcacctgctggttgccataggacagagaaatgtgttcaaatttaaccaatgagatacactcctttctttgcggggtttctgctgcggcggagaggagacggaaaccatgccggcatcgggtccctctgaaaaaagccgcggtacggattgcgtcgatttttcaaaatggatttttatgattcgtatcttggaatacaggggggtcaaaaggaaaacagaaatgattttattttctgctttctgtggaaatctcaacccaatatacgaaacgtaatatcttctttatacctgccttatactcctatattataaaggaaaacggacaaaacatcaatagagaaaagcattcgtaattcttaacattctgttgcatgctgtctaatcgaaagcaagggcgccggcagggccaaagaaatgatacaatgaggaatcaaatttgtcatcggtacacattgtataaaaaatgaattccacaggataggataccataaaatggtcccctgccgggaagcagattccgcagcagggggatgggggagagatatccacttttgctgactcggaaggggctggagccttattttttgttgtccagaagtttgttgagctcatccataaaggtgttgatgtctttgaactgccggtagacagaggcaaagcgaacataggccacctcgtccaagtctttcagcttttccatgaccaattcaccgatctgtttgctgctcacttcaccgcccagttcattttgaagctctttttcaatgtcgtcagcggccttttccagcagggagagagagacagaccgtttttcgcaggccttgagcatactggtcatcagcttgctgcgatcaaatgcctgacgaatgccgttctttttgattacgatcatggggagaacttcgatggtttcgtaggtggtaaaccgattgtggcatttgaggcattcccgccggcggcggatgctggtaccgtcgttggcgggacgggagtctacaaccttgctgtcgagggtggcacagaacgggcatttcatagagcagagacctcctgaaattttctacggtattgggtgtcaaacgatagattatatttacattataccataaaaatcataagattgtcagcttttttcaataaaattcgaaaacagcatccagatagggccaggaaatggagggaagatttccgagaaaagaaggcagggcaagagaaaacagcgcacccagtcagggtgcgctgtctcaattcagattgcttttttgctgggcctggatcttcttgcgccaacaccggtggcacatagcgacatagctgtcattgccccccaaaaacacctgactgcctgtggtgagaatggtcccgctggcatccagacgggcattgacggtggccttggagccgcaggcgcacacggtcttgatctctgtaatggaatcggccaactccatcagacggcgggagccaggaaaaagatgggtaagaaaatctgtgcgcagaccaaaacagaggacaggaagatccgcttcgtctacaatctgacgcagttggtcaatctgctcgggggtgaagaactgtgcctcgtccgcgatgataacgtcatagtgttctcccgcctgatagcggtcatatagattgtcctccgggaaaatgacatcggcctcccgaaagagccccacacggcttttgacgatagaggcgccgtcccggtcgtcaatgctgggtttgatcagccaaacgcgcatgcccaattcttcgtagttaaactgtgtgatcagcgcctgtgcggattttgagctgcccatggcaccatacttaaaataaagttttgccactgttgttcccgccttttcctggaagattcttaccaaaacatgatagcatattcccgggcacaatgcaatttttgtctggcggcctttgaacagggaaacaacagattgtcaattttgtcaaaaagggagggagtttcatttgcactcttgattgctggatatatcaatgttataatcccattaaagggttgtaaaaaaataccctgtacacacccgaaccaatccattgaaacggaggaaatgaaaaggatgaaaaagattcttgcacttctcttggcctcggtgatggtcctgggactggccgcctgcggcggggacaataccccggcagaagacacagacgccggcaccaaggagcccgctaccaccaccgagacatcggccaatgacatccccgactccatgacgtctgaggacggcaagtatgagctggcctttgtcactgacgtgggccagctgaaggacaagtccttcaacgagggcacctggaacggcgtgaagctgtatgccagcaagaatgacatgtcttacaagtactatcagcctgccaacggcgaccaggccaccgacgatgaccgttatgaggccatgaaggccgctgtggatggcggcgccacggtggtggtttgcgccggcttcctgcaggaagctgccctgaagcaggccgccattgactatcctgacaccaagtttatctttgtggacggatatcccatcaatggagacgacaatcagcctctggccaacgtggctggcattgcttttaaggaagagcagtccggctactttgccggctatgccgctgtgatggaaggctacaccaagctgggcttctccggcggtggcggcggcaccaatcccgcctgctgccggtatggttatggctttgtgcagggcgccaacgccgctgcggcggagaaggacgtccaggtggagatgaattattcttgggagtacggctccagcttctctgcctctcctgagctgcagaccatggccaatggctggtatcagagcggcacggaagtgatctttgcctgcggcggttccatgttccagtccatcacggcggcggcttccgccaacgatggtgccgtgatcggtgttgacgtggaccagtccacccagtctgatacggttgtgacctccgccatgaaggaactgtctgacgcggtggaatggtctctggctaaggtttatgacgataccttctccgaaatcggcggcgttgccacttctctgggtgtggaagaggacgccgtgggcctgcccaccgattcctggagcctgaccaactatactgtggagcagtatgaggaaatgtatcagaaggtcaaggatggtaccctggctgtggatgcggactacaacaatctggagcaggagtattccaacctgaccctgaagatcagctgagtttagataaaatcaagttttcatgcaaagtggggaaagacattgtctttccccacttttttgcgggaggaaatgcacgtatcttacaaggggaaatgcttttccccgtctttttcccaggaaaccgggttcagggttttgccttgtttcatcacaaacgcccccccaatgacatacactggggcaaatacagagaaagctatggtgaatgtgatgaaatggataaagcgatggtgcttcctgctggctctctccctgctggtcctgccggtgcgtgcacaggcggcggtttacgaagggttggatgtgagtgtttggcagggagaaattgacttttcccaggtgaaggcggccgggaaagagatggtctatatccgagcgggatatggtctgtcagaggacagccgattccgggagaatgcggaaggtgcccggcgggcggggatgaaggtgggcttttacttctttgtcaccgctaccaatcagacccaggcccgggcgcaagcggtttatttttcggaactgattcaggaatatccctatgactgccggccagcggtggactttgaacaatacggcacactgtccaagggagaactcaacgggattgccttggcatttgcggagacgctggaggagagaacgggaaaaacgccggctttttataccaatgcgtccagtgccgcagagatctgggaaccggcgctgacgcggtatcccctctggattgcggattatgggcccaaggaaccgacctcccttggctactggacacagtgggcgggctttcagtatgaggacaatggccgggtgcccggaattgcgggcgcggtggacctggatcggtttactgagggtatgctgctggagcagggcgcagagatgccctttttggatgtgcgtcctcaggactggtatgcaaagggggttacagagctgtttgagaggggactgctgcaggggattacgccggaccggtttggaccggaccgtcccgcccagcgggctgcggtggtgaccatgttataccgactggcaggggagccgccaggctctggtcccactggtttttccgatgttccccttgacgcttggtatgggaaggccgttcgatgggctgaagggattgggattgcccggggagcggccccgggagagtttctccccgcccgaggtgtaagccggcaggcgttggcggtgtttctctaccgctatggggagtacagcggaagggatgtagagaagagagataacctgcagggctatgcggatcgatctcaagtagcaccttgggcagaggaagcagttcaatgggctgtcgcggagggaatcctgcggggaaccggacgggaaacactggccccacaggcgacggcggaccgggcccaaatggcggtgatggttcagcgttttttggagaaatgaaagaacgccctgtgatcacagatcacagggcgttgtgttttggaagggaatgattacttcttctcgttatatgctttgatgcccagggccagcaggtccatggcgcgctccagatcagcctgcttcagcacataagcaatgcggatctcgtttttgcccttgccgggggtgccatagaagggttcgccgggggcaaacatgacagtgtcgccgttgtcttcaaactcttccagcagccactgctggaatttgtcggcgtcatccacaggcagtgcggccatcagatagaaagcccccttgggacactcacagaccacgccggggatttcagccagcttagccaccacagtgtcacggcggcgcttatactcctcacgaacggcggcgaaatactccgggccgacattgtacagcgcggcggaagcaatctgatccagggtcgccacagacaggcgggcctgacagtacttcatggcctcagacagcagttcgtggttgcggctgaggatggcacccacccgggcaccacaggcggagaaccgtttggagacggtatcgatgacgataacattctccgcagcatcggcgtactccccgaaggactgcaggggctcgccggcatagacaaattcacggtacgcctcgtcgccaatgatgaacaggttgtgctccttggcaatgtcgcacatgaggcgctgctcttcgggggtcagcacaacgccggtggggttgccggggttggtgcagacaatggcgcgggtgtgctcattgatctgcgcctcgattttagcccggtcagcgtagcggtatccctcctcgggggaggtggggatggggtggatgctggcgccggtggtattgaccatggtggcgtagttgggatagaagggctcaggaatcagaacctcgtctccgtcatccagaatgcactggaaaacgatagaaagggcctcggagccgccggtggtgatgagaatttcatccttttcaaagtgcatgttcaggttgtcataatacttctgaacagcgtcgatcagctcgggcacaccaggggagggagcgtattccagaacagactggctgaaattccgcacggcctcaaaaaactgaggaggggtctccacgtcgggctggccaatgttcagatgatagatcttacggcctttggcttccgccgccactgcatagggatggaacttccgcatcggggacagaccgcattttttgactttgctggaaaacttcatgtccttacctccgtttatatcctattcgcgtctgcgtacagggcaaacattcgacactattgtacgtcctgattgagagaatgtcaatctttatggcgggatttctctcgacattccagaggagcggagaaaaacgagtccgacttgttttggggaaaaactttgagaaaatggagggaacagggtgttccctgtcacagattgacaggccatggcataaaatgcgaaaaggtacggtgatcaaaaggagtgagtctcgtgcgttcgatttggctgcgaagattgaataatcttttgtgtgtaaaaagcattgtgaccattgttttaaccgttgtgtttgctcgcctttctctggcagagcgaatttccaaccaggattttttgaccgttttttctgtgattgtggcattctattttggaatccagaatgagaaacaggaggaactgccagagaaggaggcagaaaaattgtctgcccaaaagtgatagtggcattgggaaaaggggtgttttggatgtatggttatgggaatttctctcagtggtgcatcccagcgaggtatccagactggcagggaccggcaggacctcaaggggtcccaggagtccctggccctactggtcctgtggggcccagaggagagaaaggagagcgaggaatcccaggcgaaactggaccctccggacagcaaggattcccaggggagagaggtcccgcaggtccccggggagagcccgggcccgcaggccctatgggcgcgatgcctactgtggaaattggaagggttatcaccggagagaccgcccaggtaacagcctgtgaaacggagacaggcgttgcgctggatttcattattccggcaggttcccaaggtgcggccggacggacaggtgccaaaggagatacaggagagcgggggccccagggggaaaagggagagcctggccctacggggccgcaaggcattcaaggggaggccggtgcacaaggggagatgggcccgaccggccctcggggagaaaagggagaacctggtgcgcaggggcttcagggagaagttggtcccacgggtccgcaaggcatccaaggagaggtcggcttacaaggggagatgggcccgaccggcccccggggagaaaagggagaacctggtgcgcaggggcttcagggagaagttggtcccacgggtccgcaaggcatccaaggagaggccggcttacaaggagagatgggtccgaccggcccccggggagaaaagggagagcctggtgcacaggggctccagggagaaattggtcccacgggtccgcaaggtatccaaggagaggtcggcttacaaggggagatgggcccgaccggcccccggggagaaaagggagagcctggtgcacaggggctccagggagaaattggtcccacgggtccgcaaggcatccaaggagaggtcggcttacaaggagagatgggcccgaccggcccccggggagaaaagggagagcctggtgtacaggggcttcagggagaagttggtcccacgggtccgcaaggcatccaaggagaggccggcttacaaggggagatgggtccgaccggcccccggggagaaaagggagagcctggtgtgcaggggcttcagggagaagttggtcccacgggtccgcaaggcatccaaggagaggccggcttacaaggggagatgggcccgaccggccctcggggagaaaagggagaacctggtgtgcaggggcttcagggagaagttggtcccacgggtccgcaaggcatccaaggagaggccggcttgcaaggggagatgggcccgaccggcccccggggagaaaagggagagcctggtgtgcaagggcttcagggagaacccggtcccacgggtccgcaaggtatccaaggggaggccggcttacaaggggagatgggtccgaccggcccccggggagaaaagggagagcctggtgtgcaagggcttcagggagaacccggtcccacgggtccgcaaggtatccaaggggaggccggcttacaaggggagatgggtccgaccggccctcggggagaaaagggagagcctggtgcacaggggctccagggagaagttggtcccacgggtccgcaaggcatccaaggggaggccggcttacaaggggagatgggcccgactggcccccggggagaaaagggagaacctggccctacgggcccccaaggaacccagggtcaggcagggccagtgggagcacaaggggagacaggaccgcaggggcttgccggggaaacaccgaaaattgcggtggaagaggacacccccgtgagctataaggtgagtttcaagacatcggagcaaagctttatcagtccgaacctaaaatcgaacatcaaatattacaatctggatctttctaaggcaggcagcatggtcaatattccaattgaaaatttggtgctgacctaccaaaatgtctctacgtctgccctgcggattggtattcaggccttgagtaccagtgttcctgttttggcagatatccggcgggccagcatttacaactcaggtgcggtggaggcccagagcaacaacaacgcgaccattacaacgagattggttttggatgacattgtttacagcaattctgaggaaacccattggatgcgtatccgtcagcgtgatccagacagccagctctggtctatgtgtgaggtccgaacctttgcttcccaaggaggggcgagaacgtcgatttgtgtagaatggctctacatgcaggcaagctttgtggcgccgtcctgaaagagtgccttgattctaaacagaatcaaggcactctttccagctttagcaacagacaattatgggaactgggggacgagagcacggtctgctgatccgggcggttctgtctggggtggtaggagtgctgtttggaatgctttcctattttgcggcggcgcagattatgttaggactgttggaggggaggcctggtgatacattttatttggggtggtgcgcttcggcacatttgagctttctgctccgtgccacgctgtattccttggtagtgtcccagcctcataaagcgacctttacaatattaaagcggatgctgcaaaaggccatggaggtgctgacacgggagaaaactgtgccgatgattgtccgccagctgaaaaccgtctgcaatgcggatcaaatcctggttttggaccggagaaagattgtccagggagggacccatgacacgttggtaacccagaggggtatttaccgtaattttgtgatcgagcgaacagtctctgattgctggatccttcgagaaagtgaaatggacagggaacagggccgacaaatgaaacaatgcacgcatttttgcgtgcatcatttttcatgtattctctgtttcaggggagttgctctcttcctctctttggcataactgcttcataagacgaaaatacaacagcacggctaccagggcagccagtgtctcagccaccggaaaagttgcccaaacaccatttaagccccagaaacgagagaaaacaagggccagcggagggatgatgataagctggcggatacaggagacagcaagggaacgcagacctttccccaaagcctcaaagcaccccgccagaacggtccccagcgtggagaccagaaagccgagactggtgatgcgtagcatgggaacccctacggcgatgagagcgcggtccgcatcaaacaggcccatgatctgcgtgggaagaagccaggctaacaaggtccctgccgccatgatgacggcggtgagaattaaactccatcgaataatgtggcgcatgcggtcctggcggcctgcaccatagttgtagcttattagagggcgcatgccttgaatcagaccgttggccggcatgtagacaaaggtttgcagtttgaaatatagaccgaacgcagcaaccgccagggcatggagctccaccaacagcgcgttcaaaatgccaaccagcaggctgggcatggcggtcatcagaccggatggcacaccaacggcgtaaattcgtttggcgatgctgcggtcagggcgcatgtccggaagggtgatgtggatgccggggttggtccggaaaaagtagagtacggccaagctgcaggctgtcatctgcccggccaccgtggcgactgcggcaccggtgacacccagggcaggcagccccaataaaccaaaaattagaatggggtccaggacgatattgacaatggcgccaaccccttgcaggatcataggcacaaacatgtttcctactgcctgaaaaagcttttcaatgtaaatgtgatataagctgccgaaagacaggcagattacgatgcgggtgtaactgctgctcatgcggaggatctcggggtcattggtgaacatccccaggaacggttcgctgccaagcagcccaatgagcaaaaagatcacagcgtgaatggtggtaaagaccatccccatagaggcggcacggtccacgttgcgctgatttccttctcccaggttgcgggcaatgtatgcattggcacccactccaaatcctacagccacggccagtaccatattttgcagagggtatgccagggaaacggcggttaaagcgtcgttgctcacccgcgcaacaaaaatgctgtctaccacattgtatagtgactggatcagcatggaggtgatggctggcagtgacatgctgaccaacaggggaagaaccggccgggttcccatgggatgctctgtatgtttcaatgtaatcgcctctttcctgtccaaaaaagtagggccatatatttgcctgtttatcaatcagaaacaggaaaatatatagccctgcaataaaaattacgcggtgcgttttggagcaaataagtattctattgcatctcacgataccataggatttgctgccttgtcaaggttgtcgaggtagtttagagagcgggggaggggaatttatggtgatccattgacagataaaaaaaccttgatctgaaagatcaaggtttttcttctggcggagaaggagggattcgaaccctcgagacccttttggggcctacacgatttccaatcgtgcgcgctcgaccaaactacgcgacttctccgtgtttgctctgttactatgacttgctttgaaattttgccgtgggggacgcaacaataggtattataacagctttggaagagaagtcaagagaaaaatgcaaaaattttggaaaaaatttaggctgagtgaaccggctcggactgcaaggtccgagccggtggaaagattagagatagaaattatgtccgccgatggtgcaggagtaagtacggctttgatccgcccaggaatacatgctggttacattaaagtacaggcacccatcggcttcccgcacaccgtccaggcagagcttggcagcgatcacgcttttctcatcaggggtgcggtagatagtgccgttggccacgggagaaaattgccctggtgcaaaaatgacttcctgaattgtgtcggggaaagcctcatccgcgacgcggttcaggattacggttcccacggcaatcctccctttcatcggctggtttccagactcagagtagatagcgcgggagagccagtagaggtcttcttctacgtaagtgttagcggtggccaccggcccgacccggcgaatcgaaagggttcctgttgcgggctctttcaccacggaacagcccaaggcgttggccagtgattctgcggggagcaacagatcattctcttgggccataaccaaggatggtacataaaaataccggtcattgaccataaaataggcttcttctgcgatggcttccagagagaggccgttgcctgatgcagtgagccgtccatttttcagggtgaccgagacgtttgggaaaagtgcctggaggactggcgtgatggaaagataggttgtgccgtccgcagtgattgtggcggttcgggcggcgatccaggtcccgttgacggtaatatccggtgtagtacgaagcaatgtggccacagtgtctgtggcgacgggatcaatgacatcgaggtaatcaaccgatgaggtttccaatgtgcttgtgaaaagataacctgattgtgtggaagccaacgtacttgttccggaataggacttgttgtctgcggcgattgcgtgaaagcagaacgccaacaagagcacgaatagaatgatcgcgctgggcaagtgatttttcatcgtcatgctactcctgtttccgaatattcatagttgttaccacattgtaatttatttgtaagaaaaaatcaagatttttttcataaaaaagagagaatacccagggaaaataaggaaaaagaaaggccggagtcaaaagatgccacaatataatgtggaatctgattccgaccttccatatctggtttttctgggaagaaggattctacggagaacgtgagtattcaccgctgaatatgcaaatccattatttgggattccttttcttctgcgcttttgtgaggaaacgatcattttgaacgatcacacgttcgtggataccttcccccacgagaccttgggaatcttgtgcggttacgcggaaaaccaatcgtctgccgtctacttctgtcagttccgcacggcaagtgacctctacaccaatgggtgtggcgctcagatgctttacattcatccaagtacctacggttccttcctctggagagagggaaggagccactgcggtccaggcggcctgttccatgcgggcaatcataacgggagtagccaaaacgtccagtgtcccgctgccgacggttttggcggtcagtgtctctgtgacagggaaagtgagctccaaagcggttccaggggttaacatatcgtgcctccttgctggcctgatttaacaatcgaattgataggttgaatgagtaaagaaaacgaggccattgcctctgtttcgggtctattgtagcagaaaaatggagaaaagaaaagagaaacgcagctaaacaaaagaaataatttgatattccggaaaactgtgtcaaaacgaacaaaatcaaaggagcaattttgttcaaagtatcgcacaatgactgtcttgactttttatataaggtgggttagcataaaggagtaaacttgtgcgtagcacagactggtacatattaaagacaggaggacacatccaatgtttgaacatcatgaaaactatgatcgttacattcctgatgtcatgctgaagaagcataagaagcatgaagagtatttgaatgacgtctatgccggcatgtctcatgaggaaatctacaagagcaagctgggcacggtggaagacgcgctggccattatcgagagcggcgattgcattgtcaactccatccatggctgcgaaccccgtctcttctatcgcaatctgcaccgcattgccgaccgcattgatcccaacaaccctgttgagctgtggtcctgtgtgcaccgctggggacctgagtatgaagtccataccaatcctgagctgaaggataagttccatcatcagactttcttctatgatggcaacttccggaagattcatccctccggcatgagcacctatttccctgtcaacctgcataactatggccaggaactgcatcgctgcaagcgcccgaatgtggtagtgattggtgtttctaccatggacgagcatggctattgctgtgtgtcctgtgacctgcagtgggaaatggagtctttgtattccgcagataaaatcatctttgaggtcaaccccaagattccccacctgcccggtgagtgtgctgtacccgtggcaatggctgacgtgatcattgagtctgatctggacctgtatgagctgcaggatccccccatcggcgaggctgaaaagaccgttgcccagtacgctgctgagatggttcacgatggtgactgcattcagcttggctttggtggcatccctaatgccatcgggtttgaactgatggatcgtcacgacctgggcatccacactgagcagattggtgcttccatggcacacatgctccagaagggtgttgtcaccaaccggtataaaaacctggacaagggctggtctgtcggtaccttcatcattgcggacaactttacctatgaatatctgaacaaccatccccgtgtcctgatgcgccgtggtcgttacaccaatgacccgatgattattgcacagcaggataacatggtgtccatcaatgctgccctgcagattgacctgactggtcaggtggcagcagaggccattgccaacattcagtggtctggaaccggtggtgccacggactatgcctatggtgcttatcactccaagggtggccgtgcaatgctgtgccagatttctactgcgaagaagggaactgtttccagaatcgctcccatcctggaccccggttctattgtttctgtttcccggaacctgaccgatatggtggtgacggagtatggtgtggcaaagctgcgtgcccgtactgtgaagcagcgtgtagagaacctgattgctgttgcacaccccgacttccgcgcggaactgcggaaagaagccaacaagtatatgtatttctaattctttccaaagatttggctgaatttaagagaccgccgcacgattgtgcggcggtttctttttgcaatgtgtcggaaagaaaatacagtgtaatctttttgtaaacaaattgagaaacccattgacaaacaataggaatactttatcttaatataaagtaagctgtcttggttgctggtctttcgaaaagacaggaaaccagaagaacggccagatccgaagcaaagaggcgaagaaatgatgagaaccatgtttgaccgactgttcgctggaagaaatggaatcgatcaattgaatattgctctttttgtgctggcaatcctctgctggataggctctctgtttgcaccaaccaggggactggccaatctgcttcattgggcttgccttttggcagctgctttttgctgtgttcgtgcgttttcccagaacttgggacgcaggcagcaggaaaaccagaaatttctggctatgacccgtggatttcgcatagggcgaaactggcgagcaaaaatggagcagaagcggcaatataaggtttttaagtgcccatcctgcggagtaaaacttcgggtgccaagaggaaaagggaagatcaaggtaacctgtcggcaatgtggcgccagctttgaggagagaagctgagagagtttactgagggcggttgggaaagacagtgttccagactgtcttaaaaagaagaaaaaagtttgagaaaaacccttgacaatggaggaaagaaatgctattatgtcaaagctgtcgcaagacacaggttgaaaagttggagaaaaagaagaaaaaagttcttgacaacaacttggatttgtgctaaaatacaaatcgccctgtaagagcggtgtgcaccttgtaaattaaacaacgtaagtaagaaacacgaagcaccaaaacggacaagtaaaagttgtccatgaagcttaaagctttgtggggcaacgttttatttctttgaagctaatgattagcgatcaatgaattgatttgaatagcggcgagagccgctgtttagataccattttattgagagtttgatcctggctcaggatgaacgctggcggcgtgcttaacacatgcaagtcgaacggaggacccttgacggagttttcggacaacggataggaatccttagtggcggacgggtgagtaacgcgtgaggaacctgccttggagaggggaataacacagagaaatttgtgctaataccgcatgatgcagttgggtcgcatggctctgactgccaaagatttatcgctctgagatggcctcgcgtctgattagctagttggcagggtaacggcctaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaaggaagtgacggtacctcatgaataagctccggctaactacgtgccagcagccgcggtaatacgtagggagcgagcgttatccggatttactgggtgtaaagggcgtgtaggcggggaagcaagtcagatgtgaaaaccagtggctcaaccactggcctgcatttgaaactgtttttcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgctgtaaacgatggatactaggtgtggggggactgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccacgg

SEQ ID NO: 2222 - DNA, 139506 bp, KLE1738
cccgccgatgatgttcagcgcagagcacgcatcaacggcctcggtgttctcgatcttgtcctgatccgagaacgccgccccggcgcccatgaccatgacagacagcatcacagccacacagagcaccaggctcagaaccttcttctgggggaactccttgccccgcaatgcttcgctccgcaatttcccacggattttacacggaactcccaccataaaaacatcactcgcaacaaaaacccccaacgcggaaaatttggttttccgcgttgggggtgtctttctacgaaggaccaatcactcttccaactcgttctcccgaatccgaagagcccctgtgggacacgcttctgcacacttgaggcagtcaacgcactcccggatcacgttgctctgctggaactcaggtcggatggtagtatcaaaaccgcggcctaccaagccgaggattccctttcccaccacctcgtcacacattctgacacactggccgcacaggatacacttgccttggtcccgttcaatggccaccaagcgtttttccttatagctgggatggagctttcccttcccattgcctttgatccgctcaatccgttctggctgaagctcgtacagattggcacagcggatcagcttacattcggcaaaatcatggcagccgcagtccagacagcgggccgcttccgcccgggcctgggcctcggagaagcccagattgatctcctgaaagtcgtgcttccgctcctccgggggacgggtgggcatcttggcccggggcagcttgatataatcggcaaagtattcaggagacaccttcttcaccgagagataggtcttctgatagggtacctgcatgccgttgaggtacaggtccaccaccttggcgcagcggcgggcctcgccaatggcctcaatggcaatggacgccccttggtttgtggcatctcccacagcgaaaacccctggcatagaggtccgataactggtctcatccgccgaaataatgcctttccggttgagttcaatcccctcaaagcccgccacgttggccttttgtccaatggcgctgatgacacaggtaaccggcagggtttcaaacttcccttccacaggcaccggacggcggcggccgctttcatcgggctcgcccagttccatcacttggagcttgatctccttgacccggccattttccccgataatctccgcggggttggtcaagaatttatagatcacgccctcttcccgggcctcgtcaatttccagctgttccgcaggcatctccgcctctgtccggcggtagaccacatagacctccttcgcccccaggcggaccgcagtccggcaggcatccatggcggtgttgccgccgcccaccacagccacctggtcgccaatggcgggcttctcccccatggctacctggcgcaggaagtcaatgcctcccatcacgccgtccaactcttccccaggacagccgatgggcatactctcccacgcgccaatggccaaaaccaccgcgtcatagctgttcttaaattcctcaaaggtcacatccctgccgatgcggaaattgttcttcatctccacacccagggaggcaatctccgcaacctcctcgtccagcacccgtttgggcagccggtattccgggattccgtaccgaagcattccgcccatctggggcatcgcgtccacaacggtcacccggtgcccttttaaggacaggtagtaggccgcggtcaagccgcctgggccgccaccgatgattcccacacgtttgccggtggccgccgctttgggcggaagatacccgccggcttggatcacccgatccgccgcaaaatatttcaagtaggcaatggagatcgactcctctaccatctggcgccggcagccatcctcacagggatggggacaaacccgcccaatgcaggcaggcatgggcaggcgctccttgatgatccgcacggcttccttgtcatccccccgggcaatggcctggacatatccctgggcattgacgctggcggggcagttgagcacacagggaccccggcagtcgccgtcgtggtcactcatgagcagctcaatgctggttttccgggtccgaaccacccgctccgattctgtatagatcacctggccatcctgcgccaccgtggaacaggcccgcagaagtttggggcttccctccgcttccaccacacagaggctgcagccgccgtaatgcttgagttctccgttgtggcagaggttcgggatctcaatgccgttgttctgggcgatttccaggagggtttgaccagctctgccagtacaaatcttaccgttaataatgactttaattctcgttttcattctatgcccctcccttcttagtccaccacaatggcgccaaacttacaggagctgacgcactgcttgcacttgatacaagccgactggtcaatgacatggggctctttccgggtcccgctgatgcactccaccgggcacttccgggcgcagacagtgcagccggtacatttggccgggtcaatggagatggtcagcagcgccgaacattcatgggcgggacatttcttatcccggatgtgggcctcatactcctcccggaaataccgaatggtggtcaagaccgggttgggcgcggtctggcccaggccacacagcgcaccatccttgatgctgacgcacagctcttccagcagctcgatgtccccctcttgtccttccccttcgcagattcggttgaggatctccatcatgcgggtggtgccaatccggcaggggacgcacttgccgcaggattcccgggcggtaaagtccaggaagaaacgggcgatgttcaccatacaggtgctgtcatccatcaccaccatgccgccggagcccatgatcgcgccagtggccgacagtgccttatagtcaatgggggtatccatcaaggccgcggggatacagccgccggagggaccgcccatctgcaccgctttgtaggcccggccgtccttaatgccgccggcaatgtcaaaaataacatccttgagcgagttccccatgggaacctccaccaggccgccccgctggactttgccggtgagagcaaagaccttggtgcctttggagttctccgtgcccatggccgcaaaggccgtcccgccatgttgaatgatccaggcaacgttggcaaaagtctccacgttgttgatattggagggctcattcagatagccgctctgggccgggaagggcggcttcagccggggcatgcctcgcttgccctccatggattcaatcagggcggtctcctcaccgcacacgaaagcgccggcgccaattttgatgttcaggtcacaggaaaagtccgtgcccaagatattcttccccagcaggccgcggctacgggcctgttcaatggcctgactcagccgctccaccgccagagggtactccgcccggatatatacatacatgtcgctggccccaatggcataggcgccgatgagcatgccttcgatcagggtatgggggtcggactcaatcaccgcccggtccataaacgcgccgggatcgccctcgtcggcgttgcagatgagatgcttctgctccccttccgccttccgggcggcgtcccacttaaaccaggtggggaagcccgctccgccgcggcctgccagcccggagaccttgatctcctcgatcacctcttccggcttcatcttcagggctttgtccagggcctggtaaccggcatggttgatgtagtcgtcaatgctggtggggtccaccacgccgcagtttcgcagggccacgcgcttctgttttttcaggaaccgggcgtcctcatcactgatgaacatggcctccagcttggaaaaatcctttttccgcaccgcttccacgatccccagcgcgtcggtctccgtgacccgcaccaggcggtggagcagctgctctccctcgtaaatatccacgatgggttccaaatagcacataccgatgcagcccgtggtctccacggtaaagctgtcggtggcggtcatgtggccggcaagcactttggccacccgggccgcgccggcggaaaccccgcagctgccctgccccaccaggatacggatgccattgcccgcttcccgctggcgcaactggcggagaatcttaatggttttctccggggtaagattcccataggtatcgccgttaatcatcatcaccggggccagggagcagcagcccagacaggccacctcgttgagggtaaacattccgtcttccgtggtctccccattgtggattcccagttcctgggtaatagcggtccgaatgcgttctgatccgttgacatggcaggccgtcccatcacagagcatgatctgatacgtccccatgggctgcaagcggaaatagctgtaaaaggtggctactcccatcactttggccgggctgttgcccgtgcgctgggccacatggtagatgacctcctgaggcagatagccataaatcgactgggcctgctggagaatcatgatcagactggtggcatcctcctgatattggcgcagtacgccttccatcagggataggtcaacacctgacttgaactcggtcattattttcactcctttgattgacggggatttcgtttatcatctttacagtttttttatcttatctttcattttccccgtggcgtgcaaaacattatcggttaaattatagtcccctggcacacgatttgcaagcccaattccacgactggccaaaagtttttgtatactttcccctaaaaatctgacattttcccaggcttttcgtctctcttttgttccttttctcacaacctttgcaaaaaaacttgcaagtgaaaaagagacttgaaaacttcaagtctctttttgcatgatttctttcaaattgtatgtcatataccgccttgggcagaaatctcacacgtgatgcttcacccgatcatgttcctccgcccgcttggcgttgttaaaccgatccagggtccccaccaagtaaccggtgatccgacggatccgctcaaagggcacgccgtcgtcctcatggcgtccgcagccagggcactggtccccgatgatcccagagaatccacacaccgggtcccggtccaccggatggttgaccgaaccgtagccgattcccttctctttcatacaccggataacccgttcaaaggcgtccaagttctccgtggggtctccgtccatctcaatataactgatgtgaccggcgttggtcagggcgtgataaggcgcctcaatagcaatcttgtcatatgcggagatggggtagtacaccggcacatggaacgaattggtgtagtaatcccggtcggtaatcccctccatgacgccgtacttctccttgtcgatcttgacaaaccggcccgacagtccttccgcgggcgtggccagcagggagaaattcaggttgcgctttctgctctcctcatccatccgggcccgcatgtgtccgatgatctccaggcccagcacccgggcccgctcgctctccccgtggtgctccccaatgagcgccttcaaggtctctgccaggccaatgaaacccacagacagggtgccgtgcttcagcacttcccggacctcatcatcccagtccagctgatccgagtcaatccaaaccccctgccccatcaggaagggcgcgttcttgaccttcttccggcactggaactcaaaccgctccagcagctgatccacgcacaggtccatcatgtgatccaagctctcaaagaaggtattgatatctcccttggccttgatccccagccggggcaggttaatggtggtaaaggacaggttgccccgcccgttgcagatctcccgctccgggtccaccacgttgccaatgactctcgtccggcagcccatgtaggcaatttccgtctccggatgtccttctttataatattgcagattgaagggcgcgtcaataaaggagaaattggggaagagccgcttggccgagcagcggatggccagttggaacagatcatagttgggttccccaggattgtagttgaccccgtccttcacccggaaaatctggatggggaagatgggggtctccccattgcccaggccggcctcggtagccagcatgatatttttcatcaccatccggccttccggcgtggtgtccatcccatagttaatcgaagagaacggcgtctgagcccctgcccgggagtgcatggtgttcaagttgtggatcagggcctccatggcctgataggtcgcccggtcggtctccttggtggcccgataatgggcaaaggcctggcacttgcgcatctccgcttcatcctggctgtaatgggccagcaaaaagggcatctccgcctggaaatactcctcacagtcctccagcttgggatacaggccggtctcttccttaatcttctggatattggccttgatctcgctttcagggtctgttcgatcctccagcagcatcaccgcccgagccagattctggcgataaatccgctggaacgtcttccgcactcccatggccatggaataatcaaagttcacaatggcttgcccgccatgctggtcgttctgattggattgaatggcgatgcaggccagggctgcataagaggcaatgtcgttgggctcccgcagtgtgccgtgccctgtggagaagcccccatcaaagagcttaatcaggtcaatctgggtacaggtggtggtccccataggggcaaagtccatgtcatggatgtggatatccccgctggtgtgggcccgggcatgctccggcttcatcacaaacatctgatagaactgcttcgacccctcgctgccgtacttgagcatagtgcccatggcagtgtctccgtcgatgttggcgttctcccgcttaatgtcgctgtccttggcggaggagaaggtaatgtcctcgtaaattttcatcaggcgggtgttcatctcccgggcccggttccgctcggagcggtagaggatatacgccttggctgtctgaacatagccattgtccatcagcacccgttccacgatatcctggatatgttccacatcggggcagtttcccccttctacctccagcacagaggccacctcatgggccagcttggccgcggtctcctcatagcccggtttataggtggcctcaaacgccttgttgatggcgtctgcaatcttattctcatggaaggggaccactcttccgtcccgcttccgaatctgttgtaccgtggtcatcgagcgtctctccttcttatccaaactcccatctccgccgggagcatcttgtggttttcctatcacaaaaacacacgatattgtgtttccttcgaatcagcacccacatcatagcacccgggcactgtctccgtcaagacttgtctgggaaaattattgcacaaaatttagggtccgtctgtgacttcggcaccatggcttgtgtgcccatgcgcccgctcccggcagactccccgcttcccaacggcgccctgctcttccaggatttctttccccagccgcccaggagaccgacacgggttacacgctgtccgaaaattggtacttcaccaagagatgacagggcagaatctcctcaatccgggcctttgtctgctcaaatcccgccgggatcccctccacaccgggaaaggaaaccaccacctccagcgggtcctccgtctcctccacctgggccgggattccacagccccggagggtatcgttcatggccgccagggtaaagctgtcccccccaatgcgaagcagcgcggccaccgtctggcgcagttcttccaaggtctcccctgcgcgctccagtcccagcagctccagcagtcctgtcagcccttccgcctgggccgtgtacagattcatctcccgctggaggagggccacctgctccgccacctggtccagcgcctccccttcgctctggagttccccccactggaaggagccctcccatcggtaaacccccagcggggccagcagatcccgcaagttctgtccatgactcatcgcagttcctccacagagacagactccagcaccggcagctggttttctgccaccaccacatcgttggccgggccttcaatccggtagttgtcaaccccctccacctggtaaatgcgctgcccaatctgtgccagaagaaggtcccggcccagcatgcttccgtcaaaccaggtctccatggcctcctgtacccgggcaatcaccggcccaggcagcagtccgggctttggtttaacagagagaatgagccgtactgccaccggttccggcgccaaaaccgccacgtccaccgcgatctcccgcttctgctccaaccgctcctggacctgcctgaggagctcttcccccggcagaccctccaccccggcaatgatcacatccaccgtacccattccccggtttttgggcagaacccgcaccgcggtcaccccctccaccgccaaggcctcctgggcatagtaggctccattggtgccgttgggtagctgctggtaagtggccagaatccgggcccgcagttcctcgtccccttcttcctcccgcccccctgtaaacgggaccggattggtacaggcggccacccccaccggcgccaccgccatggtgcggaccgtcccggcggacacattgccccccggcccgggttccaccgcctgggccgggaggtccacagatagctcccccgcaggcagcaccccggcctgggtggtctcaaaagccaccagccccgccgtcatacacaccgtcccttgggcaatctccaaatcctcctccaccgcctcctggacagagaagcggagggtcccactggcctgccgggcagggtttcgggcaatcccccgcagaaacccatgtttttccagttcttcccctgtggccgtctggggaaaacactgccggcaggtccaggccagctcctcatagagcccatagacctgtgccgccagggcatacatccgcaccgccatctctcccgtgccgttgggttccattccggtctcctgagaaaaccgatccatcatctcccggtaaatttcttccactgttttcatatgcttcccgcctcctgtcggtcctcttgcctgtcctgccaccccagcgccgccgcgtccagcaccgcctgcatgggttctccctgccactccagttccacggtcagcgtccgggtttcctccgtccaaaccgcacccaatacccgcaggttttcctcccccgccagggcctccgcggcatagctggcccccagtgctccccgggccgagggccgcgcccgagacagcagatacagtcggctgcccacctccggcagcaggggaaatccgccccgacgggctgtgagcagaaagagaacccgctccagtacccctgccccgcccgtggcaagggcaaagccccccgctccatcggggcggtaatccccttcccgcagctgggtcaccgtcatcccctcacctcctgtccctggagccacagcgacccctccacctccacccttccctggagctggatggtcccctccttcgtcagccgaatccccgcgcctggcgccacggagatccacacctctccgggccggatgctttcctccacctggccacccaccacgcagggggcctcctccggcccgctcttcaccaccagcaccgtctctccccggtcaggaacccagtgatacccgcccggcagacaaacccgaacccgccggcgttcccccgccagagacacccccactgtgtctccggataacgtcacttctccccattctgccccaggctcctgcagccgggtttcctgctgtcctcttgccatccacatgagattgcctccttttctctcctttataaaaccccctgagggtctcccagcaccagggtggtctcatgccccagttcccccaggcagacccggctctctcgcacccgatacgttccattcccgctccatcccgttcgggtcagccgcaccaggtcccctggccaggcggcaaagggcagcgccaccgtcacttctatgaccagcctctccgccgccgaccggtccaactggaacttcgcctgataccgccgggcctgaaagccggtgtccttaggcagcaaaatcacccggctgcactggcctccccgccgccgaaagtcctcattgaactctgtctgccgggtccaccccgtcacatcttttaccgtgacctgggacaataccccataccgctggtcccgccggaccaccctcgtcaccggcgcggtctcatccagcgccgccggggttttatcctcccaggggtggagcgccagcttccccgcccgggtaaaccgcggtgtcacgcctgcatagtaacgggcaaatgtatacaggaccttccagcagctgctccccgaagccaccgaaaagccctgtaccgccggcagcgacactgctttttccagtccaactccatagggggtgacataccgccgcagaatttccgccagcgtcgcctgtccatagtccgccgcctccgcctgattgtccagcagcagcgcctggagcccccgccctgtgatctctgccacacatccagccggagaccactgggtttcacattcgtcaatcaccccgaaaaacagcgtctcccccttctcggtcacccgcagccgggttccatcggccagccggctctcctgccccgccgaccacagcgtcttcacccaaacgctgtcacaaggggtgccaagcccatagttcagccgccaggccaccggcgtgggcaaggtgtactccgtcccgtcatagcaaagcatggtccattccattccctcaccccctcacccgcagacgctgtcccggctggatcacattgggattcttgatctgcggattcaacaccaacagttcccccagggtcatgccccaggcccgcgcaatgccccacagggtctcccccgagaccaccgtgtgatacaccgctgcctctgacacttcccctcccgctgtctgtccgccgcctcccgcctctggacggacaggctccagctgctcccggtaccggtcattgtcctcccaaaacgtgaaggtataccgtacatagtcctgccttggctcttgggccagggtcaagtccacaaagtacgccttggcactctgccatacaggatggatcaaggtccccggtccgctgtgatagaacacagaggccagcttcttaaactcctcataggcgcctgccccgtaaaattccccctctcccttcatcacccgccggcccagccccaggtcctgcatggcataccgtccaaagggcaccttgtgaaccgccacctttcgcacatactgaatggtataggttctcgggttgtggggccagacatagctcttatactgcatcggcgtcagttccaccctgccgtctcctttctctctagtcaatagaggaaaaatcccccgtcataccgccgggcatcccgctgcaccgcccggtccaattctccccaatcggctgtcgttctctgctccagggattccgtcaacgcaaaaggcgtcacttcccgtcctcccattgccgcctgggcgatctgtctggcctgtcccagctgcgcgtacagcgaccacccctccggccggggccgtacttgttccgtcaggctgaccatctcctgcgccgcctgctctatggtctccagcacatcctctcccccggtccgccggcgttcctccagactccacgcctccgcagcagccccacgctgtcctgcgtctggtgccggagccgtctcccgttccctgtcttccgggagaaattcgttttctctccctctcctcggccaacggggcagtcccaacgcagattcccactcctcctcttccgccaacagggtctccaaataatcaatcacaggccccctccttcaatgcctgaaaccgggcccagtcaaaggtgggattctcctcccggaccatctctcccgtctcccggccgcacaccgggcaccgggccctctccgccgcctcccggcactgagggcacagctgacgggccacttcctcttcatccaacagaaggttgaccgcgcaccacaggtagtcctcctccctcatcgccttggcccgttcctccgtcggcagcgccccaaaacatttgagcacatgccaccgaaggcgctgccgcggcatgtgctccaggctttttttagctggtccagccggctcctctccagtccggtccccagaccctcctcctggtaaaacgccatccaccggcgggccagagtttccacctggcccaccgtcagcctgtgcagaacctcctccccggacccatacaccggacgcccccggcgaaccaccgcccgggccaccaggcaggcgttggagcacagcgcccggtctctgtcctcccccgccagcgctgtcgcctcccgccgggcctccagaacctcctgggccgtcagcagccgcagctggaccccgcccggcagccgctgccggggggaggcggtcagaattcgcagccaatcagggctcttcataatgctgtctcaatcctcctccccgccattaccgtgaccttttccaccacagcggcgcccagcgtgccgctctctccaatcttgctccactgacacccgctgtaaatcacccgccggtccggcttgcagatcaccagactgaaatcctccaggtcatggaaatgaatcccgtctgccaaagcctcatccgtggcatagattcgggtgagctccaacacatgccggctctgtcccggaattgtggccaccggttctcgttctccaaaggcctccaccgtggtgctggacttggtggactgggccgtatagctctgaaccaccgccacttttttcccatccacctccagatagatgtcactgctggtgggaatcaaatttgccgccatatcctaaccccccctgtcacacggtgatctgggcgctcagccagatctgattgagtccatgggccaccgtaaaggaaaaggtcaccaggcacaccgtgggcgcctcctccagcggctggacggtaacctctccataccccgtgatgatctccgaggccagcttccgctccagctccaaaatcacctgggagcgtaccgccccccgggtctgggccgtgtttttggcccggggaaacttggcccgcagggcatttctcaccccggggatgacatcgtccaccaccaaaattgtggtcagctcccgccatgtgctgtcggaaacgcctccggtggtggtccgagtggtcacgccgcggaccaccgaacacacgccgcccgccagctccaccggggtcacacccccctggagcagcgtgtccagttcactctccccatagcggagcgccaggccgggaatcccccgcagctccacgccgcccaggggaagggcggggtctccctctccacagatggccccggccaccgccgccgccaccagcgcaccgcctgcctcttccgatatccccggtgccaccagcaccacccgctcgctgttgagttccttggcccgggccaccagctgactgacggattcctccgccccgccaggcaccaccgcgatccgctcccgacggacctgggcatccgccagcacctggtcccgcagcgcctgctggacagacagcgtctggctgtcgcagaccaccaccttgaccgactcctgttctcccaacagcgcaaaggccgccggatagtccgcctcctcttccactggaaccgccagcacccgggccgccccgttggccatgaggagcttcaccagcgcggtcagagcatcctctttcccaaacgtggtctccgcctcctcatagcggcccaaatcatacagtttccccggggttcccccctggctccgggccgccacggcagcccacccccggcgggccgctccactgaccactgccgaggccgcataaaccgagtacacccccggccgttcatgggttgtcaccatactgctcacagcgtcacctctcctctcaccgtaaagccctccaattctccgctctcctccattcctgccaccagcatgccccggcacaccgcctggagcttgccccagaacatcccgctggcctggtcgaaggcagtctcccccgcggaccacttctccacagcgaatcccgccggtccccgttccatcagcgcctgtgccacctgctccagcagggcctggcagcctgactcccctgccgcctctgggctgtaaagggtcaccccaaacttcaccgtgatccgccgcccataccgctcggtccattgccgggccgccggatcataggtctgccccagatagttctgaaagccggacgcgccggcctccacctccttgacctgtaccaccgccaccggcgtcttccgccccttccagacctccttgggccaggcggagagggcctcaatgcccgcctccgccagaaatgcggtcatcgcctgccgaatcgtggccaacgtcgtcatgtcacatctccctcctgcctgaccagaacggcccgccaatagatccgctcccgtcccgcctccacggcgctcacgttccgcaccccatagaacctctccccctgctgcaaaacccagtctcccggttgttcctccagcggaagacttgcctctgccaggcacagcaccatttcctgccggcgcaggcccaaatccgtgggcacaaactgccgcgcctcccccagcagaggacgcagcaccgcccgccccgtccccacgatctctccgtcccgccacagggtcaccgtctggccataccgggccgcaatggcttgaaaactgccggcaaagctcatccctccacctccaaaaaggcaaaacacccgtcctgtacatagggctccatcagccgctccgcctggctttgtaggctcctggcacaggcgtctcccgtccggtcctcccgggcccgcaccgtcaggtccccggcggaaaaggacagcggcgtgggctgactctgctccaaagcccctgtcattcctgccagcgccgtccaggcactggccaccaccaataggtcctggcagtcctcttccgtcacatcctcccgtaggcgccccagccactgctccaacgcgccgccgcacaggatggagaggacgttctcctctccatccgtcagttcccgtccggcaaagcacagggccacctccaacactgcctgccgagaaatcatccttcttcccccgctgtcccgatctgaagcaccttagaggccggctgaaacaccttggcaaatccagaaatcgaggtgatggccgcccgctccagctgccggtcaatgagcttgtcatactccaccagcacctcactgccccggaccagctctaaggcatactgcctgtccaaaccaatgatggtcccggagggcaccgcgctgcttcggagcagggtggcccccatgggggttaccagctttcccgttccctggaaggccagccccgccgtgctgtcctgcatctcctccagcttgaggatttgggccatggcgtcgcccaccagcagggtattcatggtataggggtcaaactgactccaaaagtccaccagcgcgtcatagctcagggtccccgctgtcccggcgatgggcttggtccccacggtgtactgatcggcgccgttcttgttgccgtccccgttgcaaatcacgtcaatggcgtcggccacatgcatccggttgatgtaggcgccgatctgccgcagggtgaccgagaacaaatccagccgctggaactggatggcctcataggaggccaccagcatccggccccgcttgtgcagcttcaccaggttttcctgggcgctcacccgggtctccgggatcatcgccccctccgccaccattttcagggatttctcctcctccgtgggggtggaggcgatggaacggtaatccatcccgctgatccgggtttccgccgctgtcatcaggggcagaatattgttctcctccattccctgtcgcaccgcccgggccacatattccgggaaaagcaccgccgattcccagctggcaaagaacttggacaccacatcggagtccgcccccttcaccttaatgtcaaaccgtttcagctgccgctgaaaggcatccaaatgctccagcggcgtccccttgtactgctccgaggggtcacacttctccagcaccttggtaaaggaccgccccgcttcgctgtacatccccttgtccagcttcaccgtctcaaactgatatgccatacatcccgtctcctttcacgcctcacaggaacaaccccatggttttttcctctgtgttcaggttcaccaccaggcaggctctgcccgtctccccggtctgttccgggcgcaggcccccggctccgtcggtcaccagccggttccaccccagcaccggggcgggggacccgctgtacttcacccggacatatccccggatttgcaccgcggcgtgattgttccgtttgttcagcaccacgcccaccggcgccacgccgccgttggcgttgcgcacggtgtcattgccgtccattcccgcgatgcctccggtggtcaccgctaccgccttcatggttaccaccatgcttcccatgccgccaaactccacactcatgctgttctcctccctttcttcagatcacaaaggacccgtcgtttgcctctgggcccgtctctcccccgtcgtaccgcagctgcaccggcatgggcagcttttcctccagccgccgggcatagcaggcccgcagccgttccagctccggctcttccagcctgtcggcaatggcccgcagggtctcaccccccaggccctcctctgccaaaagacccagccggaccgtctcctgccgcagcccgtccaggtatcgccgccccatctccgcctgccgccgcagggccttcagttcctcccgccaggggccctcttggtccagactcgacagcagctgttccaacgtgcccgcttcccggaagcctttgaccaccccagctctgggctgggcgggaaccgccacaaaggaccactcaaaggcgtcggtggggtctgccagccgtgcaatgcagcgtttgccctcataggttctccccttcacatggctgcacagcccccggtcatggatgtcatggccgcagatggagcacacacaccgggagaccgcgcagctgacgctgacctccttcttgatgccccctgcgatctccgcaatcagcccctcgttctcctgggtccgcagcatgtacgcataccctttcaggtagcaccccggctcccccgcctcagagcgcacccccggttcctccaccaactctgtccgataaatccgggcccgctggtcccgggcgctccagttgtggtcaaagattcccgtcttccccacaaacaactctgccagccgctccaagtccttccggctgaaatattcctggtcccggtctgtctggttatcgcacaggcgcacggtaaagagatagacctcctccgccgtcaggctggtgccgtttctctggttcacgatggccagctcctcctccacgggggctgttttcccctgggcctgggcctccttggtcactgtctgcataggcttcctccttctcctgttgtctttcctgatctctgctctcccgggccatctgttccgcctgctgccggtacagggccgcccgggcctcctccacctgatcctgcaagtcaatttcctcccactccacttggaaggcgcagtcctttccatgcatgcgcagccacagcgtacagatcttttccaccaccggggtcagggtccgccgcagcgcggccagctcactggtcataatgtccgcctgctggctgctcatccgctctgtggaggaccagttcagccccagcaggaagggaggaatccccgtctgggcgatcagctgctccagaatcatccgcaccggtgcctggcagtcggggatggcgcactccgcgccaatgaccttgatctccacatcccccaccgccacaaagtcccgcacagccccggaccgggtgctctccatggcctctgcccaccgctgggccagcagctggcttctcgcctgcacccgccggtggtccagcgcctcttcccccggcttgtacaccacggcaaagcggacattgcccgcccgttcccagttggcgcccagggtctgatagattttcagcagcacccccgacaaaaagggcaggctgtggagcagggacaccccgtacggatgctccgggctggggtggtacggggtaaagagcagcagctcctggcgaggcagcacctctgtccggccgtccggccgccgcagggccagcaaaacctccaggggggagtccccctccttaacctggacatccgacacccgcccgcacagcacagcggcaatgtcccgcccatcccggctggggacaatctctcccaccgcccgtccacaggtgagcaggcagtccaggtagctgtccaggaaagcctggatgcccttttgattccaccccaccggcaccgtgcggagaaagtggttcagcgcccgctctgcctccttgtcctggcaggtcacccccacgccgccggccagccggaccagcttcagcaccgccgcgtccaccaccggcaccgcctcccgaatggcccggtacagggaaaactccggctggtgcaggggcacatatccatcgatcagggaaaagggatgccggtccgccggccgcagctgaaccggtgccggcttctccgggggttcctttcctcttcctctccaaaatcccatgacacactcctctcctatctgctttcaaacgtgccgctccacatatccggcaaaaaagaggtcctctccctcctccggcgccaccactgtggccacgaaataccggatctcatccatggcgtggtcaaattccttccgcacccggtcccggtccccggcggacaggtcccagcaataggaggcaaactcccgaatggcgtcggtgcaggggggacaaatgacaatcttcccctgcttcagggcgtccgccgtctgccggatgccggagagcacctcattgtcggcctttctcacgtgccagccctcccgccgcagcacctccaaaaaggaggccgctgaggggtccaccaccaccgcctcaatctcccgcccgccggccagctcccgcagccgctgggcgtactcctggtcggtctgctgccgccgggccgcccgggcgtcgtaataatactcttgcacccggtaccacaccccgccccactttccccacagtcccatggaggtggggttgaccgtcccatagtcacaggagatcacccaccggtccgctggttccgccggtgccgaccgcaccatgctctcctcaaagaagtcatagaccagcccttccgccgcagtccactcccccagcacaaaccgccggtaaaaggccccctgaaaggtccgctcataccgctgccgggtttcctgggacagagtggggttgtcctccataaagaaccgcaggtggagcaggttccgcgcctgggccttgcagatccactcccgataaaaccagtgccccggccccgccgggttgcaggagaaccagaattttgcccccgtcacagagcaccgggcacaggcctgctccacaaaggagcggggcatcagcgccacctcgtccagcagcacccccgccagggtcaccccttggatcagcgccgcgctcccctcatccttcccgccgaagaggaaataggtgttctccaccccgccgcaccggatcttcatccaattccgggagagtttctcctcccaggtaaaccccaggccctccaaaaccggcagcacgctggacagcagattccgccgcacagactccgtggtctttccgcacagcgcaaactgctgccgctggaatcgggtcatgctccacaggacaaaggagaggcccaggcacaaggtcttcccgctgcgcaccgccccatcacagaggatggcatcctttcccgcgtccggagagccccgattccaccaccgaagcacccgcttctgcttttcggaaaagcacagcctcatcgccgggagcacatcccctccggtgcctggggccggtccagcgcctctaaaaaggccgccgcgccccggttctcctcgtccttcagctgctccagcagcttttccagtaccgccgcccggtcggtgagcttcacctccaccgccccgctgctgttccgcttaaactccgtcaggcaccccaagtccaacgtgtcaatctcctgggtctgctcctgggtcaaataggccagcttcaccacgtcgttggccgcccccgccgccagggccatcatctgctccagcacagctcggcggttcaccgttcgttttcccactgtcatccctcctcaccctatgggaaaacacccccttgagggggacgttttcgtacaccctttttcaaaaaatcaaaaaatttttcaaattttctttcccaaggccgatgtttcccggccgccccgccgcttccccaggttccatttgacacccctccccctatttgctatcctgaactcgaggtgaaaccatgaaacgaaatcgcgtctatctcccccaatcccttcccctccccttctccgcagaacaacttgaccccctgccccgtctcattgccattttggagagctcctttgacggcattttcgtcaccgatgcccaggcccgccccatctggtgcaaccactcctacgaggtcatctccggcctaaccgcccaggaggtcctgggggtccccatgggggaactggtccgccggggcaccatctcccactccgccaccctggaggccctggcgcagggccaggcggtcaccatcaaccagaccttcaccaccggcaagcgggcggtggtcaccagcacccccatttacgaccaaacagaccagatttgcctggtggtcaccaacgtccgggacatctctgagctcatcgccctccaggagaccttggaccaccaacgccgcctctccgcccgctatcagcaggagatcgcggtcatccgggaccagctcctccacaccccccagctggtggcggaggacccggccaccctgaacctcctgcgcatcgtgggccgggccgcccagctggacacggtggtcctcatccagggggagacgggcaccggcaaggaacggattgcctcctacatccaccagaactcccctcgggcccgaaaaaacttcatccgggtcaactgcggcgccatcccggaaagcctggcggaaagtgagctcttcggctatgagcggggtgccttcaccggtgccaaccgagagggcaaacccggcctcttcgaggtggcccacgagggcaccattttcctggacgaagtaggtgagctctccctggccacccagaccaagctccttcgggttctccaggaaaaagagatcacccgggtggggggcagcaagcccattcccattgacgtccgggtcatcgccgccaccaaccgagacctgcaaaagtgcgtcaccgaaggcgccttccgggaggacctctactaccgtctgagcgtctttcccgtctgggtgccccctctgcgggagagaaagctggacatccccaaactggccgcctccgtcatcgaggaactcaaccagacctacgagcacaaaaaatcccttaccgtcggggcggaggccaccctgctccaatacccttggcccggcaacgtccgggaactgcgcaacgtcatggaacgggcctttattatgagcgacggagaggaaatccaggctgaggacctggccattttggacaacggcagtctccacacccccaaaaccatctcccccacctacggggtagagccccaacacccccagtccccagcccccgcaccggaatgtccccctcttacggaagagagcctccaggcccaggtggagcggtttgaggccgccctcatcgcccaggccctggcggaggcgggctccctccgggctgcggcccgccggctccaaatggacccggccaccctcctccgccgaaagaaaaaataccaggcacagcgccgcctgctccccgactgattcatttctaaaacaccttcccccggcgatcccagtgtttcagttttgcggcgtgttttattttcaaaacagaatagcctcccgcccctggtttctctctgtgtttcgtcacaaaagaactcccctgtggctcggtctctctttgatccggccccaggggagtttcctttttccgttcttttttcaaatttttatcctgtttttttgcctggttttcttttttgcccatagttggcacgataattgcttgtattgataggcgaaggcaatttcacctccttcgctgacaaatacattcttgcacctttaggagaaccacatctcaaaacacggaaaggacgaaatactatggcaatgatgactggaaaagaatacgttgagagcctgcgggccatgaagctgcgggtctacatgttcggcaagcgggtggaaaaccccgtggacgatcccatcctccgcccctcggtcaactccgttcggatgacctatgatctggcccagggtcccaattataaggcgctgatgaccgccacctcccatctcaccggagagaccatcaaccggttcacccacatccaccagtccaccgaggacctggtcaacaaggtcaagatgcagcgcctgctgggccaggtcactgcggcatgtttccagcgctgcgtggggatggacgccatcaacgccgtgtacagcaccacgtacgaaattgaccagaagcacggcaccagctaccacgaaaacttccgcaagtttgtggccgaggcccagaccaaggactggaccattgacggcgccatgaccgaccccaagggcgaccggtccctgcccccccacaagcaggaggacccggacatgttcctccacgtggtggagcggcgtcccgacggcatcgtggtccggggggccaaagcccatcagacgggcatgtgcaattcccaccaggtcctggtgatgcccacccaggccatggggcccgatgacaaggactacgccgtctccttctccgcccccgccgacgccgagggactgttcatgatcgtcggccgccagagctgcgacacccggaagctggagaacaccgacatcgacgtgggcaacgcccagtacggcggggtggagctgctggtggtctttgacgacgtgttcatccccaacgaaaacatctacctcaacggggagaccgagtttgccaccatgatggtggagcggtttgccggctaccaccgccagagctacggcggctgcaaggtgggcgtgggggatgtgctcatcggcgcttccgccgtggccgccgactacaacggtgtagccaaggccagccacgtcaaggataagctcattgagatgattcacctcaacgagaccatgtattcctgcggcatcgcctgctccgccgaggggaccaaaaccgcctccggcaactaccttatcgacctgctcctggccaacgtctgtaagcagaacgtcacccgcttcccctatgagatggcccgcatcgccgaggacctggccggcggcagcgtgggcacctgcctgtccgaggccgacctccggggggaattcaccggtccctgggtggccaaatacatgaagaacggcaccggcaccaccgcggaaaaccgcatgcggattctccgcctcatcgaaaacctctccctgggttccggcgccgtgggctaccgcaccgagtccctccacggggccggttctccccaggcccagcgggttatgatcgcccgccagggggacattgaggggaagaaaaagctggccaagcgcatcgcccatgtgaaagaggactgaccgtcccacacccaacgtcaggaggagatcacgatgactgcaacgctggaacaacttctggagacactggtccgccccgccctgcgcgcccacaatggggacgtggaactggtgggctaccaggacggtattctccggctgcggatgctgggccagtgcgccggctgtcccgccgccgccatgaccaacgagaccttgatcgagggccagctcatgcccctgctccccgatctgaaggaggtcatcctggtccacaccgttgacgcgtccctgctggccgaggcccggtctcttatgacccgggcccggtcccgggaccaaggataacgcaaaggagggatttcccatggactggaaaacctggtatcaagagcacctctgtcccccccagcaggccgtccgccggattcgttccggggaccgggtggtggtggcccacgccaccggcgagccctccctcctgctggatgccatggtggccaacgccgcccaatatgagcatgtggagatcgtccacatggtggccatgggcaaggcggaatactgccagcccgcatacgaccgaaactttcaccacaacagctttttcctgggggccaccagccgggccgccgccgcggaagggcgggccgacttcacccccgtctacttctccgaaattcccgcccttctccgggaccacctccaccccaacgtggccctcatccaggtctcgcctccggatgagcacggctactgcagcttaggggtctctgtggactacaccaaaaccgccgccgaggaggccgacctggtcatcgcccaggtcaaccaaaacatgccccggaccctgggggacagcttcctccatgtcacccggtttgactgcatcgtggagagctgcacccccgtcattgagctgccgccccccaagatcagccaggtggagcgggccatcgggcaaaacgtggcccagctggtccgggacggggatacccttcagctgggcatcggcgccattcccgatgctgtcctgctgttcctgaaagagaagaacgacctgggcatccacacggagatgttctccgacggcgtggtggagctggccgaggcgggcaacatcaccaaccaaaagaagaccctccaccggggccagagcgtggccaccttcctcatgggcacccgccgcctctacgactacgtggacaacaaccccgccgtggccatgtaccctgtccagtatgtcaacgatccctatgtcattgcccagaatgacaacctggtctccatcaactcctgcgtgcagattgacctgatggggcaggtggtctccacctccgtgggcctgcggcagatctccggggtgggtggccagattgactttgtccggggggccaatatgagcaagggcggccgggccatcatggccatgccctccaccaccggcaagggcaaggtctccaagatcgtccccttcctggaccccggctctgcggtgaccaccacccgcaatgatgtcaactacgtcatcaccgagtacggcatcgcccagcttcggggcaaaaccctccgccagcgggcggaagccctcattgaaatcgctcaccccgatttccgggacgccctgcgggaggagtaccgccgccgcttccccagaacctattgattccaaacgaaaggcacggtgcattcccatgacacagtttgtcattcatccctccatctggcagtacgacacctgccaggccttcgcccaggacttccacctgggtccccaggacctgctcctcaccaatgagtttctctacaccccctactttgcccccttgaacctgccctgcccggtcctcttccaggagaaatacggcctgggagagccctcagacgagatggtggaggccatctaccgggatatgcccaaggaggtcacccgggtcattgccgtgggcggcggcggggtgctggacatcgccaagctcctggtcctccagcatgtcacccccatcctggacctttacgatggcaagcttcccctgcaaaaggcccgggacctggtgctggtccccaccacctgcggcaccggcagcgaggtcaccaacatctccatcctggcgctcctctcccgccggaccaagaaaggtctggcccatgagagcatgttcgctgatcaggcggtcctcatccccgagctgctgaagggccttcccttctccgtctttgccaccagctccattgacgccctgatccacgccattgagtccagcctctcccccaaggccagcgccaccacaaagctcttcggctaccaggccattgcctggattctcaagggctatctggccatccgggaccagggacccgacgcccgcttccccctgctgtcccagttcctcctggccagcaactacgccggcatcgccttcggcaacgccggctgcgccgcggtccacgccctgagctaccccttgggcgccgtctatcacgtcccccatggggagtccaactacgccatgttcaccggcgtcatgaagcaatacttagccattcggtccgacggcgccatcgccgagctcaatgccttcctggcccagcttctggactgcccgcccgaggccgtgtacgaggccctggaggacctgctctcctgcctgctgcccaagaaagccctccacgaatacggcatgcaggagcatgagctggcggagttcaccgactccgtcctggcaaaccagcagcgcctgcttcaaaacaactttgtccccctctcccgggagcagatttacgccatttaccgctccctctactaaatcccccacaccattttgaaccagaaaggatgggattcccatgctgcgtaccgccctgcccgaaatcatcaccgacacccttcccggccccaaggcccaggccctgattgaccgccgcgcccaagccgtgcccgccgccatccgctgtgtctaccccgtggccatcgcccggggcgagggcgccatgctggaggacctggacggcaaccgctttctggactggatcggcggcgtcggcgtgctgaacatcggctactcccacccggaggtcatcgacgcggtcaaggcccaggcggaacaatactttcatggcatgttcaacatcgtcacccacgagggctacgtggccctggcggaaaagctggcccagctggcccctgtgcgggggacgtccaagaaagtgttcttcgccaactccggcgccgaagccgatgagaacgctgtcaagatcgcccgggcctacaccgggcggcccaatctcatcaccttctccggggctttccacggccgcaccctgctcaccatgaccctgaccgccaagaaagcctataccaccggtctggggcctctggccaccggggtttaccgggcccagttcccctacctttaccgcagtcccgacggtctgtctgaggaggaagtttttgccgcctgcctccagagcctccaagatgtctttgaggagggcacccccgccgaccaggtggccgccctcattctggagcccctccagggagaaggcggcttcctccccgccccccttccctgggtcaaggccctcagaaaggtgtgcgatgaccacggcatcctcctgatcgccgacgaagtccagtcgggcttctgccgcaccggccggatgttcgcctcggaatactggcaggaggccggggccgccccggacatcctcaccgccgccaagtccatcgccgcaggcctgcccatcagcgccattgtggcccggtccgagatcatggacgctgtccccgcgggcaccatcggcggcacctactgcggcaatcccctggcctgcgccgccgcgctgaaaaccatcgagctgatggaacgggacgacctggccgctcgttcccgccaaatcggccagatcgtaaccgcccgatgcgcccaatggcaaacgaagttccccctcttaggggatgtccggggcctgggcgccatgatcggcctggagtttgtaaaggaccctgtcaccaaggcccccaacggcgacctggtctccgccctggtacaggaatgcgcccgccacgggctgctcattgaaaacgccggccgttggggacaggtggtgcgtttcctggcccctctgaccatcaccgaccaccagctccactgcggcctggatatcctggaaaacgcactgaaaacctgcacacaataaccacctctccgtcaaaaaaggagcccagccatcgtttggctgggctccttttgggcttcttcctcaccgccgccggcgataggccgggggcagtcccatttcccggcggtacttggccaccgtccggcgggccaggggcatccccgccgcctggagccgttcccccagcgcctggtcactcagcggccgccgggggtcctccccctggatcatcctggccagtgcggccttcgcccgctggggggaggccccctccgcccccatgggccgggcaaaaaagtactccatgggaaacagtccctgacggcactgaaggtatttgtgcctcagcgcccgggtcaccgtggagggatggacccccagctgcaccgccacctcccggcgcagcagcggccccggcgccgcctgacagccccggaaataggccgcctgggcctggaccagggcctgcacgcaggcctccagcgtcttccgccgccgctgcacgcacgtcagcacccactgggcctgctggagcttttgacgcagatagtccgcagtctccgcctccacccctccgcgcagcatctgccggtaggtctggctcacctgatactggggcaaatcccactggttgacaaaaacccgcagctctccgtccatctccgccacccagacatccggccggatgaatggcaccgccggcggttccaccccttcccccaccgggctgggggagagggcgcggatctcccgggctgccgcctccacctgccgctgggtgacccccagccgccgggccaacgccccatagtgctccttgctcagttcctccaaatggccctgacagatggcttgggccactgtatgctcccctggcagccgccgcagctggagcagcagacactcctccagactcctggcccccacacccgcaggctccagggactggagaacctccaccccccgctccagaagctctgccggcacgcctgctgtccgcagccccgccaggtcctccgggtccaaccgtccgtcatcgtccagcaaccccgccaaataccggcacaccgccagcaattcgggcgacagaccccgccgggccaactgttcctccagcaaaaacgccaaggactccgtcggcgactctccccggccccagtccccttcctgggcagtctgtccggtccaaggagtgtcgcccagccagggcacctggctggcaaaggcctcccacgtatcctgcccctgcccctgcccgggctccgcctcctccagcaccgggttctccaacgccagttctttgagatacgcccccagctccagcgtattcatctgcaacatctccatggactgcagcagcccaggcgacagcttcaaaacctgcgccagctccataccctgggtcagttccattgcgatccccctccctgcgcacgggtctcattctgccgtgacttcccacgtttgccggcggctgtcgtacccggcctcgttctccgcaaaaaacaacacttccacctggtaacgctccccgggccggccctggtaggaaatctctcctccatattccatcgtcccttccgtccagagttcgtcggtcttccgatcatatcggaccgtctccatccaaacaccccccactttatgccggatcacaatttcctcggcccccagtgcctctacctgcccctttcccgcaatgaaatagcgaatggtcatcctccccgcctcttccacctggacttccagggtctcccctgctatctgcgggctgtcctccgtctgccatgggctgtggacctggaacatcccctcgtgccccgccgcgggcagaaccgcagcggccagcagcgccgccagaaccgctgccgccatccatccccttttcctccgccgtcgtgggcgcgttgttcccgccgcgccccgctctccttcatagcgtttccaaaaggcttccaaagacgccgatgtccgggccctccgtactgcttccgactgcccctcccgggccatgagttcctccaccacctgaacaacctgctccgcgtcacaggacgacgccatgagaaagtcattctgaagcatctgctccaattcctcccgggacaatgcccgcatggtctcctccaaccgtttcatggtgtccccccttccagctttctcctctgggcccgcagcttttttcgaatacgctgcattcgtttctggcaggaccacagcgagagccccaatcgctctgccgccgcctggtgccccagcttttccagtgccaccatccgaagcagcgccacctcctccggggacaaaagcgccgccgctttttcccagagctgccccgcgtactcccggtcctcccactgccccagctgatcgggtgcagccagggattcctccagcaccgtgttctttgcccgctgcctggcctgctcccgcaggacatggagcgccttgtattttgccgtctggatcagccaccgctccggatgttcccccgccgccagttcctctattttgggaaccgccgccaaaaaagtttcctgaacaatttcttctgccaaaagggcgtcccccaccgcccattgagcatagcgatgcagaacgccataccagcgttcgtaaagggtgcttaacagtgcacgctgtgtctgatccattcttgcccatcccctcccgtgtttttcccccattataccgggattttccacccgggtaaatacaggggcgtcaacttctcccgtttccacaaacttgaaaaatcgtccctcttttttcgcaaattctgtccgtttttcccgccctgtgggaataaaaaaatagcagcattttccccgcgccatagaaaggagcttttatatgagacattgttttcgttttttcccggccgccgtccttctctccctgcttgtcaccgcctgtgccccagcctcttctccggacgcaccctcgcttcaggccacggagcttggtcacggcacctcccgcacctccgtggagacccagattcagagcggcagtctttcctctgacaacggggcctggctgaccctccaggtaaaaaacctgggcggcacagccatcctcgtcaccctggacaaagacccggagacctgcatcaccatagagcccggtgcctccggcacccttacaacagagctgagcgcggtccccagcgaccacctgttccagctccgcgccgcccaagccggggctgaactgtatgccgcccacaccctcatccagtccacgaaaaaacccgcggaatccgttctcccggattccgcgggttttcccattcggcctcaggttccagcctgaccgccgttgttgctgtttccagcgccgccgatgaggctgctcttgtcgctcacctgctgctggctgcgggccttcttctgcttgccctggccctgttcaaactggttgcagggcttattttcctttttctggctcatcttgcatctcctttctcattaagagttccctcctaatatgccccgccatccgggacttattccttgacgaaccttcccgtccatgcaataatatttttatctcccccgccggcagccgaccggtgctctctcgggctgcggcgcgggttcttcatgatttattcaaaatgatctgatatgctatccctcgacatgatttttacggaaagcgggtgacccccatggcaagaaaggtactgatcgtggaggatgagagcaacatcgctgagctcatcaacctctacctaaaaaaagaaggctatgaaaccatggtcgccggagatggcggcaaagcactggagctctatcgcctctttcgccctgacctggtcctcctggacattatgcttcctgtgatggatggctgggcggtctgcgccaaaattcgggagaccgacaaaacccctatcatcatgctcaccgccaagggcgagaccattgacaaggtggccggcttggagatgggggccgacgactatattgtcaaaccctttgaaatgaaagaactgctggcccgggtccacgcggttctccgccgcctgggcggggacgaggccaaagcccgccgtctcacctttgatggactggtcatcaacctggattcctacgagctggaggtccggggcaagcgggtggacaccccgcccaaggagctggagctcctcttccatctggcctcctcccccaaccgggtgtttacccggaaccaactgctggacgaggtctggggatttgactactttggtgactcccgcacagtggatgtacacatcaagcggctgcgggaaaagctggagggggtcagcgaccagtggtccctgaaaacggtctggggcgtgggctataagttcgagctacacaacggctgatatgaatatgaagcggacgaaaagcatgtacctgcgccaggtcaccgtgatgctgggcctgatcatcctctgcatggtcctgttgggcgcgggctttttctccctgtcctaccggcaccagctggaggaaatccaaaccaccctggaccgaaacgccggatttatttccagctacgccaacgccgccatcaccaagggcgactctctgtccggggaggactttatcaactacatctactccgctgtgcgcctgacggataccacggttctggtctgcaacaccaagggccagattctctgtgccgccggggtcaacctgaacgaggacctgctcaactcctccaccattgcggacctcagcgtcccctcctgggcagtgaatcagctgctcaacggcaagccatacagcggggtcaccacctttggtcagctcctgtccagcaaatgctacctgaccagcgaagttctctcccccctggtgcaggaccgggtttccggggagctcatctcctccggcatccccacaggttttctcttcgtggccgcagacgccacctccgtgctggattttctggagaataccttccagctcttcttcatcaccgccgtggcggtgctgctgatctccctggtgatctgctccatcaccgtgcagcgcatggtggaccccctgaagggcatgtgcgccttcgcccacaaattcgcccacggcgaggtggacacccggatcaccgaatacaccaaccgcaaggacgagattggagagctggccatcgccttcaacgccatggccgactccctggcccaggcagagcaaaagcgcagcgagtttgtggccaacgtctcccacgagctgaaaactcccatgaccaccatcgccggctttgccgacggcattctggacggtaccatccccccggaaaaggagcgggaatccttacaggttatctcttcagagacccgccgcctgtcccggctggtccgccggatgctggagctctcccggctccagtcctccgaacgggtggccgcccaggagcagtttgacgtggcggaggtccttctccgggtgctggtgagcttagagtccaagattacggaaaaggatctggacgtgcagacccagctccccgacggccctgtgatggtttggggcgacccggacgcggtcacccaggtctgctacaacctgctggacaacgccgtgaagttctcctctccccaggggcgtctcactctccggattaccaccaaggccggcaaagcctatatcgccatcggcaaccagggcgagaccatccccccccagcagctcacccatatctttgaccggttccacaaggccgactcctcccgctccacccacaaggacggggtgggtctggggctctacattgtcaaaaccatcctcaacacctacaaagaggacatcaccgtcaccagccaggacggttttaccgaatttaccttcaccctttccgaggtgtgatccctcccccacggacccttccgtgggggactttttcggcgtgttccccgcccaaacgaaaagacgagagacctgcaaagtctctcgtctttttgattcattggttcgtctctccggcccttaccgcagcaccatgccgacctttctctcgttccaaatcttctcaaaggtctgggcattctcccaatattggtggacctgcccccggttgtaatagttataggggtcggaaatgaagtatcccttgttgggatcatagccgcacaccagcaccgcgtggttgttgctcaccagccgctgggtggtgccttcaatattgtagtaacgatagtacggcgcctcccaccagagggtcatataggccaccacacagttgcccgccagcagttcccgctgcaggtcggtgatggaggtcccccggaaatccgcgcacacagcatccccgccgcagtagctgttggaatactccgccagcttcgccggatagatggtggtccgggtccgcttggaggtatccggcacatagggggagcccacaaatcccttctccgggttggagctgtgccggggcagattgtccaggaagtatttcaccgatacctctttggcataccccttggcctgcaggcccatcagggtggccaccgcctcacagcccacccaggcatagatgttgtcaatctggctgatatagggtacgttggccatctggtaggacgcggcggtctgggtcagcgccccggcgctgttggccgtgtacgctcccaccgtctggttcacagccagcttgccgtcacggtccacgtagtacagctgaccgcccacctgatggaacccggtctgaaaggtcatctttgtcaggtccacaccgctccagctctctccgccgctgcccgctgccggggtgtgggacaccgatgcctcggccacagccacagccgcccagtgggcagcggtcatgtccgagaacagccccagggtcagcagcttgttggcctgggccgcgtctcccgtccggcccagcatccggttgaccaccgtgcaggcctcggcccgggtcaaccctttttccgggcggaaggttccatcggggtagccggcgatccacccttgggcggcggctaccccgatctgcttggctgcccagtgggtagccggcacgtcgggaaaaacagccgttccctccgcctggggtttcaggcggaccagcagatccacaaactccgcccgggtgatgaccgcctccggccggaaggtggtcccgttgtcaaacagccccagcgcgcacagcgcccgcaccggctgggcgtaccactggctgctgggcacatcggtgtaggagcagtcgcccgtcccgctctctggctgggccagcaggcgatagaccagctgggcggcctgggcccgggtcagctgtttctccggctggaaggtcccctggggaaagccctccatgtaccgcacatgatcctggcgcagcgccggtccggcaggcacctcactgggggtctccggcaccgattcctccggcggcacaggctcctccggctgttccggcgccgggtcggccggttcctctgccggcggttcctgggattccaccggcggctctcccggtgtggtcgtctcttccgtctccggcacggcgggttccgtctccaccgccgccggcatttccccatcagacactgcctccgccgccagggcgggggaggccagcaccatcagggacatgaccagggccagcgccccggacagcattcgtctttttttcatcccctcatctcctgcctttccttccacgggccttccagcgtcggcccggctctttccagatttctctcattatatcgcctctcccctccatccgtcaacccaaaggcgccatttcccggcgcgccctgtctgcacctcctaaaacaaaaatgccggacggatcatctcttccgtccggcatccatgctttcattccgccgctttcagcagctgcttggtgtagggatgcacaggatggtcaaaaatcccatccaccgtgttctcctccacaatcttccccttctgcatgacaatcacccggtcacagcactggtagattacattcaggtcatgggagataaacagatagctcaggtcatacgtccgccgcagcttcatcagcaggtccaaaatctggtcttggatggtcacatccagggccgacaccgcctcatccaggatcaccagccggggctggacaatcatcgccgccgcgatggacacccgctgccgctgaccgcctgagagctgagcgggctttcgattgtgaaattccggtcccagccccacggcctccagcatttcttccgcccgccgcttccgctcggcggcggagtacttgccatagatccgcaggggttcctccacaatccgccggatggagaaggcgggattcaaggaggaataggggtcctgaaacaccatctgcggccggcgggagtgatggacaatctccccctggtactccgtcatgcccagaatggacttggccagggtagacttgccgctccccgattcccccaccagccccaggacctctccccggccgatggtcacattgatgtcttggagcacctggacggtccgccctcgggaaaaggcactgccgccctggcggtaaaaactgttgagctggcgaatctccaaaatgggttccatggtcttacccccgtttccgtctggtgggaatggccgcgatgaggcccttggtgtagtccgcctgagggtggtaaaacacctggtccaccggcccttcctccagcagttctcccttgcacatcaccgccacccgggtacacagcttccgcaccacatggaggttgtgggagataaaaaggatgcccgtccccttctcccggttgatctttttcagcagattcaaaatgccctcctggatcgtcacgtccagggccgtggtgggctcgtcgcagatcaggagcttgggctctgaaatgatggccgccgccaccatggcccgctggagcattcccccggagagctcgtgggggtatttgcgatacagcgtccccggctccggcagttccgcatccgccatggcctgtaaggcccgggctcgacgctcctcggcgctcagcttggtgtggaccaccagggcctcctccacctggggcccgatccgcatcaccgggtccatggaggtcatgggctcttgaaagaccacagcgatctccttgccccgcagcgcccggaccgtctcccgggaggcctggagcaggtccagcccctgaaagaaaatggcgccggagagttccgtcttggcgtggctcagcagccccgccagggccatggcggtcaccgtctttccgctgccggactcgcccaccagacccagaatctccccttcatccatgtgcagggagattcccttcaccgcctcccgcccttccggcgcgttgcggaagcgaatgtggaggtcttgaatgtctaacatgcccgtccctccctctcagcttctccggcgctgctggagcccttccgtcagcaggctcagccccagaatcatcagtacaatggccaggcccacaaacagggcataccagggcgcccggcccagataggtctgggcctccgacagcattcgccccaaggaggcgtccgggggctgcacccccacccccagatagctcatgctggcctccgccagcaccgcgttgttaaagccgatggccacaatgggcagcagcacctgcaccgtgttggggaggatatgccggaagataatccgcaggtggctggcccccatgagccgggccgaggccacataattcagattccgctccttggccacctccccccgcaccacccgggcaaaggaggggatgaacagaatgcccaaaattaagatgatctgatacttgcccatcccaaacacattgatgagcaccagcgccagcagaatgctgggaaaggctgtgatggcgtcgcacacccgcatgagcaccaggtccgccgccccgccgaaatatccggtaaggcagccgatcaccgtcccgatgatcccgccaatgagcacgacacacagggcaataaggaacgtactccccgccccctccatgacccgtgagagaatatcccggccaaaattgtccgtgcccaagggatgggccagacagggggccaaaaacttgtccgcgccggacattcccgtggtgtcatagggggtccagacatagcccactaaaatgagcaccgccatgacgcccacaatcacgccgccgatgagcaaaaagaaattgggatggggctttcttccccccgccggattccgctgggctttcttcggcgcttttccgtctcttgccagaagcacattccttccctcccctctgtgtcttgtctctcttggggcaggccccgggggttattggattctgacccgtgggtccatatactggtacaggatgtccgcgataaagttgaccaccaccacccacacggccagcagtaccaccaccgcctgggccaccgggaagtcccggctgccaatggaggccaacaggagccggccaatgcccggcaccgcaaacacctgctccaccacaatgctccccgccaccagttccgccgcggtcaccgccaaaaaggcaatgacggggatcatggcgttgcgcagggcatgctttttcagggcatccacccgggtccgcccccggctgaaggcggtacggatgtaatccttgttcatctcatccaggatggaggagcgcagcattttaacggtcatcgccatccgggacagggccaccgccagggccgggaagagcatgtagaggaaaaattgccccgggctgtctgcaaaggacacaaaatttcccggtacaaacacccgcagggtgatcccgaagacaaagcacagcaggatgcccacaaacaccggcggaatggacatacagatctgattgaccaccgtgatgatccggtccagcctgctcccctcccgccgggccgtggcaatccccagggggaaggaggccgccaccgtgatggcgaaggccagcagcaccagggccgccgtggccggcagcttctccagcaccatgtccttgaccggcaggttgtagctgtaagactccccccagtctccctggacgaaatccgccacccaccggccataccgaaccagcaccgggtcgtccagtcccatctcttcctccagctgcgccaccttttccggggtggcgttggtccccagcatactggtggccggggacccgggaatcacctgaaaggccaggaaggcgagaagggaaacaatgaacaatgtaataatgagagtgaggagcttgcgcaaaatatatttcatcctctcgccctcctttctctttcaggcatggcccagggggccggattcgttaaacggactggacatagtggacggtagacaggtccatcacgtacaggggatagaactgatacccgtccaggtcagacttgatgagcacaaagtccgccaggtcctggatatagacattggccgcggtctccgtgagcagtttggccgcctgcttgtacagctcggtctgctccgcgtcgtcggtggtggtattggccttttccatgatcgcatcgtactcggggttgtcgtagttgatcatgttgttctcattgtcgctcatccagcggttgagcagagcgccggcgctgagggtagcggcgtcaaagcccaccacggtgctctcaaagtcccgtcccatgtaggtctccgagagccaggtctcccattccaccgggttgatggtggcggtgatccccacctgggccaactgctccaccagcacctctgccacattcatgtggggggtgtagttggagggcacggtgatggtcatggagaacccgtcctcgtacccggcctccttcagcagctgttttgccttctccacatcataggtgtagtaatcagacaagctctcatcgaagtacttggtaaaggccggatagatggaggaacccagcttcttgccatggccctccccggtgaggttcaggatctcctccacattcaccgcgtagcacatggcctgtcggaccttctcattgtcaaagggctccacatcattgttcaggtacagggcctggaccaggttcatggtaccctccagcgtcttgtaggcgccgccgctgaccgtgttcacctggtcaatggtcaggtggaaggccatgtccaccgactccgcgctcagggcggacataagggcgttggcgtcctcatagatcttgaaggtcacctggtccaggtaggccttctcgccccagtagtcgccgaacttctccagaaccaggttctcctgcacagagcgggagacaaactggaaggggcccgtccccaccggcgcggtatcctgctggtcatacgccgccgggacaatgtacaccatgcccacatagctcaggaagtccgggttggcttccgacagggtgatggtgacggtgctcccctcggcggagatgtcctccacagaagaaagcgccgcggccagggcggtgtccaccgtggtctcggcgcaggtttcaaaggaatagatcacgtcctcggcggtcacagcttccccattgtggaaaagcaccccttcccgcagggggaaggtataggtcaggccatcctccgacacagtactgtcggatgccaccgccggcacatactcgccgctgacattgggcttgaccaggccctcgtagacgttgaataagacctctctggttcctgctgccgtcatctgatacgggtcaagactgtctcccaggtcttgagaaattccgaccaccagctcaccgccggtgaccggctctccggaagagctcgttccattgctgccgatcccgcctgcttcctcagacttctcgtctccgcaggcgcagagtacagtggtcagaagcagggccgacaggaaaagtgcgaaaatacgttttttcatgaacttctccttccgccgcgttttccccgcggcgttacaacaaaaatagcatctcccattattaaattgtcggttgcagtgtaccaccctttgccccaaattacaagaaaaacttttttccgcgggccatttttttgcggctctccctgctcagaccctatttttgtcttgcggacgccggcatcgtgcaaaagctgcgcacccggaagcttgaaactctattgtttctaatctcatcattccatcgacacatcgttttctccctcaaatctaattcccctactttcttaatctatcgcacagcggcagcaattcttcgattttggcaacgatgcgatactgctcctcaagaggaggaattgctataattacatttcggatagcatcaatcgatatgctttcctgggcagttgctttcttgtgttttgtcaattcggcatatccgtatgtgctctttaagtaccacaaaacatattcttccagcacaaaagtttgtatgtcagaattaagcagttctattttaccaacattagagccaagatgcgctttgaatgatccatcaaatattgcaatatttccgattgtaccgacataaggcgtcagcagacacttctttgctatttggctgcgaggcagttcatccgaaatgcttttggggatatagctctcaaaagaaagaactaattttccgttttgaacatttttccccttaaataatggaattccatctgcgacgaggttatcagcaatatatttcgtatattcaaatccagccaactttgtaacaaacgcaatatcatcaatatagcagaccttccaaggctgcggaaaatcaaacggaatagctgcctcagaaataggctctaaagctcttgttttcttcagcctaccatccttgattaggttcttcttgtacacttggatctgctggtacagttcctcgccggtgccttcttcggttcgctgctccaccagcttaccctgaatggcatattgcaagatggacttcttcatgtcctccgggaacttggcgttaaactgctccagcttttcataggcaacagcatagcggtcaaccagaaggaggagttcctcaatcttcgctacaatgcgtttttgctcggcaagaggagggagtggtacaacttggtttttaacagtatctcctgtaatagcaacaaaagttgttcctgttgctttttttataaaagcattcttgaagcacctgagccaattgagtgtaaatttttcattcattccacccagtggtacaacatcacacagtcctctaccaatgcaaagttttctattagttatatttacaataccgacaggtgctctcacacatagtaaaaccgaattaggctcagcaattttttggggagcatttgtagtttgcggtgatttacctatatagtcctctccgaaataaactttcccttgatgaaattccataccatcaggactttcagaaacacttttcccatctggtgattgtcccatgatcaagttgaaaatatttcccaatcgtgtccacttccagctctccggaatatcaaaaggaatttcatcttcggaaatctccgccaatggttttccctttttgattttcttttcctgtatcagccgttgcctctctgcctgaatctgctgatacagttcctcgccagtgccttcttctggtctctgctccaccagcttgccttgtatggcatactgcaaaatgctcgctttcaactgttccggtgtcattcaattacacctcccggcagcagggcttccagttccgccagcaccttgtcgatttccgcattgagggtggttcttctctcctgatactctcggatggtatccagcggatcaaggatttcttcttcctcatggggataaccgcacagatcgatgttacagccctgttcgttcagcagatactctgcggtaaacttctgcgccttgaagttttcgccatctggaatttcctttcggtcattccaccaggcaatgcaatcatcaaaatgtttcagctccatgggcttcgtcttggagaagtgctttctgtcggacggaatatccacccgataaaaccatgtctctgtggtcggcttggtgttgtcaaaaaacagcagattggtggtgattgaggtgtaagggctgaacacagagccgggcagccggacaaccgtgtgcagattgaactgggaaatgagcttcttcttgatgttcaccttggcgttgtccagaccgaacaggaaaccgtccggcacgacaacagcagccctgcccttcttcttcaagcggtacatgatgactgacataaaaaggtctgcggtctcggcgcttgccaaatcgtcagggaagaagccctgaatggacttgtcctcatgcccgccgtagggcgggttcatcaggatcacatcaaacttgtcctcgtccgtgtagtccagcagattgtgtttcagcgagttcatgtggtagatattcggaacctcaatgtcatgcagcagcatattggtcacgcacagcagatagggaaagggcttcttctcaacgccataaatgctgtcatcaagctgcttctgcgcggtggtgtccgttacctgccccgagagctgccccagccacgaagtgataaatccaccggtgccgcaggcgaagtctgccatcttttcgcccagctgcggctttatcatcaatgccataaactcggtgactgctctcggcgtgtaaaactcaccggaagaaccggcagattgcagctcccgcaaaatctcctcatagacaaagccaaaagcgtggctttccttcacatcgtcaaatgcaatctcgtcaatgacatcaatgacctgacgaagataaacgccgtccttcatatagttgttggcgtcctcaaaggcggatttgacaatggctttcttaattggcgtatcgggtgtcaccttgatcccctcatagagaaccgcatccccgtccttcacatcattgcctttcagcaccgggaacagaatgttgttgacgaagttcagcagcttgtcccccgtcatggcgtgaccgttgctgtcggcttttgcccaatttctccatcgcaatgcttcgggaatgatggattcgtagtcgtcctcgttcagctcccaatcatcttcctttgcgtcatagactttcagaaagagcatccacaccatctgctcaattctctgggcgtcaccattgatccctgcgtccatacgcataatatctctgatgcgttttataaatcctgactgcatcgccatattaaactacctcaaattcatagatactttcttccagctccctgatggctgcttcgtactgcgccttgccgccaaacagcttgacgatctttgcgggcttcccaaagttcgcaaaatcggcaagggacagaaccttaatatcctcaacctcggtaatgccctgattcatgtacttatccaaaaggatacccagaaccgcctgcgcttcggcagaatacttgctgaagaagtcttttttcttcaccttgctggcccgttcttcgcgggtcagcggctttttgccgtatgccacatagcagatgaaatcgaaatcgtccacatcttccatcccttggtctgccttcaacgctttgaggtcaatgcccatcgccgtgaaagattcctcaatggttttcttcttgtccgacgctttccacttgcggataaaatcggacagggaagcgtattcacccttgatattggttctggtgtagtcgataatatcctcctgcttaagcagcttgccattcgcatcatagacagaaacggtcttattgataatctttaccttgcagccgtccctgtccacgatgggcgtttccacaggatcatcgggaggattcttcccaccaccgccgtggccgccgccctttggcttggcgccgccatgctcaaaaccctcgtgctgctcaaccggaccgtcccactcagggtcggtgaacagccttgtcacattccgaaagtccatcacgacaaagtgtgtcttgccctccttttctcggatacgggttcctcgtccgatcatctgtttgaacgtggtcatgctctccacagtcttatcaagaacaatgagcttggtcatcttgcagtctgcgccggtggaaagcagttccgatgtggttgcaatcacgggatatggttcggatacagagatgaaatagtcaagtttggacttgccgtacacatctgagccggtaattctcacgcaatagtccggattctccttcaccatatcctgattgtcgttgacaagggcaattttcatgcgctctgcatggtcttcggaagcgcagaacacgatggttttctgcattctgtcggtgcttttcagatattccgtgatctctctggcgacctcatcaatacggtcttggagaatgatggtgtaatcataatcccggttgttgtaaattcggtcttcaatgacattgccaaaaatatcggtctgtccctggtatggtctccagccgtctccgatgttggttgtaatattgatgaccttaaacggggcaaggaagccgtcctcaatcccctgttttaagctgtaaatataaaccggctctccaaagtagtcgatattggataccttttcactctccttcggggtggcggtcattccgatctgcgttgccgaagtaaaatactccaaaaccctacgccagttgctgtcctccttggcactgccgcggtgacactcgtctacaataataaggttgaaatattctgccggtatctgcctgaaatgttcttcgtcattctgccctaccatctgatggtagagggcaaaattcacttcatgggaagcaatcttgctcaggcattccttatcggagaagtccaccttgtagatggtcttttcaaggggggcgaagtcctgcaaaatgctttggtcaaccagaatgttccggtctgccagatataaaaccctcttttttaggtcagaacggagcagccgatagacaatctgaaacgctgtataggtcttgccggttccggtagccataacaagcagcaatctctgctgtcctcttgcgattgcttccaccgttctgttcacagcgtttcgctgataatatcttggcggatacgtgctttgagatgaataatacggctgggtaacaattttcttttccaaggcagaaatgcccttgccgccattcaactccgcatagtagcgtgcaatcagctcgtcctgtgtcggaaatttttccaatgcaatctgctgttcctgcccggtcaggaaatcatgctcatagaacgcgtcgccgtttgacgaatatgcaaacggcaagtccatcatctgagcgtatgtcatcgcttgctgcaatccatgagatacagagtggttgttgtcctttgcttccacaacggcaatcggcttgccatcgtttaagtacagcaaataatcggcaaacttgaatttatataattattcctctaactttccccattttataggctttcccgcctgtccattagtgaaatgatatgtagtttcccttatttttgcccttatgagataatcacaagggaaataagggaaattttttagtcattgcccaccactttatcaagaagccgaactgattttcgtttcgcatctcttgtggagtgagcatagacgttcattgtggtactgacatctgagtgtcccaacaattcctgcacatcttttggggcagctccatttgctaaaaggttgcttgtataggtgtgacgtaactggtggaaatgaaagccttcaaatccctctaatgtttttgccacctttctgcaaacagtccccaaagtagttggaagttccaaacaaccatccggtcttaaacagacgaaagaaatttctttataatctgtcgggacttcctctgttctgtctaaacaataatattcgtagtacactctgtttttctctttgacctctttgtagtagttcgtgtgataaagttctccgtactgcattcgattttttaactgctctttccgggcattacggaaaatctctaccagtgtatctccaaaatcaacaacccttacttttttccgcttggttggtccgatgatatatttgcgctttgagccatcatatcggatgctgcgtcttatggtaaggcattgttcttccagatttacgtcctgccatgccaaaccgcaggcttctccaatacgaagcccggcataataggctatctggattggaagtattgcggctgggttctttttttgcagataagcaagcaatctttcataatcttctcgtgaaattggttggacatttccgtccatatcctcatcggaaaacaaatccacttcatccgtctgataccgcagtttaatatactgcatgggattgaacgtaatatactgctttggaaatactgcaaaacggaaggactgctgcatgactgcggaaaaagaatggatataatctttgctgtaaccctttctctcttttccgtcgggatgaactcccccgaaggaaagcaaatcgaagaaggattgcaaatgttcagaggttacatttttcagtttccgttctgccaatgggtgtttcttgatatttcggattgttccgaggtaattctccaccgtaccattgctgagcgtacctgtttttaattcctcctctgcccacacatccaaaagctgtccgactgtgagattttccgctttggcaacaaatttctttttctcataatcatccattgcctgacggagcagcttttcagtttcacttttgctttctgttccaacgcattctttctgaacaagattgccgcttgcgtcctctacatagaagcggtagtaccatttctttcctttttttcttacagatccttttgccataatcgtatgtctcctttcgatattagacaatcggaactgatgaaatgcttcgtgcgtgtaagtatatcataactccggttgtcttactataccgattcggaatcttcgtataagacttctgataaaagatttgcaagcctttgttctgctgtttttggtttcttggaatagagccttacaacgtctgccatctcattaaaagcattgatggtgtgagtgatttcccttaagaacataatctcattatattcatcattcgattcaaaccctattgttttggcaatatccgtctgaccagcattccccttgaagtttttgcaggcgaactggaaggaatccaaaaacagaccatattgttttaacatcagcagtaataaatcttttgaaaaagcatcttcttctttggtaagggcaagcggtaactgttccagaatatctcccatcgcatcacgaatctgtaactctctcttatccgtaatgtcggtttcatattcatctgtttcccctttgagccattccacagatacatggagtgcttccgaaagaccttccagcaccatttttttcgtattgtcaatcgaaccattctcataacgcaggattgtagaagcggtaacacccatcttttctgcgacataaggctgtgtcagattcaattccagacggcgctgttttactctgctgcctatcagcttgcgtagttctttatctttcatgctgactgcctcctttttcggtatgtatgaattatagcattgtttttctgtaattgcaatatgcaacttaaaaattatttttaatatttcgtaacgcttgacaaaaagatatgaaaaggatatacttacatcacaagaattgcataatgcaatttataaggaggtgattatatgacgcaaagaaaaattgcattatccatcgaagaagctgctgactatacgggaatcggcagaaacaccttaagacagcttgtagaatggaagaaacttccagtattaaaggttggtcgcaaagtcctgattaaaaccgatattctggaaatgtttatggaagcgaatgaaggtcgtgatttgagggatagaggaaatgtaaaagccgtaacaagaactgcggcaaattaaaaaggcggcttccaaagaaaccgccaaaggttctatcagaccgaagccatgatatacctacacgcaagaagattataccatgtgcttcttctgatacgcaaccgagaacttatgtttgtaaaagaaaggggaatgtaatcatggcaaaatcaacaaaaagttatgaagaacgaatgcttgaaatggaaaagaaggaacaggaaagccttgaaaaagcaaaacgatatgcagcacagaagaaagaacttctgaaacgaaagaaagccgaagaaagtaaaaaacgaacccataggctctgtcaggttggcggtgcggtggaatccgttctcggtgcgcctatcgaggaagaggacatcccaaagctgattggttttctgaaaaagcaggaagccaatgggaaatttttttcaaaggcaatgcagaaagaaacacataccgatatggaggaagtgtaatggcgggggggggatgagtttttcattcccttcattgctttttcatgaagggcgcacttatggacaaccagaggtcgtcccaataagtttgccacaagtggcaaccggtcttcgctcacgcttgccgggctcgttccgtcggcggggctttcagccagacctgctcatgccgcaggaggcactcttcgccagaggggcgcattccatgcaggctgctatgcgcagggcactcttacgcagagggcgttccggcaatactgctttttctaaaactgaaagcaatgttgccggaaatctatgccggatgtgcagaaagggggaatccagacatggcgatttttcattacacaatcaaaatagtcggacgaagtaaagggaaatctgttatctccgcttccgcatatctcaatggggatgtgatgaaaaacgaggaaaccgggcgaatcagttattacacttctaaaaaagaagtggtctacaccagtctgatgatgtgcgaaaacgcacctcctgaatggcagatagtaccagaagaaaatataaaacgctttcaaaaatctgtccgatacaaaaggtcagaagataaagaagctgctttagaaaaatttaaaatcacatttcagaaacaacggttatggaatgaggtattgaagattgaaaaaagtgcagatgcccaacttggcaggtcatttgaatttgccctccccaaagaatggagcagacaggaacagattcaatatacagccgactatatcaaaaaaacatttgtggataagggaatgtgtgctgattggagtatccacgacaaaggggatggcaatcctcatgtccatctgcttctgacaatgcgcccttttaacccggatcattcttgggggaagaaagaagtcaaagattgggattttgtcagagataaaagcggaaatatcgtgattgatgaatcccatccgaactggtggcaggataagaaaaaccctgaccgtcatggaatccgtatccctgtattagatgaaaacggaatccagaagattggtgcaagaaaccgcctgcaatggaaacgggtactgaccgatgctacgggatggaacaatccaaaaaactgtgaactgtggcggagcgagtgggcaaaggtgtgtaatgaacatctgcctttgcataatcaggtcgatcaccgttcttacgaaaagcagggaaaactccagattcctaccatccatgaaggtgctgacgcaagaaagattgaacaaaagtttcttgccgggcaggaaataaaaggttcgtggaaagtagcggaaaatcaaatcataaaacaacaaaacacgttattgcaaaagatactggacacctttgggaaagtatcaggtgcattatcattatggaaggagcgattaaatgacattagaagaaagccgggaaattatacccttaatggagtccatgattgggcaaatcgaagaacagcagaccttaatggcagaaatgcttctggaaatgcagaaccgggacacccaactctctcttatgcaggaacagaatcagaaattgcaaaaattaaacagcgagttatccgagctgctcaacattttgccaaataccgaggaactactttccaagatggaagaacagaaaacgaagatagaacttttggaaaacgaaaatcagcaatggcagatattggcacagaagctgaacagcgaaaacagtttattactgaaacagaacaccgaattgctgaactggaacagcaggtagagaaaggacgtgatatagatgaacgaatccagagaattaaagaacgccgaacagttggaagaacttctgctcttgaccgaggagatacaagaagagttggaacagaaagaccagcttatcgtggaactgaagacgcagctcaacgaatctctgaccttgaacgagaaattaaacaaagagaacagagccgggaatattcaagcattaaagaacgacttgaagctggcagacagagcattgcggagcgagaaagagaagctgcgaagcgcaaacgtcacgatagaggaatgtcaagataaaatacgatgcttaacacaacaacgggattatgcccggacacatcagaaaatcgtagagataccggtagaaaagccggtactctataaaaaatgcgaagcctgtgaccggacagcctatcagaatgcaaaagcaagatacgaaacacaaaaagagcaacttgcaggacaatataaagcaaaaacggtaatgttccaaacaaccttgttccttcttgcatggtattcgctgacaaccactctttttcaggcagtacagtcagatgtgttcctttccgattgcaaatcattcttccatgatgcagcatcattcatacaaacttttatcggttggacgattgatgccgggcaatctgtggcacaaatcagcacaaaaattccaaatgagattatagccggaatcatatattggttattgatgatattggttgttggaatatgtgtggcagggacagggatactggcaatactgatagaaataaaggttatagaattatataagaaaaactgttgggatgttattaccctactgatgatactgacaagtgcggctgtcatcatttattttggagaagtaattaaaaaagcattatcaataaatctgttgttcttttggttaattttacaaggaatatatcttacaattcgacgctatataagtcaagatactgattgactagatactaaatatttgataaaatataaatagaaatacagcagatcaaaggaggtaaaacttatgagagcaaagaaagtgattgtaggggtagctattagtgcaatgttaatttcttcatcaattccagtaatggcattttctgttacaaacgggaataagacatttgataaaaagtgggaattgagcactacatctgatggcggaaaaggtgttttgacttatggttataatactcttgctattaatgaagattatgcacacgcatatcattcaactaaagatcattacgcatatgtcaagaatggaaatggttctttttcgggttcaaatgttggtaaaggtaattggtctaaaattgaggttgctcataaaggaaatagtattacctacggtaatagctactaaacaaaggttcgggataatggctgagtggttggaattccaaccactcttttttgtggagtgtatataaatgaagaaaaaaataaaatatataggaattgttttggttattttgttctgttgctataatttattttggtacttcgggagttataaaccatataacgaatttcagaaagacttccctgaaatagaagaatctggagtaaaaatttacacagataaagatggattccagtatagtgtgtctgtccctgattatttgctttggaatggaaatcttgcgatagctgagtcagatgttcgatatgcactaattatttggataaaaccatttcaccaaggaataagtcaaggcgtgctatttaatgactataaggatttgaatactcaaattatgttgtcaagtagcaaaaaagctgaagatcaagaagatcaatggattgttgatgaaaatagcacaatattgactacgatatttgaaaaagcaaataaagtatggaatctggggttgaaataaatgaaagcaattaaaaacttatgtttgttttgtttcctgatttttggaatacttatgcaatctgaaatatttcaagatcagctttggaacttttctacagcatattttacgtcatcacgctatgaagttgctagtgaagatatgtcgcagtttctgaaagatgtatcagaaactgcaacggagaatgatgtacatattttttctcagtacaatgaaatcaataataaatacctttcaacacttcatatttatggcgatgataaagtaatcagacaaacattaaaaaatactgcaaacatagaagaatcagaatataccgctttagtttccggaattacgaaagtaaaatttcataatctctcagaattgcaaagtacctctgtgggttatgaaaactttatctcatacataggaaatgaggacaatattatctctgcatatcagaaattatcagaaaaatatagcttaacttatccagaatattggaattctacggaaaaggacatgatttttattatatggggtatgattattgcattgatgattgttctaaatgtaattgaagtggttaggcgaaaaaaagaggttgttgtacgagtttccttaggagaaagtgctggtttcatagcatttaaggctgctttattcgatgtaacttttgacattgcattatttattgttgcaaaaatattgctgtcaaattatatatcgggagcatatgagaatagactcgtcacaattttatattccattggaattattctttccactattccatattgttctttttgcttttttgatattagaaaggcattcgcaaatgcaacacacaaaagaggagtggattttttaatttattcgttaaaatttatagcaggggtagccgctgtttttacaattaccactaatattagtagtattcataataacctatttacaaatgaacatttgttagaagaatattatgatgcaaattattttaccgtaaagactactgattttaatgctgaaaaagaagaagctttttggaataaactatacaagaatgaatataacacattaaagcctgtaatatgcttgaatattttaaatgataaaaatgatgtgatatatgtaaataatcatgcaaaagatatgttacaaggttttacgaagcagataaatgcagtagagaatgaatcttctgatttgattattttcattccaaagaatagatattttgctaaaaacaagcaattagcctatgactccttgagccatgttttaaatcatgataatttacaacaattaaatattcagtacatagagtatagcgaaacagaatacttttcctatttagatacaagtagaataaatggtatcgaaaaaagcaaaaatccgataattatttatcaggcaaacaaagatttagcagtcaatggtgggtatcttgaaagctataaagcaggagcagttttatttcaatgtgatgaaaaacagctaagaaatatcagcaaaaagtatgaagatatgcttggaaattatcagctagtaattacaaacgtacatgaacagtatttatataatcacacatttttaataaaactcgtgggatttttaagttctctttgtacgattgtattgcttttaaatattatgattattgttacagtaagtagactagagttccgagaaaatgcaatgaaaatttccttgatgaaaatctttggatatagtttatttgaacggcacaaaacacttcttaaaatgattgtagtggaaaattttgtgatattagtaggtatgcttatctattctttattatcggtacagactgaagtaggaattagcattcttgttagttcatttatggcactaatagaatttacaattattttctttaatatcacaattgttgaaaaaacaaacataccgaaatcattaaaaggaggttgcttatgataacaattgaaaatctatgcaaagcatataatgataaaattttgttcaaaaattttcatttggaaattccagatagccgttttttggtaattagtggcgaaagtggatgcggaaaaagtactttacttaatatgattggaggtattgaaactcctgacaaaggttctattattgtgaatggttttgatgtggcaaaaaaaggaaaaaagcagaaatatttcaaagaagttgttggatttttatttcaaaattttgcccttttggaaaacaaaacagtaaaagaaaatctagaaataataaaaaaatcaggtagaacggatatttcaataaatgaagctcttgaaaaagttggtttacagaaagtaattaacaaaaaagtctatcaattatctggtggcgaacagcagagagttgcgttagctcgtttaatgctaaagaaatgttcgattgtattagcagacgaaccaactggttccttagacaaaaaaaatagtgagattgttatgaatatattgcatgagttaagtgaacagggaaaaacagttattgttgtaactcatagtgaagaaattgtagcacaagaaaagcatgttctatatttataattacccataatagaagaatatgttctttcgggagacacctcctctaagaacatattcttttggttaaaattgattataaagatacttttatttcagtatattcgctatattgatgggatatatatttgcatattatttatatggataaggattataactctagtgagtcttctgcatctacccacatctgtaaattaccctcaagatataatcttgcatattccaaaggctcatccacagccaatgaagtaagcgcacattctgatccgtatgtggtttttagatttttttcagctttccagcaatcaatgcgaagcatatatccggcacttgtgtaaacatcaatactatcgtgatttatgttgtattctgcataaattgttctcatcgtatcttatctccattttcttttaataatcagttatagagttaaatatcgaaaacatttcaatcagttcaccatgtcgttattgttatactgtgttatgaaattttctttcccttattttttcccatattaaggttcatgaaaaccaatgtgagaatataacacaagggaaagagtaagggaaagctcacttgctacaaacttagtattttcaagggtttgcgaagaatttgataattaaatataacagttattaaatttcctaaaatatgtgaaatatcaacttgggtttgctgcgaaccacgatattgcccctgatgttgatgcggccatctgtgattctggtctccatcgtgatatgacctttccaacctctctgaatggccggagttatgaagtttaacttgatgtcttcttcggacatctgttttttgcccaatatcgtcatagcaaaacctcccaattcattcttcgtgctggctattctccggtcgtttcgagaatattttctatatggcagtccattacctcccagatacgaagcagaacatctgtggtaatgttgtcccctttgccgagctttgcaagggaagcagagcgaatgccggcttttttctctcttgatctataagcctcttccagagcttattgcaactgatacgcgccatcggaagcttcccaaccaattccgttaatatttcttatattataccaaaaatccacaaattcctccactggtttcgcaaattaaatattttgtgatagagacaataaaaatcgtattctgttttcctgatcgcaaaagaagcggccaccgactattgaacactcggtggtcgcttctacggactccgttcatcgtttcgccaatactccagaattcctcagagcacgccaaaatgcctcagtgcatccataatggccgcttccttttccggcgggcactgcggcgctttggcatcttccttcttcgacagatgatagtcttggccagcctccaacccgcacttccgcttgacctgggagatatgcagggacgataccttcaagccagtatgctccagtacatacgctttgatctcgtcatagatgactttgctctccgccgcagtcaaatccagctcatctcaattcaactccacctcgatatgctacttagtatttgagtttggacaacaggcacaccgtctctacatgcgccgtccgcggaaacaaatccaccgcctccgccctctgcagcacatacccctgctcctccatgcgcttgacgtcccgggccagtgtcgccgggtcgcaggagacatagaccagacgctgcggggccatctgaacgatggcgtcgatcaccgccggggccagtccctttcgcggcgggtccacgcagatcacatcggggcgcaggccgcggtcggccagggtctgggcggcctgcgccgcgtcggcgcagagaaactccgcgttggtcaccccgttgcgggccgcgttggccttggcgtcctccaccgcggcggggatcacctccgccccaatggcccgccccgcctgccgggccatgaccagggtaatggttccaatgccgcagtagaggtccaacaccgtctcccgccctgtcagccccgcaaaggccagcgcccggccatacaaaacctccgcctgctcccggttcacctggtaaaaggagggcacggagagccggaaggtcaggccgcatagggtatcctccaggtagtcccgcccccagaggcaccggtgggtctttcccaaaataacattggtcttctcctggttgaccgacagcaccacccccgccaaatcaggctctgcccggcgcagcgcctgcaccaattcctcctgatggggcaggtccgtcccattggcgatcaccgcgcacagggactgtccccgctggttgacccgcacatagaaatgccggatcagccccccgtggaccctttcatcgtaggcgggaacctgataccgttccatccacagtttgaacgcctcccgcagccgggtggcggccagcggctgcaagagacagtcctccgcgtcaatcacttcatggctccgggcccggaaaaagcccacccgagggccgtcggccacgggaaactggattttgttccgataccggtccggcgcttccgccccgtggatcttctccacccgcccggtccatccgccgatccgctgcaaggcgtcctggaccttctgccgcttaaagcgcagttcctcggcataggtcatgtgccgcagctgacatcctccacaccggggataccgggggcagtcggggctctggcggcctggaaccggcgtcagcacctgggtcacccggccccaggcggcggacttgcccaccttcaacagctgaacctggcagatctctcccgccaaggcccccttgacaaagaccgcctgtccctccagccgggccaccccctctcccgcgctgccgtatccttcgatccgaagagggtgctgttcgttctttttcgccgccatggccatgtctcctttttggtgtcaatgtcttttggcaacagtataccacagggaatcttcctcgaacaaccttgatttttccccggattttctaccacttgttcacagtttcctcttttttctcccgggggaatgtgttataatgctatgaccatgggggtttatgcccattatttttacaaaacacagcggtttccgcttttggaaaggatctatccactatgggttttttgaccaaactgttcggcaccaacatggcaaaggagatcaagcgcattgatcccattgtccgcaaaatcgaggccttggaagaggagtacaaggggctcaccgacgcccagctccaggccaagaccgcagaattcaaggagcggtatcagaagggggagaccctggacgatcttctccccgaggcctttgccacctgccgggaggccgcggaccgggttctggggcttcgcccctaccgggtgcagctcatcggcggcgtcattctccaccagggccgcatcgccgagatgaagaccggcgagggcaagaccctggtggccaccctccccgcctacctcaacgccctgtccggggaaggggtccacatcgtcaccgtcaacgactacctggccaagcgcgacagcgactggatgggaaaagtttaccgctttttgggcctcaccgtgggcctggtgatccacggcgtggacccggtgggcaagaaagccgcctacaacgcggacatcacctacggcaccaacaacgagtttggtttcgattacctgcgggacaacatggccatctacaaggctgagctcatgcagcggggccacgctttcgccattgtggacgaggtggactccatcctcatcgacgaggcccgtacccccctgatcatctccggtatgggggaacagtccacccagctgtacaccctggcggacaattttgccgccagtctgaagggcctggtgaaggccaccgtggacgacaaggaagaggaggccgacgacatcgacgccgactacgtggtcaatgaaaaggcccgggccgtcaccctcaccgcccggggcattgccaaggcggagaaggccttcaacgtggaaaacctctccgacccggagaacaccaccctctcccaccacatcaaccaggccatccgggcccggggcctcatgaagcgggacatcgactacgtggtgaaggacggcgaggtcatcatcgtggatgaattcaccggccgtctcatgtatggccggcggtataacgacggcctgcaccaggccattgaggccaaggaaaaggtcaccgtggcccgggagtccaagaccctggccaccatcaccttccagaactacttccgtctgtaccggaagctctccggtatgaccggcaccgccctgaccgaagaggaggagttcaacgccacctaccagctggacatcgtggaggtgcccaccaacaagcccctgatccgggtggaccaccccgacgaggtgtacaaaaacaccaccggcaaataccacgccatcgtccggcagatcgccgcctgccatgaaaagggacagcccgtcctggccggcaccacctccattgaaaagtcggaggtcctctcgaagctgctgaccaagcagggcatcaagcacaacgtcctcaacgccaaaaaccatgagaaggaggccgagattgtcgcccaggccggcaagttcggggcggtcaccgtggccaccaacatggccggccgtggtaccgacatcatgctggggggcaacgcggagtttttggccaagaacgacctgcgcaaggcgggcctgtccgacgagatgatcgccgaggccaccggctttgccgagaccgacaacgaggagattctccaggcccggaagatgttctcccaggccgaggccaagcataaagaagaactggcccccgaggcagaaaaagtgcgggaggccggcggcctgttcattctgggcaccgaacgccatgagtcccgccgcatcgacaaccagctccggggccgttccggccggcagggagatcccggtgagagccgcttctacctgtccatggaggacgacatcatgcgtctgttcggcaccgagcggatgcaaaacatgatggagaccctgaagattgacgacgacacccccattgacgccaagattctctccggcgccattgagaacgcccagaaaaaggtggagtccaagaacttccaggcccgaaagaacaccctggaatacgacgacgtgatgaacgtccagcgtgaagtcatctataagcagcgccgccaggtgctggacggagagaacatggggcagttcatccgcaacatgatccaccgctggattgacacctccatccacggccacctgggggagaacaagcacctctccgccgagtcctatcagctggccaccgagcccttccgcggtctcttcttccccccggaccagttccaatacaccgacgaagacctggccaagcagagccccgatgctctggtggaggaactggaccaggccgccctggctgtctatgacgccaaggaggccgccctgggcgacgagctcatgcgggagctggagcgggttatgatgctccgggtggtggacgaatactggatggaccacatcgacgccatggaagagctgaaaaaggggatccagctccgggcctatgcccagaccaaccccgtggacgcctataagaaggaaggcttcgagatgttcgaggccatgatccaggccatccaggaggagaccatccgccggatcattctggcccgggtccagaccaacgaggtccgccgggagcgggtggccaaggtcaccggcgaatccggcggcagtgaggagccccagaaaaaggcgccggtccgcaaatccatcaagatcggccccaacgatccctgcccctgcggcagcggcaagaagtataagaagtgctgctacctgaaggataaggccgcacagtaagcacccgcggccccggttagaaaggctcgtctatgtcatttacccaacaaacccgaaacggcgtcgtcttccacacggcggacgcctttaccgccgccggcggggtggcccacggcttcgccacccggctgggcggcgtcagcaccggtccctatgctcagctgaacctgggcatcacccgccccgacgaacgggcggcagtccgggagaactatcaccggttctgcgccgccatcggcgccgatgtcaccagcctggttatgacccaccaggtccacgaggataccatccgccaggccacccgggccgatgtgctggatgatctgctggaccccctggactaccaggcggacggcctgctcaccaaccagcccggcctctgcctgaccatctactacgccgactgtattcccgtgctcctgtacgaccctgtgcacagggccattgccgcggtgcactccggctggcggggaacctctctgggcattgccccccaggcggtggccaagatgaccgccctttacggcagtgaccccggggacatcctggccgccatcggtcccgggatcggtccctgctgctttgagacccacgatgatgtcccctccgccatggtccagcgactgggggaggacattctctcccactgtgtccccctggcccacggcaagttctctgtggacctgaaggggatcatccattggcagctgacccaggcgggtctggcggacggccatgtggacaccctgtccctgtgcaccgcctgccacccggagctctactggtcccaccggaagatgggcgaccagcggggcaaccacgccgccatgctccagctccttccctgaccccaccgtcctcttggggccgttatccccacagcaaaggagtcgattcccatgcaccaatcttccaaccactccaaatttcagcggatgcgccgcaggctggacctgtttcggcagaaaaaagaggaacaaagcgtgtcccaccccctgcgcgcctgcctgccctttctctgcgccacaggggtactgatgaccaccgtggtcactgccgcctcctgcaccctgtgctatcgggtggacgcccaggggcagtccttggcgtttttccacgacgtggcaacctatgacgccgccgtgtcccaggcggaaacccgggcctctaaaattttggagacccagtattccctgaaccaggacctctccgtccgggccacactggcccccaaggaccagattgaatccctgtccggggtcaccggctccctcatggagagcatcccggagctggaacacgtctacaccctctctgtggacggcaccatggtgggcgccgcgcaggacccttcggtcatcacccaggctctgaacctggtgaaggaacgctacaccaccccggaaacccgctccctccacatcgacagtcaggtagatatccgctaccagtatcttcccgccgacacgggagaatccactgcggaggaaatggccgccgcgctgctggcccagtccccccgcaccttctcctacaccacccagccgggggataccatggagtccgtcacagccctcttttccatgacagaggagcggttccgggaactcaaccccgacctcaccctggagccggcggcccccacggcctccagtcccttggatgagctgccggacaacgaggccgccgatgcccaggtctcggccgcagaggagccatccccggacagcgcagaagcggactcccaggccgacgagaacgtcattgacctggaggcactcctgggcgaccagctgcaaaccccgctggaagcggggctcaccatcaccattgagcagtcctgccccctgctggtggtctccaccgtggaggagatgaacctcacccgggagattctccccgacttagagacccaagaggacgacaccatgttccagggccagcagcggatcatccaggagggagaggccggccaatccagcgtcctgtcccgggtggtgaagcgctgcggcgtccctgtggccagcaatgacctcagcgccgtcacgctgtcggaagccacccccctcattgtgggcaccggcaccaaggccatgccggagctccccgacgggtgcctcttcctctggcccgtccagggtcccatcacctctgagttcggctatcgcttcatcttcggagaaaacaacttccaccgggggctggacatcgccgccgccgccggcaccgccatcaacgccgccgcggacggcacggtgatcttctccggggagaagggaacctacggcaatctggtcatcctctcccacgggaacggatttttgacctactacgcccactgctccaagctcctggtccaagtgggggattccgtcacccagggtcagcccatcgctgcggtgggctctaccgggcggtccactgggccccactgccactttgaggtgcggtaccagaacaatcccatcgaccccctgttctacctccccggcgagaacaacgcccccgtccgcacagagcctccggaggaggaggttccccctgcggaagagccccccgtttccccggagaccccggaacagcccacggaaccggtggaacccaatgtcccagcggagccctcccaaccggaagaccccgacagctccaccgaggaccccgccgccccgccggaagagctggaagccggcggcggtgccgccggccaggcttccccttccccatccccataatctgagacagggccgaaccaaactggttcggccctgtctcctgtttcccatctgtaaaaaggagacggcttcccacccggaggccgtttcctgtgtctattgcgccacccgctccagcaggaccttcgccgccgaccgggcaaacagccgggccccggccagcgcctcctccagggagttgccatgccctcccacctccaccagcagggagcccttggtgagctgctggttgaaccgggcggtccgcagggtgatgggccgggccaggccgggccaaagggagttcatctgctgctggatctgcatggccagggccaaatgctccccccagtccgggaaggaggcccccgcgtcatcggtgcccaccagcagcatcacctgggcggttttgacgccgtcgatctgaagcaccggcttatacaccgtgccgtcggtgcccaccagggcgtcccggtggacgtccagcaccatctgaatggtgggatactgggccaaatgggcctcgatccccgcccgggccttgtcataggcgtcgttataggaggggtaatcgtacagttcccggtcgtgaatgacgtttaatcccatctcctcgaaaattcgtgctatctcatcccccactcttatgatattataggaggtgtccgtggtccgggccacccctgtctcggtgtagggctcggtgccgtcccgggcataggattccgttccatgggtgtgcataatcaggacttgggggcctgcctccgccttttgaaaggagagggaagaccctcccttggccaccgcctccagatccaccgtcttctctgtccggttgaacagggagatgccctgggcattgacatagccagagccgctgccggagatggttttttcctggatcttgtccggggtcaccgcctgcagattctgctcttcctccgcctcctccggggcggtctcctccggtttttccccctgggcctggcccgccgattccgcggcccactgggccagcagggcggagtcccccagcagcagccgctgccagaagggcacaggcccgtcccccgccggggcctgggccgccatggcggtctggattcctcccagtccccccagccatcccaggggctggggcaggcccgccgtgaccgccgccatgcccattcccacaatggccaacagacaggcaatgctgcgccgcaggaagcggcggacctgtcccctggctttctgttttttcattggcatcacactcccgtatgccagtatcctatgtaccgcggtccaggttcagaacctgtcccccgccgaaaaggaggtgccccccttgaaaaagctctggacttccccctttgtcctcttcctgcgggaggccatcatgctctatttcagccgccgggtgccccaggccgccgcctgcctggcctacttcgtgctgctcactgtgttcccggtgctcatctgcgtgtcctacattctgggcatggtgaacatcgacattgtcagcctgatggatcagctccagcccctgctgccggaggccgccctggacgtgctggagagctacctgcgctacatctccttccaccagaccccgggcctctttctggcggggctggcgggctgttggttctccgcggccgccgccttccgaaccatcacccgggtcatcatcgacatgtatgaggatgtgtcccaatccatggtccggggcatggtggccagcattctcttccccctggggctgctggtcacggtggacctgtccgtgatcgtggtggtcaccggccagcggaccctggccgccgtggcccagcgtttccccttctgggaccacgtgctgaacctatggtcctggacccgctatgttctgctgttctccatctttttcctctttatcctggcggtgctgaacatggccgcccccttcggcacaccgcggctgcccgtgctgctgagcagtctggtctccgccctggccctggtggtctcttctgcggtcttctcctggtttatcagtatgtcctcccggtattccctggtctacggctccctggtctccctgatcattctgctgatctggctctacctgtgcggacaaattctgttcatcgggattgtgtttaccagcgtatggtataaacattggcgccgccggcggctgacagatccagatgactaacccttgtcacccgatagggattgtgctataatgtatcattactatcttagcatctctttgttttcccgatcctgaatcacttggcagtgccccactgcctggagggtaccgttatgcgtcagcaaacctttcaaaaagccctttcccgaatgacggaaaccggcgttcgactgttttttgcggcctgtcttctcttcgcgttgctcactgccatctacaacatctggctctgcctggcggagctggtcctgatccttctgctctacctcttcttccagaccggcatcagccgccggaagaaagaggtcatggcctatctggaccacatgaccagcggcgtggacgtggcctcccggcggaccttgatctcctcccccctccccatcgccatcttccggccggacaccgatgacatcatctggagcaatgaacgctttctccacctcaccggcgaccccgaccacctttttgagaccaagctctccgccctggtgccctccttccagtcccagtggctgctggatggagaccacctcagccccgaacccgttcccgtgggcgaccagttgtacctggttttcggcaatctggtctgtaccgggggacaggacgaattcctggccaccacctattgggtggatgtcacagagtacgcccgggtggcggaacaatttgacgccacccggcctgtggtgggcattttgcaggtggacaactatgaggacctgaaccgcggcctggaggaaggagagcggtccgtgatccgcaccgagatcaacaaccgtctggccgcctgggtagaccccgcccacgggatgctctgccggtatgaccgggaccactacattcttctggtggaagccggtcaattccaggacttctaccggcggaaattttccatcttagatgagatccggcaggtacagagccccaacggcgtcgccgccaccctctccatcggcttcggccgcaacggcgcctctccccgggagctccacgaattcgcctccctggccctggacatggcgctgagccggggcggcgaccaggtggtcatccgggacgggggagaattcctcttcttcggcggccgctccaaggaaaccgaacgccgcaccaaggtgaaaagccgggtggtggcctccgccttttccgagctgctggccagcacggaccaggtgatcgtcatggggcacaagtaccccgacctggacgttctgggggcggtggccggtgtgtgcgccattgcccgaaaaaaaggggtctccattcaggccgtccgggccccctccccctaccccgccgaggagcagacccgtcagctggccgccctgccggagtaccaggggatttttgtgcctccggatgaggcccttcacctggccggtcccaacaccattttggtggtggtggacaccaaccgcccggaacagacccaggttccagagctgcttgactccggggcccgaatcgtggtcatcgaccaccaccgccgggccgcctcctatatcgaaaagcccgccctcagcttccacgatccctacgcctcctccgccagtgagctggtggcggagctggtccaatacatcttggacaccggcgacctgaagcgccaggaggccgaggccctgctggccggcattgtgctggacaccaagggctttaccatgcgcaccggcagccgtacctttgagaccgccgctttcctgcgcaaatccggggccgacaccgcccaggtgaacaagttcttccagaacgacctgcgggacacggtcaccaagttccatatcattcagggcgcccacacctaccggggctccatcgccctggccctcaccgaccggcttgtgggccgggccatcgccggccaagccgccgacgaactgctcaacatcgcgggcatcgaggcctccttcgtcctcttcccggaggccggccaggcctatctctccgcccgctccaacagcgatgtcaatgtccaggtcatcagcgagatgctgggcggcggcggcaacgccgccaccgcaggggcccagttcccggggaaaaccccggaagaggtccttcccctgctgaagaatgccattgacacctattttgacgatgagaaatcataatttaattttcatttacaccatataacttgggaggtaacaccgatgaaagtgattttacagcaagatgtcaaaggacagggcaagcggggccagctggtcaacgtctccgacggatatgcccgcaacttcctgttccccaaaaacctggccgtccccgccaacgccgacaacatgaacaagatgatcatgcaggacaaggccaagaaggcccagatggccgcggaaaaggccgaggcccaggccatcgcggaaaagctcaagggcgtgatggtaaaaattcccgccaaggcgggcaccggcggccggctcttcggcgcggtgaccagcaaggaaatttccgaggccctgcaggcccagtttgacctgacgattgccaagagcaagattgtccaggaggagcccatcaagagcttcgggacctatcagctcaagtgcaagctggggtatgagatcatcgggaccgtcaacgtggtggtcaccgaagagacctgatccccccggggcagtcccttgcttccaaaggtggtgtttccatggacgagtcgtccctcctattgcgacaaattccccacagcattgaggcggaacagtccgtcttgggcgccatgctcattgacgcccgctgtatccccgacgtggtggaggccctgaccggggaggacttctatctcaaggccaaccgggagatctacgagaccatctataccatgttcaacttctccgccaccattgacccggtgacggtgctggaccagatgaagctcacaggtgtttacgatgaaaacacctcccgcagctacctgctccagctcatggagatcacccccaccgccgccaacgtcaaggagtacatccgcatcgtcaaggacaaggccctcctccgccggatcgcggagaccgccggggagctcaccaccctggtgcaggaggggggggagaccgcccaggccgtgctggatttggccgagcagcgggtctacgccatccgccagggccgcagcgcccaggggctggagcccctgtccaaaattctggtggacgtgttcgaccagctccaggagctgtccatgtcgggctccgaggtccccgggatggccaccggcttcggggacctggaccggaccctcacagggtttcacggctctgaactgatcctcctggccgcccggccgggcatgggcaaaacctcctttgccctgaacgtcctcctacacgcgggaaagttctccggcaagagcgtggtctttttttccctggaaatgagccgggagcagctggccacccgtctgatctccagcgaggccttcctggacaacaaaaagctcatgaccggcaagctctcccctgacgattgggataaagtgaccctggcctccacggccttggcccacaccaaaatctacattgacgacaacccctccctgtccgtggccgacatgaacgccaagtgccggcggatcgaggacctgggcatggttgtcatcgactatttgcagctgatgcagtcctctggcagcaccacccggtacgccggggaaaaccgccagcaggtggtggccgacatcagccgggccctgaaaatcatggccaaggaactccacgtccccgttctctgcctgtcccagctctcccgtgccaacgagagccgctcggataagcgccccatgctctcggacctccgggagtccggcgccattgagcaggacgccgacgtggtcatgttcctctaccgagacgactactataacaaggacagtgacaagcgcaaccaggccgagtgcatcatcgccaagaaccgccggggggagaccaccaccatccccctccagtggctgccggaattcactgccttctcctctgtggagcgtaattatgaagaaccctattgacctggccgcccaggcggcggcttttgccgacaagtataatatgctcccccaggggagcaccgtcctctgcgccctgtccgggggcgcagattccatggccctgctctccgtgctggaggccctggccaaaccccggtccctcaccctccacgccgcccacttcaaccatcagctgcggggggaggagtcccaacgggacgaggacttcgtggtccagtggtgccagaagcggggcatccccctggtggtgggccggggcgacgtggcccaggaggcccaggaacagggcaaaggggtggaggaaaccgcccgcgccatgcgctacggctttctcaccgccaccgcccaggagctgggcgccgacaagatcgccaccgcccacaatgccgatgacaacgcggagaccctcctgctccacctggcccggggcaccggattggatggactgacagggattcccccggtacgaggcattttgatccgtcccctgctggccaccccccgcatcgacatcgccgtctatctggcccaggaagaaattccccatgtggaggacagctccaaccaagacaccgtctatgcccgcaaccgtctgcggcaggaggtgatgccggtgctccgggatctgaaccccgcctttgtctccaccctggccgccaatctggtccacctgcgggaggaccgggaccttctccacgccatggcggaaaaggccaccaagaccgcggtggtgtccgaggggcgggtctccctctccgcccggaccctggccgcgctgccccaccccgtggcggtgcgggcggtgaagcagctcctggccaaggtggaccgcttccaaatttcctccgtccatttggaacagatcctgtccctggccgccggcccctccccttcggccaccctgaacctgccagacgatctgtttgtctggcgggagtacgatcagctggttctctgtccctcttccgccatgcccctggccttctccctgcgcctgctcaccgggccgggcaccttcgccctggacaacggctggaagatcgagatcacagagaccatctgccctgatctccccgcccaggaggaatacgagtgggacattgcccagaacaccgtaaccttccccctggtcctccgctcccgccaggctggcgatcagctccgcctgccgggccgcaggaccaaaaccctgaagaaatggtacattgacgagaaaattccccggcagaaccgccagtcccttccggtcctggcggatgaatccggcctgctggccgccgccggcctggggcccaactatccccgcctggctcaacccggccagcccgccctccacattcgactgacccccaaaaccaaaccagaggaaaggacttagagagagtatgatggaacaggatatgcagcagatcctattcacccaggaccaggtggccgcccgcgtgcaggagctggccgcccagatcacccgggattacgccggaaagacccccctggtggtgggggtgctccggggttcgttcattttcatggccgacctggtgcggcatctggacctccccctcaccctggatttcatggccgcctcctcctacggcgccggcaccaccagctccggactggtcaacatccgcttagaccttcacgatgacatcgccggccgggatgtgctcctggtggaggatatcttggacaccggcaacaccctgtccaagctggtggccgagctcaagggacgccatcccgcctccctgaagctgtgtgtcctgctggataagcccgagcggcggacacggcctctggaagccgactatgtgggtttcaccatcccagacgccttcgtggtgggctgcggcctggactacgaccaaaaataccgccagctgccgtacatcggggtgctgaaacccagcgtctacgaataaccgcgcccggcgggcccccctgcccaggcatcctgcggcggaagcctcaccgccgcaaaaaggagtgacatctttttgaaacaaaacacgaacccctttcgcggtctgatcctgatgctctgtatcctggcgctgatcttctgcgccaccagcatctttcggaccacctcccaccagacagaatactcctacgccgatatccgggcgctttttgaagagaaaaaggtcgataaggtgctggtggacgacgataccctcaccctgaccctcaaagagcccctgaacggcgcccaagtggtcacgtattccctttacaattttgatctgttctacaatgactttaacgacctggtggtccagcagtggaaggacgggatcatctccgactatgagtaccccgacagcccctcccccgcctggatgggcaatatcctcacctgggtggtggtcctggctgtcatggccctgctctggtacttcctgtttctgcgccgggcccagggcgggggcggtccctccgccacccagttcggcaaggtcaaggcccgcaccctggcggaaaccggccggaccgtcacctttgccgacgtggccggcgccgacgaggagaaggaagaactggccgaggtggtggattttctccgccagcccgcccagtatacccagctgggcgcccgcattcccaagggcatcctcctggtgggcccgccgggcaccggcaaaaccctgctggcccgggcggtggccggggaggccggctgccagtatctctccatctccggctcggactttgtggagctctacgtgggcgtaggcgcctcccgggtccgggacctgtttgagcaggccaagaagaatgcccccgccattgtcttcatcgatgagattgacgccgtgggccgccagcggggcaccggcctgggcggcggccatgacgagcgggagcagaccctgaaccagctattggtggagatggacggctttgcctccaacgagggggtcatcgtgctggccgccaccaaccgggccgacattctggacccggccctgctgcggcccggccggtttgaccgccagatttacgtgggcctgcccgacatcaagggccgggaggaaatcctccgggtccacgcccggaacaagcccctggccgaggacgtggacctgcacaccgtggcccaggccaccgtgggcttcaccggcgctgatctggagaacctgctcaacgaagccgcccttctctccgcccgggaaaagcgtcccttcatccgcatggatgtcctccatgaggccatgctgaaggtcatcgccgggccggaaaagaagagccgggtggtccccctccacgcccggaagctcaccgcctaccatgaggcgggccacgccgtggtcatccacgagctgaaaacccaggacccggtgcaccagatcaccatcatcccccggggacctgccggcggcctgaccatctccctgccggaggaggaccggatgtaccagtcccggcaggagctccaggagcgcatctgcacctgcctgggcggccgggtggcggaagagctggtcctgggcgatatctccaccggggcctccaacgacctgcagaccgccacctccatcgcccggagcatggtgatgaagtacggcatgagcgaccggctgggcgccatctcctatgacagcgaccaggaggtcttcatcggccggagcatgtcccaggcccgggcctactcggaggaggtggccgggctgatcgacgaggagatcaaagccattctggacaccgcctatgcccgctgccgggagattctctcccagaacatggacgccctggagcggaccgcccagtatcttctggaatttgaaaccatgtccgccgaggacttccagctggtcttccagcccccggaggttctggaacgccggaaggccgaggagcgggtccagcgaacccggcaggccgaggaaaaggccgccgagcaagcccgtctccaggccgcgcgggaggcggagatggcccgccgcctgcaggaggcggacgaagctgcccagtccaaggaggacgagacgcctccgccgccgcagaatcccgatcccttttaacggattgatcgccccgcattttctccgcgagcagagctgggaaaatgcggggctttcttctgccggggatcgacggtttttcctgcacccttcccgccccttcgacatagattgccatgggtcccaaaaattcgagaggagaattttgaccatgtgtaatatgtcttcttggaacagcggctgtggctgcggctgcggcggtaccagcttccgccccaccaccatgaccgcgcgggtcctggaggtccagtgctgctccctgctggtctgcgactgcgacacctgccagcaggtccaggtgaacaccgacgacgcctgctgctaccgcgtgggggattgtctgtgcatccactacaacggcgccatgaccaacagcctcccgccccagatctctgccacctgcatccaccgcagataaccatccccaagggcccaaaaaaccggtgctcggaagatccgagcaccggttttccacggtacatgggtcaggaggctttccgcaaacgaacccgaatggccttgagcagctggatcaccaccatgctccccacagccagcgccgggatggccagccccagctgccagggcagggccacagcctgcatcagctcctccaggggggggatcaccagcaccgccgacagcaggagcgcccccaccaggaaggcccccaacaggggcttgttgttccagaaccgccgggtgaagagaacgggctccgcggccttgcagttgaagccgtggaacagccgggacagacatagggtcgcaaaggccatggtggcccccgccgcctctccgccgtagcgcaggcccaaatggaaggccacaatggtccccaccgcgatgaccagcccctccagacccacgctggccaggaagggcttggtgagaattccctccttccggggccggggtttctcgtgcatcacctgctcggtgtggggctccagccccagggcgatggcgggcagggaatcggtgagcagattgataaacagcagatggaccgccgcgaagggcaccggcagagccagcagggaggcatacagcaccgtgagaatccccgccatgttccccgacagcaaaaactgaatggaccggcggatgttggcatagacgttccggccgttcttcaccgcctgcacaatggtggcgaagttgtcgtcggtgagcaccatgccggcggcgtccttggccacctcggtgccggtgatgcccatggccacaccgatgtccgcctgcttcagggcgggggcgtcgttgaccccgtctccggtcatggccaccagggccccccgctcctgccaggcccggacaatccgaatcttatgttccggcgacacccgggcatagaccgacacctggggcacaaagtcctggagttcctggtcggtcatggactcgatgaccgcgccctccaccgcctgggtgcccggggtcagaatcccgatttcccgggcaatggccgaggcggttaccacatggtcccctgtaatcataatgggacggatccctgcggcgatgcagtgggccaccgcctctttggactctgctctgggagggtccatcatggcgatcaggcccaggaagagcatgttgttctcctcctccagggagacctccgtggactccagccgccggcaggcaaaggccagtacccgaaggccctggttagaaaaggtctggttgacccgctcgatctcctcccgttccccgggccccagcaccgtccggtccagcatcacgtccaccgcgcccttggtcaccaacatatagccgccggcaaaccgatggaccgtggacatgagcttccggtccgagtcaaagggcagttcccccagccggggccactggtcccggacatccagctcatcaaagccaaagtcctcccccaggcggaccagggcggtctccgtggggtccccgatctcccctttctcattcaccgtggcgtcgctgcacagcagagccgcccggagaaggggctcctgcacagggtccttgaagttggcctcctgagcgggtatgatccgcccgcccacatagagctgccggacggtcatcttgttctgggtcagggtgccagtcttatccgagcagatcaccgacacactccccaacccttccaccgcctggagctttcggatcaccgcgtgctccttggccatcttccgggtgccgaaggagaggacaatggtgacaatggagctcagcgcctcagggatggccgccaccgccagggccacggcgaagaggaaagcgctcatcacattttccccgcggagcagaacactcacggcaaacaaaaggccgcacaggatcaaaatgccgatggagagttttttgccaaactgatccaggctcacctggaggggggtcttcttctccgaggtggacttcagcagggccgcaatcttgcccatctcggtgtccatccctgtgccggtgaccaaaaaccggccccggccataggtgacaaaggtgccagagaacaccatattcttccggtctcccaggggaacctccccgtcaatgacctccgcggccttctccaccggcaggctctccccggtcagggcgctctcggcggtcttcaggctggcacattccagcaggcggccgtcggcacagacggcgtcgcctgcctccagcaccacgatatcccccgggacaacctcccggccgggaatttggaccactgtaccatcccgcagaaccttcgccgtgggggccgacatctgtttcaggctgtccagggaggcctccgccttcaccgtctggaccgtgcccagaaccgcgttcatggtgatcaccgccaggatgaccaccgtactctccacatctcccagcacggcggagaccactgcggccaggatcagaatgatcaccaaaaagtccgcgaactgctccaaaaaaatccgaaatgtggatttttttcccccttcccgcagctcattggggccgtaccgctccagccgccgggcggcctcgtggctggtcaggccgccagggccgctttccagggtgtccagcaggtccttgccggaccgctgccagatctgatcgggtgttttcatgccttcttcttcctttctgttccgcgacagcctgggcacgcaaaaaagacgagcccttttgcccccacaccttcgcgtatggattcaaaagtctcgccatttcaaaccgaagcggggccctttggcccgtgcattgacgccgcggctccacaatcccttgtgccagctactccctttttctacggggcatcatatcctattttgcagggtttgtcaagaggaatccccggtctttccccggaaaaggggccctcccctccaggcccgcctcccgcaaaaactcttgctattcttccccgaatgcagtaagatatttgtatcttatcccctcgtttggaggtgggcacatgccccaagcttcctcaggcaaaccccttcgtttctggcttctgctcatcggcctcatcgccctggcgtgtgtggccggtctggtcaccctttccctccaccgccagtccggcgccatggtgcagatcacccaggacggccaggtggtgggaacctattccctgcagcagccccgcaccctgcgctatgagagtcaggacggcgggtacaatatcgtggtcattgcagacggcaaggtgcgggtctccgaggccagctgcccggaccaggtctgtgtccgcaccggtcccacagaccaaactgcttcccccatcgcctgccttcccaaccgcctggtcatccaggtcattgacaatgggacgtcgtcccagctggacggagtgtcgtaatgaatatcagaaaactcaccaccatggccatgctcacggccatctccatgatcgtctttctcattgaggcccagatccccctccccatcgccatccccggcgtgaagctgggcatcgccaacgtgattaccctctttgccatctggaccctgggccgccgggaggctggcgccattctcatggtgcggatcgtcctgggcaatctcatcatcggcaatgtcatgggcatgctgtacagtctggccggcggggtgctgtgctggctcgtcatgtgcctgctcaagccccacgtgggccggaagcagatctgggtgatgagcgtcttcggcgccttgggccacaatgccggccagctggctgtggctgtctgggtctccggcacccccgccctggccttttacgcaccggttcttctgctggcggggattgtcaccggtttcttcaccggccaatgcacccaggcggtgctgaatcatttagacaagctgaagcacaccgcagaatcgtcaaccagtccaaaagattaagttgacaaatatctctttttcgtggtatactgacgcatcccttccgaaatgaggcgaatgctgatgtctgtacctacccacaccaaagccctggacctggcgtatattgccctgatggccgccctgatcgccctgtgtgcctggatctctgtccccttggggccggtcccttttaccatgcagacctttggcatcttcgccgctctggggctgctggggggccgccgcgctcctcttctggggcctcaccgccaagctggggcaaacccttccggtgatggcctcggccatggtgctggggctggtgctctgctatgccttcggcaccttctggtttctcaccgtctacaccggcggcagcggggagaccctgctgggcgccctgaccctgtgtgtgttcccctatgttctgcctgacctggggaagattttcctcgccctggtgctggtctcccgggtgaaaaaacacctggccctataacctctgttttccaaggagttgatttcccgatgcaagtcaaagaccgtgtcctggaagccctggagggccaccggggaacctatttctctggcgaagccctggccaaagagctccaggtcagccggaacgccgtctggaaggctatccgtcagcttcgggaccaggggtatcccatccacgcagtctccaaccgggggtactctctggccccggacagcgccatgctctccccccagagcatcgcccccttcctcaccgttcccggcctgcaggtggaggtccagcccgtggtcacctccacgaatcaggttttacgccagcgagcggaggagggggcccatgagggactggctctggtggctgttacccagaccgccggtcggggccggcgggatcacagtttcttctcccccccagattccggcctttacctgagctttcttctccgccccgatctctccgcccgggatgccctctctttgaccacctgcgccgccgcctcggtggccctggccattgaggagtgcgccggagtggacgccaagatcaagtgggtcaacgatgtgttttgtcatgggaaaaaggtctgcggcattctcactgaggccgccttggatttagaaaccggcggcctgcagtatgccattgtgggcattggggtgaacctcttccccccgaaggggggcttccctccggagctgccggaggccggcgcggttttccccacccgtcctcaggggctggaggggcgcagccagctggcagggtccattctcaaccacttcttctctttctatccccacctaaaagataaacccttctttgcggattaccggcgccgctccctggttctgggccaggagatcaccgtcttagaaggcgggcagacccgcaccgcctttgccctggacctggaacgggatttctccctccgggtccgggaaaccgacggcaccatccataccctatcctctggggaggttcgggtccggccggctcatggttgagttcacacattttttacgattcttcccttgactgtccctccccctggggtataatattctttactatctgcaaagggggatgattccttggcggagcccacaaaaacattttggcagcggcaccctggctttgacgtttacagcctgttctggctggttctctttctgatcctggcggcgctggggcggttttatctccccctgttcctcccagccgccgtggttctggtctacctcctcatccggctgttctccaaaaatcagcagaagcggcaggtggaaaatgcccgttttatcgccctgttccggtccatcttccggtggttccgggggcggaaggtgctccagaccgacaaagagtattactatttcaagtgtcccacctgcggtcagtccatgcgcctgccccggggactgggcaaggtggagatcacctgccggtcctgcgcctctcggtttgagacaaagtcctaatgtcaaataagttctccaatgcagtaggcattggagaacttattttttcatagagcttaaccccttttcaaagcgtgactatctttgcattttatagaaaccaggtccaattatataacaaaaaattgcaggcacaggccagtgtcaaatagattaccggttcacagctgcccagtgaaaccgtccgttgtgcctccttccccccgaaaaaatgctttcccaccgtcttccacaccagatatcctaacatggtccccaacgtattcatcattacatcatccacatccaccagccgattcgtcggtacttgggcaaactcaataaagacagacagcaagaaacctgtgaatgccactttgaagggatttctaaagttcttccatatataggggagcaaaaatcccaacggcatcagcatgatcacattcatgcaataggtgaatatcccctccgattgaaaggggacccagcttatgtttgcctgctgaaccgtggcagcccatccgcctttggcaatgacatcccatatagagccgattcccgtcacagaaaaaacaagccatatataaagcatcatcgtgtatgtccacacatagtgggtcagtgtagacttttttcgtgccagcagcctcatgctctgatagagcatacccggcactatggtcaaaagaattgggatcatcagcatcaaaagcattctttccgctcccccttccacttacccatccaatctaccatggatctctgaaaaaagcgttaaggtttgcgaaattttttcttaaatcacgatggcttccgtgccacttcccctcttgcaatccggcgctgtcaaattcaccgcgccatggttcgaccggtacaggcttcgtccctgcccgaacaaaaaaacgcgcggcctacgccgcgcgttggagacggttattcttttccttccggccgtctgccgcagacggggcagcggtccgaggaggcccggtaccaggttccgcaggcaggacagtgggacatggcctggttctcccggcagggtaccgcagacttttccgccgccggggcggcggtctccggggcaggctgctgacgtccaggggcagcggccggtcccctctcctctgtcatctgggtcagcttctggtggatttcccgggtggtcttcacctgcatcaccagcagcaggatcagctcataccccacccgcagcaggatgggccccaccgccaggatcaccaggcccagggccaggttctgaaaccctgagaagaacccgctgaaaaagaccacaatcccgtacagcaccgccaggcaggtgagaaacacgtagagaatttgcagcagcttctccatcaccagggtcttggggctgaagagatcatagagcatctgaaacaccgacggcagatggccgtccttctccttgggcagcaccagcaccaccagcagggcggtcagcgccaccgccagcaccaggattccaatgacaccggcggcataattttgataaccgtaataatacatggcagcatccctttctttgtctgtggggctccaacggggccgttatgtttgttgcttcgtgcggtacagatcggtccggcggccagagagaatgggaatctgggcccggtagcgggccaggtcccccaagtcaaggtccaccacccggaccgcctccccctcgccacagtccgtgaggatctccccccagggattgcacaccagggagtggccataggccacataggaggccgacctgtcccgggccggggaacagccggccacaaagcactgctgatccaacgcccgcatccggaaggccaggtcccaatgcagggggcccgtggtcatgttgaaggcggcgggcaccaggatcagctgggcccccaggtcccccatgacccggaaaaactcggcaaagcggatatcaaagcagatggccagccccagttttcccagcgctgtgtccaccaccgtgatctggctgccggcggtgagggtgtccgactccataaaccgctggccccccggcacatcaatgtcaaagaggtgaaccttgcggtggcgggccagctcctccccctggggagagaagagataacaggtgttgtaaatggcctccccctcgatctccggtaccgaccctcccgccaggtaaatccccagctcccgggccatgccggaaagaaattgccaggtctctcctccggcgggctccccgtagaccggaaagcaggcattctcatagggacagttgaacatctccggcagcagggccaaattggcgccctgggcggcggcctgacggaggcagctctccgcccggcggaggttctcctgtttgtccggtgtcacacgcatctggcacaatcccaatcggattcccatcggcaggctcctttccttctcccgggccccgccggggaccggcggggaaccacgggggttcttccatgactgtaccatattttctgcccggacgcaaggtgaagcaggcgggttctccttccctttccattgcgtcccagggtgttttcctgtataataaaagggatttcctcccaaactgtttgggaaagatggaaaggaactcctttttatgactgcatctcccacccgccggcagctggttttcctgctgggcagcctgctgctggctccccttgtcaccctgtatgccacccaagccgtgtggctccagagcctgtgggcgcccctgccctggatggcctcgcatggcggtgcaaccgtgctgttttgggtgctcttctccagtctgagcctcaccctctacggctttttccgccggctgtttcccgcctatctgccggaagtggccgtctttatgggggtggccgtcaccagccggtataagctggacatcaacggcgcacctctccagttaagtgattttgccttcgtgggcaacctgggcgacatcaccgggtatgccgcctctcagctcattcccaccttgactaccctgctggccatcggcgtggcggccgttctcacggaaaccctccgccgcaaggagacctggcgtccctccctcacccagggcttcgtcctgggcagcctgtgcctgacgctgttcctctcggcgctgtaccccggtgcccttcagtccgccgcccttcgcctggaccagaacagcccggaccaggagacccgcaacgaacggatgggggtggtgctgggcctctacaccgcctgggcccagcgtctccaggtggagaccggcaccgccgacccggagaccacccgtctggtggaccagctgcgggcggacgccatggggccaggcacccccgcgcctgccgccgccccggacattatctttgtcacctccgagagcttttttgacgtaacccgtctgccgggtctcaccttttcccaggaccccctgcccaatttccaccgtctgtcggagacctgcaccaacggcccctttctctccaacacctatggcggcgggaccggacatgtggagatggagatgttcaccggcctgacctcctctctgctcaaggagggggataccctaaatacccttcacaccgcggtctatcaggacctgcccaccaccgtccggctgctgcaaaaggcgggatacgccaccaccgccctccacgcccacaccagtgagctgtacaaccgggagaccatctatcccgccatcggctttgacacggtggcctttctggacgacttcctcacccccgtggagatcgcaggcaagtacgcctccgacgactccttcgcccgggaactcatcgcccggtatgaagcccgggaccccagccagccggtctttctgtacggcatgtccatggagaaccaccagacctacaccccggaaaagtacggccagccctcgggctttcccgcccagtgcgacaagctgtcccaggaggacttggccattctggacgcgctggtcatggggctgcaccacgcggatgcctccctggggctgctcaccgactacttctcccaggtggaccgtccggtgatgctggtctttgtgggggaccatctcccctccttgaacctgtccgacggggtctccctctacacccacctggggtactctcccacggaagaggctgcggactgggacccggagaccctggagaacatcctgtccaccgactacctgatctggaccaattacgaggcccaggccgccccggaccggatggagagctgtaccttcctggggctgcacaccttacagcgggcgggcattcctctgaaccagtatttctcctggctggaccgggaggtggcctcccacatgctcctctcccgccgcaccctctttgtggaccaggacgggaagggcacctattccccgtcccaggaggacctggccatactggaacagtacaccgccgtggagcggaacctgctctaccgtcggtagaccgcagttctcccccacgcattctcaatcttacaaaggaggtatttctctatggaagaaaacaaactcacccaccgggccggtctggtccgggaagccgcggaaattctcaaccgctacaccccttacgccgccgagcgccgggtcacctttcagactgcggagaacggctggctcaccgcccggctggaacggaccgacggccagcccctggcccaaagcgccaaccccattgaccaaaagctggcccatctgaaggaccagaccctggtgatccgtcccttctttctccccatggccaaaagtccctgggaggaatccgacgccaacgacttcacccaggtgaactttgactacgccgccattctgggctacggcgtgaccccggagggaacctcctttatgaaggccctctatttcctccccaccgacgccctcctggccggtcagaagccccgccccgacggcacctggcatctgccgctggccacctactatgtccaccaaatcagtctggacccccggaaaaagtttgcccggttcctctatctggtggagcggatcaccgaggcattggaataccaatacgacaaaaccggcggcttcttcagcaaccccgccgcccagtgacagcccgtctcccccgcccggcaacgggggagacgggtttccgtttcctgcatatttttcccaaaattttcgttggaaatggtggcaatgtacgcaaaaatacgctatactatccctaccaccgcgggtgagaggtccctctctcgtccccgggaaatttgaagatatggaggattgtccaacatgaaactatggaagaagttttccgcgctcttcctggcactggtcatggtgctggccctggccattcccgccggagccacagagacggaacaggacctgaccggtcacatcgttattctgcacaccaacgatgtccacggggccatcggcgagtatgccaaagtcgccgccttgaagcaggcctaccaagcggccggcgcctatgtgctgctggcggatgccggcgactttatccagggagaccccaccgtgagcgcctcccagggaaagaccgccattgagcttatgaacctggccggctacgacgtggccgcccccggcaaccacgagtttgactacggctaccccaatctgaagaccctggccggggaagcggacttccccatcctggccgccaacgtacggtatgacaacgccgccgccctgggggatcagaccaccttcaccaccaccgacggcaaaaagatcggcattttcggcctggacacccctgagaccgccaccaaggcccacccggacaagatcaagggggtctccttcctggccgcccaggagatgttcgactgcgcccaggcccaggtggacgccctgaaggccgacggctgcgactacatcatctgcctgggccacctgggcattgacgctgagtccaccggcaaccgctccatcgacctgctggagaaggtcaccggcattgacgtcttcatcgacggccactcccactccaccctggaagagatcaaggaagccaccaacggcactggcaaggtgggtgacaccgtgctcacctccaccggtaccaagctggccaacgtgggcatggtggatatttcccccgacggcaccatctccacctccagcctggccaccagcgagctgaccgtcacccccgacgccaaggtcgccgcccgggccgaggaaatccagaaggaaatcgacgccgactacggcacggtctttgccaagaccgaggttgctctggacggcgagaaagccaacgtccgcaccggcgagaccaatctgggcgacctgatcgccgacgccatgctgtggcaggccggcctcctggatgaaggggtggacgcggccgtcaccaacggcggcggcatccgcgccagcatcgccgccggggacatcaccaagaaggacatcaacaccgtcctccccttcggcaacaccctgtacgtggtaaaggtgaccggcgcagagctgctggaagctctggaggcctccacctactgcacccccgaggccattggcggcttcccccaggtggccggcattgagttcaccgtgaacaccggcgcccagtttgacaccaaggagctctatcccggctccacctatggcaagcccgcctccatcaaccgggtcatgatccagaccgtgggcggcgaggcattcaaccccgaagagacctacaccattgtcaccaacgactttatgggcgccggcggcgacacctactacgccttcaaggctgcctccagcggctatgactccggcgtgcccctggacgaagtggtcatggactacatcacctccgagctcaagggcgtggtctccaaggcgcagtacggcgagaccgataaccgcatccacaccatctcctacaacgatgtgaaggccggcgactggtatgccaatgccgtgaactatgtgaccctcaccggtctcatgaacggcaccggggacggcttctcccccaacctggccattaaccggggcatgatggtcaccgtcctctatcggatggccggctcccccgaagtcaccgcggagaatcccttcaccgatgtgccggcggacacttggtacaccgacgcagtgatctgggcttccgagaacggcatcaccgccggcacctccgagaccaccttctcccccaccaattccctgacccgggagcagctggccaccttcttctatcggttcgccgactttgagaatcccgatcccatcgagatcaccggcgatctgaccggcttcaccgacgcgggccaggtggcctcctatgccaccgacgccatgaagtgggccattggcgagggcctgatctccggcaccaccgagaccaccctctcccccaaggcaaccgccacccgggcacaggtcgccaccattctcatgcggtacaccgcggagtaattccggcgcccttgtcccgtttctgacagaaaagccccgaacccacttgggttcggggctttttccccggcagggcagcggcccatccggtcagtgttcataccagcccaccgggccggggttgagattgatgttgatttgcttgacctcctggtactcctccaggccgtggacacccagctcccgtccgatgccggacatcttatagcccccccacggggcctcattgaaggtggggttgtagcagttgacccaggtgatccccgcccggatctccttgatgacccgcagcgcccgggccccgtccgcggtgaataccccgccggccagaccgtagatggtgtcgttggccagggccacagcctcctcctcagttcggaaggtctggatggtgaccaccgggccgaaaatctcctcccggacaatggtcatctccgaggtgcagttgtcaaagatggtgggctgcacaaagtatcccttggcgcactcgccctcggtgtaccgcgcaccgccgcagaccagggttgccccctcttccacccccttgcggataaagcccagaacgtcgttcatctggctctcgctgaccatgggccccatgtcggggttgttcaggggattgcccagggtaatggcgttggtccgttccaccaggcgccgcaggaaggtctccttaaagctctcctcaatgaggatccgggacccggcggagcagacctccccctggttgaagaaaatcccgatcatggcccactccacggccccttccaggtcggcgtcggcaaagatgatgttgggggattttccccccagttccaggccgatcttcttgacatttgccgccgcgcagcgcataatgtcctgtcccaccgccgtggacccggtgaaggtcaccatgctgatgccgggatgggcggcgatggcgctgcccacagagccgccaggccccaggatcaggttgaccgagcccttgggcatgccggccttttcaaaaatctcaaacatcttcaccgtggataaaacgcagttggagctgggtttgaaaatcacgctgttccctgcggccagcgccggggccagcttccaggcccccatgaggaaggggtagttccagggggtaatgagccccacaacccccaccggctcatggatggtgtaggaatgcatctccccaaagccggcgttcacgccatagctgcccccctggggcattttgatgaggcccgcatagtagcggtagcagtggatggcgtcgtccacatccccctccgcctcccgcaggggctttcccatgtccaccgcgtccaggtaggccagctcctcccgggcctctgcaatcaggtcagcgatccgcagcaggaaatctcccctggtctggctgtccatatcccgccattcccgggtctcataaaacgaggtgtgggccgcggccaccgcccggtccacgtcctccggcgtgctgaccaccacctgggccagttcctccccggtggcgggattgaacgtaggggcggcgtttccgctcacgctctcggtccatgccccgttgatataattcttgcagcgcttcatagttacctccttcaatggcattgcgttccctgtgggccccgtgccaacgcgaaagggcccctgtgtccccagctctcacaaaggaactgggcggctttggcttcattataaggggcggcgctccattttgaaattctttctttccccctctttttacgggaaaaaaagtataaattcctattttgaggtatggtgtttcctgttatttcatattaaactaaaaaaagcaaaccatccggagaaaggagcaggcgtttcattgctggagaaaaaccaatttttgatcttcaatcatgtactgtctgagctgtaccgatgccggacctatcaggacctgggggacgcctttctgccgatgctgcggatgctcattccctaccgctacgccagcatcatgcgccgggcggaggccgggccctccatccacctggtggaccccctctgcgtccccgccgcctttgccgaggccgagcgccggtacatgcgctttgccgccgacgactacaccgcctggctgagctgctgccgggaggccaccctcttccgggagagcgacctggtgggggaacagcagcggctgcgctccaccatctaccaggagtgctatcagccctttgaggtctatgactccctccagtacggcattgtctgcaacggtcagcccttgggggcgctgagcctgttccgctgccgggaggacgggcctttctccgaccacgagctcttcctgctccggtccgtgggcacgcacctcaaccagcagatggccgctctgctggcgggcaccccccctgcgggcgggtcccctgaccacagcctggccgccgtggccgcccgccacggcctcaccctccgggagcgccagctgttggaggaattgacccggtttcggaacaaccaggagatcgcggaggccctgtcggtgcgggcctccaccttacagaagcattttcagaacatgtttcgaaaattcggcgtgacctcccgctgggagctcatgcgcctgctgctggaggagggcgccctgccctgggtgccccctgtcccccagagcgaataaaaaaggacctgcccgccggcaggtccttttgcctctgtttttcagtgtgcacgaaagcgggagaggaactcctgggtctccgccttctgggggttctcaaaaatctgctggggggtgccctcttcccagatgacaccgtcccgcataaagaccacatggttggacacgtcccgggcaaaggccatctcatgggtgaccaccagcatggtcagaccctccgcggccaggtcccgcatgacggagagcacctcccccaccatctccgggtccagggcggaggtgggctcgtcaaagaggaggacctccgggtccatggccagggcccgggcgatggccacccgctgcttctggccgccggagagctgccggggcttggcgttgatgtagggggccatgcccaccttggtcaggtacttcatggccagctccttggcctcggcggcgctcttcttgagcaccttgatctggcccacggtgcagttgtccagcaccgacatattgttaaagaggttgaaggactggaagaccatacccaccttcgtccggtaggccgcggccccgcccttccgggtgaggatgttctccccgtggaaggtgatctccccgctggtgggggtctccagaaggttgacacaccgcagcagggtggacttgcccgagccggaggccccgatgatggaggtcacatccccccggttcaccgtaaaatcaatgtcccggagaacctcatgcttgccaaaggatttggacaggtggcgcacctgtaaaatcatctcatccatgtcactggtcccctccgtcctggtttctggtttcgttgccgtgggcccggcgggtctccgccttttgcccctcccggaccgcggcgtcccgctcggcctggcggcgcagctcctcccggagcatgctcttctgggcctccgggttgcgctcgtcaaagggggtgccccggccaggataattgtaggtaccggcggacatggtcagcgcgtctacctgaaccaaatcatagctgtcattgccgtccagcttcttctccagcaaccgcagcaggaaggaggcaatgagggtcatggtcaggtatcccaccatctcaatggcagcggaggggaagtagagatagttcgaccccaccacggtgcgatggatggcaaaaaactcggtaaagctgatgataaacatcaccgaagtatccttgatattaatgatgaagttgttgccgatttgcggaacgatatttcggaatgcctggggcagaatgacgctgaccatggtctgcacgtgtgtcatgccgatggccttggccccttcggtctggccagggtccacggagataatgccgccccggacggtttccgccatataggcgccggtgttgatggagacgataaggatggccgccgcccagatattgtcaaaccgcagggcgttgttgctgaaatagggcaggccatagtaaatgaacaccgcctggagcaccataggagtcccccgaaaaatctccacataaacgcgcacaataattcggatcagcttcagcagaaaccgcttgggcagggaatcacttttggtataaggaatggtgttcaacacaccacagacaaagccgatcaggcacccgatcaaggtagccaccaccgccaagatcagggtgttcttgatgccgttcaaataggaaccactgtactggctccacaaacgcaccatatcggagccgagctgggcgaattgttccacagaggagcactcctttctctctttgcccggaactgggcagtccggcgcccccgccggggtaccggcgggggcggttatgaataattgtgaaaattactgattcaaaggctggatggaaacagcataatccatcaggttgtcgaagttatccttgttgagcgcggaaaccaccttgttgatggcgtccttcagctcggtattgcctttcttcagggagatgccgatgttaatgtccccctcgtccacttggaagttatcctccgtgtcggtgaagtccagaatgaccatgtcatcgtaagcagccacagcacccttggctgtgggaatgtcggtgcagataaactctacggcgccagtctccagcgccatcagcatagcaggcgccgtctcagcggcggtctggatctctgcgcccttaatctgcggcaggcaggtatcataccaaatggtttcaatctgcgcggtggcggtaccggtcagttcgctgattccctttgcggaagcctgagggctgccatcctttgccacacagacaatagaagcgtagtagtaggggccggcaaagtccacttgctccatacgatcctccgtcatagactgaccggcgatcacagcatcatacaaaccgctctgaatcccgggaaccaaggagttccagtcagtgcgaacaatttccagctcccagccgtaagcctcacaaatgcgcttggcgatcatcacatcatagccattggcgtattcactggagcccttgatgggcacagcgccattggaatcgtccatctgggtccagttgtagggagcgtaggtacactccatcgccacagtgagcacgccatcctctactccagcgatggcgctggtgtcagtaccggtcaggtcttccacggggggaaggtccagcgtaacggtttccgcaggggaattggtctccgggttttccgccggggcatccccattgtccgtggtgtctccgccacaggcgcacaggcccagggccatcaccagtgccagggtcaaggcaagcatctttttcatggtggtctcctcttttcattttttatttgttaaaaaaaccatggacccgaagcagatccatggcaaacaaacacaaatacggggctcccgcccctttggttgtcccatgatagcgctccatcgttttgacaatggcagtccggcagatcttctctgccgacccagggcacccctcaggcaggaacccgagaagcccttcggcggtgccccctttcgcttccccggttgcctgccggaggttggaaggtactgatgagcgccgcgcctctatcattgttcttcattatacgggacaagacctccccttgtcaaggaagcagaaggaacaagatacgcccaggtttttcacctatttttgggcagttccgcacagtttccaggctttgcccggggaagggcctgcctcccccgggcaaagccccggttcactccatcttttttctgccgtcgtggtaggcctgtcccaccacaccgcccagcaggcggtatacccgccgaacccggtcaaaggacaggaactgggccttgtcggcgtccaccaggccatcctcccccaggatggcctcatcggcgctcatgttcaccacctggcccacaatccgcacgccgccggggccgtcgctcctctccaccacctggcactccaaggtcagggggaactcctcaaacaggggcgcgtccacgaaagcactccgcaccggggtgagccctgcccgggcaatcttgtccggggtggtgtggccggagaccagacccacataatccgcttccgtcaggtgcgcccggtcggcaaagctcacggtgaaggccccctttagggagaggttttccgtggtcttatggccctgggaaatgttgatctccacatagccgccccccaccaggccgccccagcccacattcatggcgtccggaaccccgtcggtgtcgtaggtgccgatgatcagcaccggctggggataaaagccaacatccttgaaattttttcgcatggatttctcctccttctcacaacatccgtcccacggtgtaggcgctgccaatggcggtcatcacactgcccacccggctgccgtctcccacctggtagacctccattcccgccccggccagctccggcgccagggaggtccggggggcaaatcccaccgccaggacaatgtggtccgcggacagcttctcctctccgtcggggccatcggccaccgccccgtcctctgtgacccgagacagccggcggccggttctgcggaccaccccggcctcgtccagcaggtcccggagcatggagtcattcatctccggcaccgggataccggcggagagaatgtccggcagggcctctaaaatggtgacctgcttgcctgcctgggcatagcccagggcggtctcacagcccaccaggccgccgcccaccaccagcacccgctggccggggaggtccgggccggtgagggcggtgacgcagtcgatcaccttggggctgtcgatccccggcaccgggggcaccgccggggcggcccccaccgccagcaccaccgcgtccggacttcggtcctggatctcccgggcggtcagacggacgcccagttccaccgtcacccccagctgggccagctggccctgataccagcggttgagctcgttcagctcctccttaaagggatgggcgccggcggggatcagattgccccccagccggtcgctcccctcgcacagggtgacgtcgtggccccgcagggcggcacatcgggcggcctccatcccggccacgccgccccccaccaccagcacggatttcttccggggggcgggggtgagggcaaaggaagcctcccgggcggcctggggattcaccgcgcacccggcccggcgacccactttcagggcgccaatgcacccctggttgcagccgatacaggggcggatgtcctccggccgccccgtggccaccttctgggggtaggccgggtcggccagggagggccggcccagcaccaccgcgtccagcttcccctgggcaatggcctgggcggccagatcggggtcgttcatgcggccgccgcagagaatggggattttcaccacctgcttcaccgccgccgccaggggaatcacccgccctttctccatatagcaggggggcgccgcataataaaaggaatcatactgcccaaagtccacactcaggcagtcatagccgtaggcctccagccggcgggcaatctccagcccctcctccagggtccgccccacttcctcttccccgtgaagggagggcttgttatagcccttgatgtaggacttcagcgccaggcgcatggagaccacaaaatccgcgccgcaggcggccttgaccccctccacaatctcccgggcacagcggaggcggttctccagcgccccgccgtactcatccgtccggtggttcataaaggacagggcaaactggtccagcagatacccccagtgcatggcgtggacctcaatccccgggaacccgcactggcggaggagaactgccgtggcaatcatctgatcgatcttctgctggatctgctcccgggtcagggcaggggccttccgggcgggatcgtggtaatagggaatctccgagggacagaagcatcccagggcgttgcggccatatcccatggaaacctggggcagcatcttggtgccataggcgtccaaccgctccagcagctccaccgccgaccgctgaaaggtcttgggggccttcaacggctgcttgctgtccaggggatggaccgggtccaccaaggtgtccgggtgaaaggccccggtaaacaacaggccaaagccccccttggcccgagcctcaaaataggccaggccgtccggggagaactcgccaaagggcccctgcagggagggcagggtgaggggtcccgcacagaagcggttctggatggtcattgccccaatcctcaggggctgaagcagaggcgcgtggatgaatgtcataggattgttcctcctgttctctcgtgttttttcagaggaccggggcttacaaaacccgccggtaaaattcccaggcgtttttccagcacaccgcctcaatctcccggggggtgaaccccgccccctccatggcctggaccagccggtccatgtggccggcgtcctccagttccagggggcagtcgataccgtcaaagtccgagcccagcgccaccaggtccaggccgcccacctggatcatgtggcggatgtggcgggtgagatcggccagccggctggtcccatggggccccaggaaccccgcgtaaaagttgacccccaccagacacccccggtccgccagggcccggagcatggcatcggtgaggttgcgccggtgggggtgcagcgcccggcagctggaatgactggccacaaagggcttccgggccgcccggcacacgtcccaaaccccgtcgtcggacaggtgggacacgtcggggatcatccccaggttctccatctcctccaggaactggaacccccgccgggtcagcccgcccggctggccgttggggcggcccagctcattgggatagttccaggtgagggtgagcatccgcacccccagccggtaaagggtccgcagcagcggaagggaccccaggcagacgcccccctcctccacggtcagcaggcaggcaatctttcccgcctgccgggcccgctccatctcctgaaaggaccgaaccggcacagccaggtcctcgttggcctccatctccgtccaatagaggtccgccagggtcaaaacctcctccaacggcgaccccgcccggcagcccatggacaggcggtaaaggtcctcggcaccggccccttccccagggggcggcgtctccccctgcaaattgacaaacagggcaaagttctggagcaggtatccgctccgctggagtttttccaaggtaacatgggccccttccccggtccgaagctgaccgggcagccccgcccgccggcaagccagcaggcgggcaatggtatcacagtgcaaatccacaaagggcatgaagtcccctccttatccctccccgtggggagcgtgacaggctacccggtgttcccctgttccctgaaggggcgggggagcctgggcgcagaccggggcggcatagggacagcgggtgcggaaccggcagccggagggcggggtgacagggctgggaatctcccctggcagcagttcccgcccctccccccggcgggtggggtccggccggggcaccgaatccagcaggaagcgggtatacggatgccgcggggcggtaaacagcgcctccgtgggccccacctcacacacccgccccaggaacatcacacacacccggtcggcgctgtggcggaccacccccaggtcgtgggagaccagcacataggtcagccccctcgccgcctgcaggtcggccagcaggttgagcatctgggcctgcaccgacacatccagggccgagaccggctcatcgcagaccaccagccggggggacagggccagggcccgggcaatgcccacccgctggcgctggcccccggacagggcgtggggatagcgccccagcaggtcccggggcagccccacctggtccagcagcaccgccgcccgggcgggaatctcccgccgggggcagaggcggtggacccgcagcggctctgccagaatgccctccacggtcagccgggggttcagggaagccgcggtatcctgaaacaccatctgcatctgccgccgaagggcccgcaggtcccggggcgaacaggccgccaggtcccgcccatcaaaaaacacctgcccctgggtggggggcagcaggcccagcaggagccggcccagggtgctctttccgcacccggactcccccaccagggccagggtctccccctcgtaaaccaccaggtccacctgggacaccccgtggagaaccgccccctttccctgtccccgggcgggaaaggttttggagaggtcccgcccctccgctaaaatcttcgccatagcccctcctctcaggatatgtggcagcagcgcacccaatgccccgccgccagggcccgcaggtccgggacctggcgggcgcagtcctgccggctctggtcacaccgggggcaaaaccggcaaccaggcaggggacagcgggggtccgggacggacccccggatggtatacagccggtccgccgtcccctccagggaggggatggccttcagcaggccctgggtatagggatggcggggggcccggaagagggcaaaggtctccgccgcctccacaatctgtcccgcgtacatcacatagacatagtcgcacagctgggccaccacccccatgttgtgggtgatgagaaggatggccgtgccgtggtcccggcgcaggtcccccatcagccggagaatctgggcctggatggtcacgtccagggcggtggtgggctcgtcggcaatgaggagctccggctcacaggccatggccatggcgatcatcacccgctggcgcagacccccggacagctgccggggataggcgtcataccgggccgccgggtccgggatgcccacctgctggaagagctccacggtgcgggccttggccgcccagcggtccaggcgccggtggaggcggaggacctccgccacctgccggcccacagggtacaccgggttcagagaggtcatagggtcctggaagatcatggcgatccggttgccccggagtttccgcagcgccccctcccccaaggtccgcaggtccgtctctccaaagcggatctccccggcggcaacccggccggcgggggggaccaggcccagcacggacagggcggtcacgctcttgccgcagccggactcccccaccagccccacgatactcccccgggggatggccaggtcaacgccgtccactgcggcaagaggcccctccggggtgagaaactccgtccgcaggccggtgatggtcagggtattctgtcgcgcttccaccgtgttccctcctctgcctggattcttacatagcgtcagtttagcacaggccggaccgttgggcaactcttttgccccgagaagtctccgccaaaggtcttctgcaaaaatccctgcaaaaaatttctgaattttgacagacagccattcactttttctctgctttggggtataataactacaaaattactctccttttccctctggattcggagtggaaaaaggccgcatcgtaattcatcggaagaaagaaggatatgagtatgatgatctccaccaaaggacggtatgctcttcgcgtgatgctggacttagccgaccacaacaccggagagtacattcctctgaaagatatcgcccaacggcaggaaatttctgtgaaatacctggaaaatattttggcctccctcagccgggccaacttagtggacgccatccggggtaaaggcggcggctaccgtctttgccgcgcccccgaggcatacgccgccggggagatcatccgtctggccgagggcagcctggccacagtctcctgtctgaagggggagaaaaacggctgtgaaaaagccggccactgccgggccctccccctgtggaaggggctggaccaggtggtcgatgaatacctggacagcgtctccctggccgacctgcaaaaaatggaggagaactgacgtgtctgtccgcgccccctgcgatatgcagggggcgcttttttatccgatgctttttttgtttttcctattgactttatatgtaattcatggtattcttcaatcaacctaataatttagtaggaattaagcaataaggaggttgctccatgatatacgcagacaacgccgccaccaccaagctcagcggcaccgccctgaacgccatgctcccctacctgcgggaagcatacggcaatccctcctccctgtactccctgggccagcaggccgctgaagccctggcagaggcccggcagaccgtggcggactgccttcactgccggccggaggagatctactttacctctggtggcagcgaggcggacaaccaggccattctctccgccgcccgccggggaaaggcgcggggaaagacccacatcatttccacttcctttgagcaccacgccgtcctccacaccctccagaagctggagaaggagggcttcaccgtcaccctgctggatgtccatgagaccggccgcgtcaccccccagcaggtggccgaggccatcacggacgacacatgtcttgtgaccatcatgtatgccaacaacgagattggcaccattcagcccattgccgacatcggccggctgtgccgggagagaaacgtcctcttccacaccgacgcggtgcaggccgccggccacctggagattgacgtgggccgggagaacatcgacatgctctccctctccggccataaattccacggccccaaaggggtgggcgccctctatgtccgcaagggcattcccctcacccccctcattgaagggggcgcccaggagcgccggaagcgggcggggacggaaaacgtggccggcattgtgggcatggccgccgccctgaaagaggcctgtgaccacttaccggaacataccgccaaggtctccgccctgcgggacaagctcatcgccggtctggatgccatcccccacggcgccctcaacggggaccggaaccaccggctgccgggcaacgtcagcttctgctttgagggcattgagggggagtccatgctcctgctgctggatgaccggggcatctgcgcctcctccggctccgcctgtacctccgggtccctggaccccagccatgtgctgctggccatcgggcggccccatgaggtggcccacggctctctccgcctgtccctgtgtgaggaaaacaccgagcaggaggtggacgtcatgctccgggagatcccccaggtcatcgactacttacgaaatatgtccccggtatggcgcaaattgcagaaaggagaatgcagctatgttatacagtgagaaggtcatggaccatttccgccacccccgcaacgtgggcatcctggaacacccagacggcgtgggcgaggtcggcaacgccaaatgcggcgatattatgaaaatctacctgaaaattgaccaggacacggtctctgacgtgaagtttgaaacctttggctgcggcagcgccattgcctccagttccatggccacggagatgattaagggcaagtccctggatgaggtgatggacctcaccaacaaggcggtggcggaggccctggacggactgcccgcccataaactccactgctccgtactggcggaggaggcggtcaaggccgctttgaaggactactacgacagacacaacatcgcttacgatcccaaacagttttcttccattgactgtgaagggtgtcattaacccccaaaccctctctttcctccgcaggggcccggcacgtcttgtgccgggcccctgcctctctatccctctctcaagcaaaggcccccggcgcggtgtgcagacgcgccgggggctctccccttgttttactgggcggtatagcgggccatgccctcctggtccagggcgcgtacaacggccccctcctccgccaggtattccaaatgggccagggcctctcccgtggcgaaccacttctgattcaggggaaagtccgcccagctgtcggcccggatatcccaggtcatgcggctggccacctggtaggcgttcagtcccccctcccgccggacaatggccagcgtctccgccgcccgccgccggtggtgggccagaagggcctgaatccggggggccaaatccgccgtgtgccggtggccggggagggccagccgggccggataggtcccgatgcgggttaagctctccaggtagcggcccagggcgttgggcagattgggccacatggtgatgttgggggtgatgtcaaagagaacatggtccgcggtgaagaggacctgctggtttgccatccacaggcagatctgacccggggtatggccgggggcagcgatgacctccagggtatattcccccacggtgagcctgtccccgtcctccaggggctggtaattgggcaggtccaggtccggacccagggtccgggccgggttggtgccggtggtgatccgcagctcctccgggggaaagccctcctggagaaaccgctggtcaatgcggccccagtattcctcctcccaggcccggctggtgaagggatagtccccccgcccgatatagatggcgccccctgggcgcaccacctccgaggccagcccggtgtggtcggtgtgaatgtgggtgagcagcacatccaggggatcgtgctccgccccggcggcacgcagccctgcctggagagcctggcggcacgcgggctcccggaagcccgtgtcaatgagcaggcttctctcccgcccccggatcaggtaggcattgagctcccgcagggggttgcggggcaggggaatgggcaggcgaaacagccccggcagcagctccagcaccctgtcgggcccatgcacatcccgcagctgctggacagcgtcggccctcatccctgcttccgggcctctcccaccagggcactggcgcccagacggtccgctcccagcgccagataggcttccccgtcggccagggtacggatgccgccggatgccttgagcttcacctgcttgggcaggttttcccgaagcagggccacatcctcccgggtggcgccgccggtggagaagccggtggaggtcttcagatagtcggccccctccttggccaccagctggcagagcttgattttctccatgtcgctgagcaggcaggtctcaatgatgaccttcagggggcggcccaggcaggcggccttgaccccggcgatctcctgggccaggtccttccagttccggtccttcacccagcccaggttaatgaccatgtcgatctcactggcgccgttttccaccgcgtccttggtctcaaaaattttggccgccatagtgttgtatccattggggaaaccgatgacggtgcagatcttcaaatttccctggacatactccgccgcccgcttaacataggacggcgggatacacactgtggcgcagccaaactccatggcctcgtcacagagggtcttgatctggtcccatgtggcctcgggcttgagcagggtatggtccacgtggctgagaatggttgcagtctccataatcaattactcctttgtctgatttcctgatttgggttcatcatatcctatttttctcccgttctcaagggtctccggcgaaaaaatcaccgcatggacagactgttgttgagcaggagggtgctgtacagaaagaggacgtcctggtcctcaaagtcgatatattggtccaactggtcgctggataggtaccgcaggtccaccagggtgatggtccggtagcctgaggccagcagaggggccaggctgctcccgtaggaatcccggaagaggatgaggtttttgtccatgggagcctggagattcttcacggtgacaagccccttggagccggacaggaagagcacataggggtagttcaaatgccctgaggccacctcatagacctttttccgctggggcctgccgccctggtcatagaccgccaccagacactggtccagggtggggctggtgagataatacaggtcctcccaggccatggtcagacccatctgaatggcgtaccgcccggtaaagggccgggccaggcgctggacgtgataggcctcgggcccgtcaatctccgcccccatggctccggccagacgctgggccacgtccaaaatcttctcctgccgccaatggctgtcggtgttgtagtaatcctccagggacagcaggtcggtaatgtccacatactccatgggcggggtgtgcgcccgcatgtactggaacagttccccatagtccaggctgggatagccgtattcttccgccagataggcgttctttcccggaatcatagacaggtaacaggtgacatccgtgccggccaagtaggtatcgtatacccactggatcttcttggccgcgtggtccagcatctccggacgcagggggtactccatctgggccaggtaggtccccgcctggtacaaatggtccaggtccttttgccccaacagcttcagggcactcagccccttcactgtgcggaagctgtcccgcagggggaactgatcctgggtgtgttgggcaaagtccccggcaaaggacccgtcggccaggtcctcccacttggggtccaggtaccaggccagtccccgctcctcggtctccgaatagtgcttcggaggctgcacccaggcccacaccgaaagggtcaccagcagtcctcccaccaccagcaccaccgcgccctcccggcagcgaagacggggcagcgcccgtcccagccggcggaaggggcgggccagatgcccccggggatcggcccgccaggcttgccaggcccgggcaagtcccgcccttccccggctgatccggccaggcaggtcccaggctgtccacagccgggcgccccaggttcggatggaatttttccggttcgcacgcatgctctcccccctcaataccaaaacggctggacgccgccatccaccagatagcccgtggagatcacaagcagggccgccagcaccagcggttccgccaccgccaccaccttgcccgtccaggtcccccgacggaggcgggccatccaacggctgggccagggggtggcccccagggcggccagcagcagggtggggccatagcttctcagggcataccaccccgcggtccccattccccccggttccccctggcccagcaggccgccccacagcgccaggctctggcccaggtcctccccagtcaggagaaccgccccaaagcccagaacggccagcacaaacaggtggcccaaagggggaaaccggttcagccagccccccaggcccaggcgctccgccgccagcagcaggccaaagagcaggccccagaggagaaaattccaccctgccccgtgccacaggcccaccaggagccacaccagcagcaggcagccggtccgttttcccccggccgcccggaccagcggccggtacagatgatcccgaaaccaccagcccaaggtgatgtgccaccgccgccagaaatcggtcagcgtcctggcggccaggggccagcggaaattctccgccaggtcaaagcccagcagctttcccacccccagggccatgtcggtgtacccggagaagtcaaagtacagggccagcaccagcgccagggcatagagccagcagaaggccagggtccgctcctgcccttcctggaaactctggcagaggccccacagcgtctgggccagaatgcactttttccccaggcccaccaccagccgccgcaggccctccgcccctttggttaacgtgcaggtccggcggtccagctgtgcggccaaggaagcatagggcatcatggggccggccagcacccagggaaatcccatgagatacagtgccacggagaggccccccttccggggggatacggtcccccgccagacccccagaacataggccgcgccctgcaaggtgtaaaagccaatgcccaccgggcaaaccagcttcaccaggggtaccggtagcccggtggccgcccgaaattcctcccagaaaaagcccaggtaacgaaagacaaacagcagccccaaactcacccccagggagaggatcagaatccgtttggccgccggccggccccgcatcctctggatcagccagccgcacaccccgctgttgaccgcgcaggccgtcaacaagagcaaaaaaaggccctccacccagccataaaacaccaggctggctgccaggaggaccccattgcgccccttggagggcaccaaaaaatacaccgcaaggacaacgggcagaaagtaatataggaatggcagactggcaaaggacaaacttctcacccaactttcccccgccggcgggcacaggcccaagccggcggggtgagatgccgggcccccctgccgcggcgccaaaggcagcgtacaggggagcccctccggcgcacaggccggttattcctccatagactggggacacatcaggaagaagacgatgtccccctcctgctggaccaccgtctcatcggcctcggtgcagatattccaccgggggtccgcggcgtcgcggagggtctgtacgaagtcctgcccgctggtctgctcctccagccggaagaggtaacccacaaagggaatggtgctgatgacaggcgcaaacatcaccccctgggaaaagccctggatcgtctcgttgccaaagcccatgagcaggccgggctccaccggggtgacagcgccctgaaattccaagtcttcctggtccagcaggccctgggccagggtctccaggtccgcctgagggctgtctttgacacgggtctgaaagtcctgcagcagcgcctgtcccagcgtggctggcgcctgcggcgcttcctggccgcaggcgaccagggagagcaggagaagaacggcaagcaggagggatgcaacggatttcatacacagtattcctttctgatccgcgccgccccggctaaaatgttctcagccaagacagcgccgtagtagagtgattatagcatagatccagccgacgcgctaccctctcccctcatttcgcaagttttgtgtcgtcccggcgggttttcgggctgatttgcaggatttcgtgctattcccttcaaaatttttcctgaaagcaaagataaaaaagacataaagaactttttccccgttccctccctgcccggcctgtgctatgatactgcattggtctgagccgtcgggctttgacccggattctgacaaaaggaggacccccatgcccagagaaaataagagaaagaaaccttccctgaccgtgcaaatcaccatcagcctcatcatcggcattgtggccggcatcgccatgcagtcgatcccagacatcgccgaaggttacgtcaagcccttcggcaccatttacctgaacctgatcaagatgatcgtggtgcccgtggtggtcctgtccatcatccaaggcatcgtctccctgcaagatgtccgcaaggtggggtctatcgggatcaagaccatcgccttctatctagtcaccaccgccattgccgtcaccctgggcctggtggctgccaacctgctccaggtgggcgcagggtacaccctgggcacggaagccctcacctatgaaccggcagagcccttaaacctgatggacaccctggtgaacatcttcccctccaacgccttccagcccctggccgacgccaccatgctccaggtcatcgtcatcgcactgttctttggctttggcatcatcgcggtaggggaaaagggggtgcccgccaagaatgtggtggacagcttcgcggaggtctgctttaagattatgtccatgatcctcaagctctcccccatcggcgtgttcgccttgatctgccccgtggtggctgccaacggccccagtgtgctgctgcctctgctgaaggtcattctggtggcctacgtagcctacgtggcccacatggtgctcacctattccctggcggtgaagggcttcgccggtctgagccccctgcggtttttccgggctatgagcgagcccatgctctttgccttctccagcgccagcagcgtgggcacgcttcctttcaacatggatgccacccaacagctgggggcacggaaggagatctccagctttgtgctccccctaggcgccaccatcaacatggacggtaccgccatttatcagggggtctgcgccatcttcatcgcccagattttcggcattgagctgaccattgcccagcagttaaccatcattctcaccgccaccctggcctccattggcaccgccggggtgcccggctcggggatgattatgctcaccatggtgctggaaaccgtgggcctgccggtggagggcatcgccctggtggccggcattgaccggattctggacatggggcgcaccaccgtgaacatcaccggcgacgccacctgcaccattgtggtggacgcctgggaaaagcgacgggaacgaaaaaaaatggcggccaatcttgccgcgaaataaaccccgtttttgcacgccgcccccacgcctgttttggcgtgggggcggcgttttaattgtgttcacctgtcttatctcattcatattgggaccagtcgggggtctcccgcagctgggtccaggtctcatagatgcctgtggtgcgttcatagtcgtggctgttggtggcctcctggatggccaggtagtaccactggctggggtcctggttgtccggccaggtaaccatgtccttcagcagatcctccgggctctggggattgcgctggaggacacggttgatcatggtcaccgcttcagcccgggtgatggccttgtccggccggaaggtgttgtcctcatagcccataatccagcccagggacaccgcccgttccacttcctccttggcccagtggcccaccagatcggggaaggtggcgccgcccgcgttttccccggtgtcaaaccgggcacagatggccgcgaattccgcccgggtgataggggcattggggacgaaggtatccggggtccggcccttcaagatgcccagctccgccatggtggagatggccgtgttgtaccagtcaccggcgccaacgtcagcaaagacgttgtcagtggtcaggttctcctggcgcacctggtcctggagcagccggaagaagatagtggccacttcggcccggctgatgttcccgtcgggccgcactgtgccgtcctcatagcccaccacataagcatagtggtcctctccattgagcatgccggggacatccgtctcttcccaaccggcgtagacggttttgttcgaggtcatcttgatctccgtgatggcctgggtcagttccttatcggcataccagccggtgaaggtatacccctcccgggtgggcaccttgtccagttggaccacggtgttgcgccggtaccgctcgctgtcgtactgggtgccgccgttggagtcgtaggtcagggtataatacgtgggccggctggggccgctgccgccggtgtctttctcatagaccagggcaaagggagagaatgcctccgtctcaaatttgatatactgctgatttccaatggatattggcttcagattttcatacagctctggcggattcgcttgtaaaagcccatcaatctcctccgtcgtcccgtagtttcgatccagggcatcaaagtgcacaatatagaaaggttccgccgtgtcggcatccgccggcaccggccagtaaagggtcattttctgcccttcccccatggtgaccacggcgttgccgttgctggtgtccaccaggtccaggtactgaacggcaaacaggtacgctccggctggaatgtcctccatgccggcaatatagtcggtcagtacctgggtgtccagcacatcatcgaccagcagtttaacattctctttgtctgtaatctctacttgactgtcgttgacatagtaggtgacatccgccggtgccatcgcggtcacctcgttgccgtagacctctgactcctcagatacaatctctgtggaagcaggctcctccgtggtaccccggacggtaagggtgccagtctttaactgaatgggataagagcaagcctccatcccctctattcccgagaagttagcctgaacatgcccctgatccagctgattgagatacagtgccatggtatactctgtattcaggcagtcttcgtcaaacacaaattcatcgctgacaacttcttgcccctcatcattggtaaaagtaagacgcacggggtcctggctttctgcgggaaccatgcggtagacatagcgggcaatgccgtccaccgggtccaatgtactggaaccatcgggagtatacggctgtatcgaccatgttcttgttgtcccctgaccatcgttataagtaaacgtcaaatacttcgaaaggtccactgcatttgcttttccttccagcgccgcattgatctcgtccggcacggtaaacaggaagccaggttccggcagaccctcactgttggtggtttccccactgtctatatcacctaccacgctctcataaccgtctccgcccatataaactgtaatatccgctggctggatgatcaccggctccgttttgtcaacaaaccattcattctggattcctcccccagaagctgtacggctatcggtaaaatagccttctgctttcccagtttcagaaaccgcaaagggcgtttgtcctgaatattcggacatgctccgaagaaacacgtctccttttacataggccgcatctttcgccccattgtcttctgtggacacatacgttgcaccttccgacacagcaacggtccccgttacaatgaaatacacggtatcacgctctgcactcaccggcttgggcattttcaatgtccctgccgtggtaaacgcccctgtgatctcattggtttgcaacaggtcgagggtgccgccctttgcaatggtaacagtccccacattgttaaacagggttttgggggtctgatgctcccgcaggcatcctccatcctggacgacaatctcagaaaaaccgacaatcccagtggatgtgtagtctcccttgacaatgactttggtctcaggaaccgtattttcggtattcccaatttcataattgtacagatattgtgtctgttctgcatttccgcgcactgcaccgtgcagttggtccgtgtcgtccagtgtgaccgttaccgatttaccttcggcaatttgtccgtcttcgcccagcgtgtatacatcggcacggctgccgttgagcgtgatggaaacgtcgccgccgatcttcgctttttcctcggcatcttttccttttcctgttgcaaaaatatctggacacgaagtgatggggccaccggttaatgtaatttctactgcaccgcttacattgccttcctcaccgccgccatgaatatctccgattacttctttgctatccaatatgtttatgctcacatttccgtttacattagcctcgttaccgccaccccaaacagtatctgaagcgatcgtgctgtctttcatttgaatggtaacatttccttccactgttgctccatcataacctccgccatagagagccgcagcattgttggtcatgtcaatattttgggcaataatcgcaacttcgcccactggagctgtctctccacatccaccgccataaatcgggcggccaaacccgttattcaatgcagagagatctattgatactttccccgttactgctgcgctctttttgttgggatatccaacctctcctccaccgtatatggcattatctgttacagagttagcaaattttaagttaacatttcccgtaacagtggcatctttgtcttttgcatatccgccgccgcggacatgttgtactttaccgcagttttggatggtcaggttaacatctccagtgaccgttccattatagcctccgccatagactctggttaccggaacagaagcattgatggtgacggatgtccctgtggtaatgtcttcattaaggccaccacctataatataacaaccggatgcctcctcctggcgctcagtatcgggattatattctgcattcgcattgtagagtatctcaaccttctcccctatcatcagcggatttccgttggctacaataacataattgccaatgtatggactggatgaggttataccttcctcctcataatacacatcaaagctcactccatcaatcgaaagcgggccgctcaaattgatatttggtgtaccctcagatatcgcatgataatggaatttcagaactgcgtcctcgtccttccctaccaactcggtctctaccgtggggcttgtccatgtatcaacactgacaatcccaacaaccacaatttgaacaggtcctcctttgtcgtttgctatctctgttgcatgatccagcgttgttgcgttttcctcactggttccgtccttatcattacttcctgattctgagacataaagtacgcttggctctgcacttcccagcggttttcctaccgccaaagcatacggcgccagagacagcacaaagcacagtgccaacagcgccgcggtccatcgcttcttcatcttcgtttcctcctttgtcttcccggcaaatcttcctttctcccggggctgtcaaaaggtgtaccttttgatagcatgcaaaatacaaaggaaatgacaggtctttttaggcgaatattccgaattttccaacaaaattcttgcatctttcgatgttttattgtaaactattgcatataaaaacagctatcaaaaggtacaccttttgatagctgctgtcctttccagcataaaaaaagaagccgcttctggtagctactcataaaacagtatcaaccaacaaattgaaatagggtagctgccatacagggtgcagaaaagagcgagtaagaaatgaagcgtttcttgcccgcttttttcatgctccttgttacgcaataggggttgaaaaagccttgatataagcggctttgcgggtgcgttttccgcgtggcaagggttttataccttttttctcaaaaacgcctttctactgcgtaacaaatctgtggtaattatctgaggaagcatagaccacatatctcggttttcccgttgttggattatccaatattggattttccgacatcggaaaatccaacgcaattaaataaagatatactaactaaagaaaaaccaaatacagatttaatcaaatacctattcctatcctttcctttccctaatccctctcctttggggcaaggtatagcggcagagccgccggaacggaaaagaatggaacagaagcgacaatacaaaatatcgtttgccatgttacgcagtagaacgccatttttaagggtgggagtataaaacctttacccttgcccctatcgtcgctgtaacgcgcttaaatcaagcgagaaacgcaccctatcgcataacattccatactggattgagagcgcaagcggtctatccgattgcgctctcttggttgcccaacagcaaagacggaaacagtcgtcaaggacgcttgcgcaaagtttatccttgacgactgtttttgactttgctatctgttacctgtcaaatcggaattgcaggatagctttgataagctgtgcttttaagcggtcttgaatatcgtcgttgatatgtccacgataggtagacaaatattttatacgcccctcgtagtgccgcaatactgcggctatcgcttccggctctccggcaacagctttttcaatggtttcaaagggtatcagcttcttattcctcatgtttcgttttctccaattcttttcttaactgtttcaatgccgccaacttccaatagtttactgtgcttctgctccgtccgtactcattcccgatttttctttcgctgtaaccaaggaagaaattcatcagcagaacagtacgcctttgttctgacagattagctaatgcgtcggctaaccgtctacttgtaacgacaacttcttttccttgcacgacaaaaacagtcggcttctcataaacatactgctcaaagtagttgtcggttgcaaatggttcaaaagacgtttctgacatcagatagtcaagcgacacttcatgcttctgttttcgtcccaaatcgcggtacgcgttgattgccgcgttacggagaacgactttacagaacgcggcaaaggcatattcgatatgctccataaattgttcggaatacctcattttctcatcaccccctttctttccagtagggggctattacaacaaacgcccatgcaggcgtaaaaccgcatgggcgtttggtaatatgagttatttaagcaattatgatgatttgtgtattcatctctatggttgcaaaagaccgttgcatggaataggctttttttaataatggaatagaattaaaaatgtgaaaaagaaacatggcaatatctcccgacaccgccatgtctataaaaataattgtgtatttgccgctattccattttatatacaggaaatggcggtttgttttcctatcacaaaacagaaagagccaataatcataagatttatttcttgtgattatcggctctgcgtcaatgcgtctggctctgtgataactgaaatattcaaattttttacattgataagattttcctgcttgcacttcggacagtataggggaaaattctttatttctgtatcttcccgtatccttaatcgggttttattattgcatacaggacataaaatccatttttcttgttgcaatgcaccacctcatttctaatcaaactacctttaatgataatcagaaacagagtgctgaaaaatcacttgttcccccaaaatggtaattgctttcttgctacattgatttacacaccgatagcataacgtacaccgtccgtctgctatcatcttatcttctgataatgacaaattgttcataggacacaccactgcacatttcccgcactttatacaagcgttggtatctatctgtattttgtctgaatattcttgtgttttacggtaaaaccaaagccgctgtcccaaaagccctgcaatatggcataaaaatcccaaaccgtctttagttggagtaccatttttcaaattgtacaccgctgattttatgcgttcttccgcttgtatgacaatttgcttattttgagccggagtacgctttaaggcttttacatcacaaatacaatccggcattttcaaatgaagtccaccccatacctgtgcgccgtatctctcgaacaatcttgcagatacgcctgcaccatcgccgctaaacagtcccattgttgcaataatgaaaatacgttttcctttccatacatcagaattttcgcagataaaatcccgtacaattttaggtaagttactgtaatagattggataagcaaaaatgatgtctttatgatatgtaactttttccattgtacctgtatcttctaacggggttatgtcaatgttcctgtcatatagagcaacaaacttttctaaacaatattttgtatttcctgttccgctaaaataaatcccaatcatattttttctcccgtattatctaaaaaggaaagttgaaaaacgtccataaaatcaatgactttctctctccagtcattatcataatttacattattcatggtggctaatgaagtaataccatgtataaaagcccaaatggttatgataatatcattttgctttccttctgaatagtgcgtctgctctaataattcacttacaacatttttatatatgatataaggtttatagttttggtcatctggtattgataatgataagtcaatttttatattggattgagaatataaaaattgaaaataagcagggttgtctacaaagaaagatacataggctattcccatatcttttaatatttctgcaacattattattcttttgaactgtactttctaattgtttagaaaatctatctgtgataaataattgcattgcttcaagaagttcctctttattttgaaaatggctataaggggcagcatggctgacaccacacgccgcagctacctttctcaaagaaaaagcatttactccctctgtatttacaatctgaatacctgtttcaatcaatgcgtttcgcaagtccttgtgatgataagtctgtcgttgctgttccatgctaattcctccaatctttacactgtctatattataaggtttaaactttacggtgtcaagtttgagggggattttaagttgtgatacttgaaattatttttccataaacggttatttatttggcatttcaaaaacttttccgtaataagagataagaaaaactttttgaaaaattttcgcttaaactttggcacaatcgccttgcgcggtgtagtaggtagtgaaaggaatttcagagggtttgggatacttcccaacaagcaaaatgcggtgccttttacggaaagggtacccttttcctatgcttgctacgaaacttatcacattacaaatcaaagaaaggacggaaaggaatggaacggaaacacaaaatcaaggacgggcatatcgtagtagaaaatccgctgtttcaagagttgcctacgcatgaggtaacgataaaatccggcaggacgctctatcggtttacggggagttatgacggagaaaggagcctgccccacaaggttttacgcctcatggagcaggaaaaggacaaaaaagatgttgattaaaaatacaggagccgatacaataaagacaagcaatcctgtattggcagactgcccgccgacgaaaggagcagaaactatgttaaggcagtctgacaaaattaccgccctctattgccgcttatcgcgcgacgacgaattacagggcgacagcaacagcattgttaatcaaaaggcaattttaagtaaatacgcaaaagaaaatcatttctcaaatatttcgtttttcgtggacgacgggtattctggaacaaatttcaaccgtccgagttggagcgaacttttggaacggattgaaaacggagaagtggcgacgctgattgtcaaagatatgtcgcggctcggacgtgattatctgaaagtgggattttataccgaagttctgttcgttgaaaagagagtgcgatttatagctatcaacaatggcatagacagcgcaaaccaacaggacagcgactttaccccctttttgaacatcatcaacgagtggtatgcaaaggacacaagcaagaaaatccgcgctgtgatgaagtcaaaaggagaagcgggcgaacatctctgcacaaatccgccatatggttacatgaaagacccggataacagaaaacattggattgtggacggagaagccgccgaagtagtcaagcggatattcgccctttgtttggacggttacggaccgtcgcagattgctcgtattctgaaagaggataaagtcataacgccgacaatccattttcagcagacaggcagggcaacgaggaacacgccgccggacaagccctataactggacgggcgataccatagctgatattttggagcgtccagaatatcaagggcatacggtaaacttcaaaacctataagcagtcctacaagaacaaaaaaacctgttacaatccagaggaaaaatggcttgtgtttgagaacacccacgaagcaatcattgacgctgacacatgggcgcgggtacaggaattacgcaagaacaaacgccgcccgacaaggacaggtaagacgaatatgttttccggcattgtgcgctgtgccgactgcggcgaaaagctgtattactgcacaagcaagaactttgaagcgcggcaagaccatttcgtttgttccacttcaaggctcaaaggaaaagaaatttgctcaacacattttatccgcgcggtcgtactggaacaggacgtgcttgctcacatgagattgacgattgcctgtgtcgctaaccatgaagaacaattccgtaaagcgatgggcgcaaagcagaaagccgaagcgaaaaaggaattggcggcgaagcggcggcaactgacgcaaggagaacgacggatagaagaacttgaccgattattcaagcgtatttatgaggataacgccaacgggaaattatctgacagcagatttcaaatgctctccgatgattacgaacaggagcaggaagaactgcggaaaaagctgttgcgattgaacgaagaaattaccaaacaggaagaacaatccgagaacattgacaggttcatcagcaaagtacggaaatatcttgacttggacgagttgacgcccgctgtactgaatgacatggtaaaggcggtgtatgttcacgcgccagataagtcaaaggggcatagggaacagcagattgacatttcctatgaccttgtgggaatactccccgcgtctttactgaatgacctgcaaaacggagaaacggcatagcccacaagctacgccgtttcccaaaaacatttctaatactgtcttatgagtgccgctcttccgcggcttcttttttgttccaatccttagtaattctctgccttcacctcaaagaacgcctggggatggctgcacacaggacatacgtcaggcgctttgtcgccatactccagatgaccgcagttgcggcagtaccagaccttcacggaggacttcttgaagacctcgtcgttctccaagttctccaccagcttcaggtaacgttcatagtgggacttctcaatctcacccacagcggcgaacatatccgcgatgcggtggaagccctcctcccgggcctcctcggccatgcgcttgtacatggaggtccactcctcatgctcgccctcggcggcggccatcaggttctccgcggtggtgccgatgccgcccagttccttgaaccagagcttggcatgctccttctcattgccggcggtctcctcgaagaatgcggcgatctgctcaaagccgtccttccgggcctggctggcataataagtatacttgttccgggcctggctctcgccggcaaatgcctcccacaggttggcttcggtcttgctgcctttcagttccataataaagctcctttcaaaaaatgaatgtgaatctatgtttgatgacttctactcgttcggaacaggaggaatcctgtgtctttaggatactcgattccgagcgtctatacagtgactttaacacattctgtcaaaaaagataagtggtaattttggtttttttatgatttattaaaaattttattttggcacatactactcccacggccttgcgccgtaattttacgaaatgaagcaacggagggaaggtatggttcgcaaactgatgaccgccgctctcatcctcaccctcggcctggcgctcaccgcctgcggcaatgaaaccgccggcacggcggccaaccgctggactggcaccaacgccgcttcccaggagtgggccatccagcggcagagcgacgccagaggtcccctggaggaccggggcaacggggcttaccacgcggacgagaccggccgtgtggacggctaccacactgacagcgccgacggcacccggggcagcgccaaagaggacatgaaggacgccgggaagaacctgggcaacgccgccaaagacgcggccaaaggggccggcaacgcagtaaaggacgccgccaagggcgccggcgatgccgccaaggacgtgggcgaagcggccaaagacgcggcgcggggcgtaggagacgcagcggaggacaccctggatggcatgaccaacgccgccaaggacaccgcaaaaagcgccaaagacgcctccaaataaccccgtggaaaaaacagaggtggctgggccacctctgtttttttatccgccgatcaaaaagtccagcacgttccagcctgtggaggtctggttccgataaatctccgtatagccgcagttggtgcagctgatggtgataaattttttattttgcacgtcaaaaattttggcaaaatttccgccggtggcctgaaactgatcggtctcatagctggtattgccacatttggggcactgatacatctgttgttccatgtgggcttccccctttctgtttttcttattttaccccaaggacttcccctgcgcaagggcttgcagtcagatcatttcctatgctatactaaaagaatcgaaattgtgtgtttttcctgttttttggcttttcaaaggggggagctcgtatggaattcattatcatctccggcttatccggggcgggcaaaagctccgccgccgcctttttggaggacttgggcttttactgcgtggacaatatgcctgtggccctcatcaccaacttcgccggcctgtgcatggccggggcgggcaccggcaaatacggccgggtggccctggtcaccgacatccgcgggggccagacctttgacgagctctttcaggccctggacggcctgcaggagatgcacctggactatcagcttctcttcatcgaggccgccgacgaggacattgtccgccggtacaaggagacccgccacacccaccccctcacccgccagggctactccctgccggaggcggtgaagctggagcgcctggcgctggagcccgtccggcggcgggccagccacattctcaactccaccgggctcaacctgtccaaattccggggggagctgctccgcctgttcggcatgggggcgctggaggagagcatgacggtctccgtcacctccttcggcttcaagtacggcattcccatcgacgccgacttggtcttcgatgtgcgtttcctgcccaacccctattatattgccgagctgaaggaatgcactgggctggaagaggcggtgcgggccttcctctttggctaccggcagaccacggagtttatgcggcatctggaagagctcttcgctttcctgctgccccagtacgtggaggaggggaagtcctccctggtcatcgccgtgggctgcaccgggggacaccaccgctcggtggccgttgcccacgccttgacggagttcatccggcagaagggatatcgggtggaggaaacccaccgggacatcagccgataggaccctttggttccgctgtgcgcgcccctttggggcgtctgtttgggaggtggtcgtttatgtcttttgcgggagaggtgaaagcggagctgtgccggggaaagctgggccggaagtgctgcgcccaggcggaggcctgcggggtgctgctgtactgcaaccggttttccctgtccgaggtgaagatcgtcacagagtccccggcctttgcccagcggctgcctgggctgttccgaaaggctttcggggtggagtttgatgaaaaaggggacccggacacccccgggaagcggattttcaccatttccgccccggagaagctggccctgctgtgggagctgtgcgcctttgaccccagcggcccggcccaccatatcaacttcggcatgctggaggaaacccactgccggctggccttcctgcggggagcctttctggccggcggctccgtgaccgatccccagaaggggtatcacctggagctggccaccacccacctccgggtgagccgggagctggacaccctgctgctggagctgggctacgcccccaaggagaccacccggaaggccaactatatcacctattttaagcagagcgaggccattgaggacctcctcaccgccattggggccccggtgtccgccatggagctgatgaacgccaaggcggaaaagctcctgcgcaacggggtcaaccgccgggtcaactgtgaggccgccaatgtggacaagaccgtggacgccgccctggagcagcgccgggccatccagattctgcgggaccggggggccctggagaccctctcccccaagcttcgggaggccgcccagcttcgggaggcccaccctgagctctccctggcccagctggccgccctgtgcgagccccctgtgaccaagtcctctctgagccaccggctgcggaagctcatccagctcagcgcccaggacaccgccccctgagccccctgtgacaggtctcggagtccgtctgtctgttttttcatgttctatcctgacaagagaaagaaaaggagtctatcttctatgaaccgttacgaacaagctgtcgcatatcatcacaaaggatttaactgctgccagtctgtgctggccgcctattccgatctcaccggcctgtcccagcaggccagcttcgacatggggggcgggtttggcgccggcgcccagaccggggagctgtgcggggccatcaccggcgccattctcacccttggcatgctcaccccggtggacccccaggaccctgtgggcagcaagcgccgcaccggcgccctggccaaggaattccagaagcgcttccaggagaagttcggggacctgcgatgcaagcccctgctgaaggccgggatccaggccaccgacgccacccccgtggcccgggatatggccctcaccaaccgctgcgacgtgctcatcatcaccgccatggagatcgtggaggagatgcgaggggagaatgcttaaacccagggagggattgccgtgtcttttgtccatctgcatgttcactcggaatacagcctgttagacggcgcctgccggattgacggcctggtggcccgggccaaggccctggggcagaccgccgtggccgtcaccgaccacggggtcatgtacggggcggtggatttttaccgggcagccaagcaggagggcatcaagcccatcatcggctgcgaggtctatgtggccccccggacccgcttcgaccgggtccatgaggtggacgaccgcccctatcacctggtcctcttgtgccggaacgagcaggggtaccggaacctctccgccctggtcagccggagcttcacggagggtttttacggcaagccccgggtggactgggagctgctcacccggtaccacgaggggatcatcgccctgtccgcctgcctggccggtcagctcccccggctgctgctggccggggactacgccggggccaaggcccacgccctggccatgcgggacctgtttggcccggacaactactatctggaactgcaggaccacggcatcccccagcaaaagcaggtcctccagggcctggtcgccctccaccaggagacgggcatccccctggtggccaccaacgacgcccactacctcacccggcaggacgccgccatccaggacgtcctcatgtgcatccagatgggcaagacggtggaggaccccaaccggatgcggtttgaaacccaggagttttacctgaaatccgagcaggagatggccgccctctttcccgactggcccgaggccctggaaaacaccgccaaaatcgcggcggattgcaacgtggactttcagttcggggtctatcacctgccagaattcaagcttcccccgggctacaccgacggggacgcctactttgagaccctctgccgccagggctttgcccggcgctatccccagggcagcgaggaatatgaaaaacagctggcctacgagatggacatgatccggcagatgggctttgtggagtatttcctcattgtctccgacttcatcggctacgccaagtcccacgacattcccgtggggccgggccggggctccgccgccgggtccatggtggcctactgcctggacatcaccgacgtggaccccatgaagtactccctgtactttgagcggttcctgaacccggaacgggtctccatgcccgacatcgacgtggacttctgctaccgccgccggggcgaggtcatcgactatgtcaaccaaaaatacggggccgaccacgtggctcaaatcgtcaccttcggcaccatggccgccaagggggccatccgggacgtgggccgggccctgaacgtcccctacgccgaggtggacgccatcgccaagcaagtgcccaactccctgcacatgaccctggcctccgccctgtccctgtccaagcccctgcgggagatgtacgagagtgaccccaccgtacaaaagatcatcgacaccgccaaaggcctggagggcatgccccgccacgcctccacccacgccgccggggtggtcatcacccgcaacccggtggacacctacgttcccctggccaaaaacgacgaggccgtggttacccagtacaccatgaccaccctggaggagctgggactgctgaagatggacttcctggccctgcgcaacctcaccgtcctggacgacgcggtgcagatggtccgcagccatacccccgactttgacctgcacgccattcccgacgacgacccggagaccttccaaatgctctccgacggccggacctgcggcgtcttccagatggaatcggcggggatgaccggggtgtgcgtggggctgcggcccaaggacattgaggacatcaccgccatcatcgccctctaccggccgggccccatggaatccatcccccggttcatctcctccaagcacaacccggacagcgtctcctataagcacccctccctggttcccattctctccaacacctacggctgcatcgtctaccaggagcaggtcattgaaatcttccgccggctggcggggtactccctgggacaggccgacatggtccgccgggccatgtccaaaaagaagatgaaagacatccagcgggagcgggaggccttcctccacggggacccggaccggggaatcaccggctgcacggcaaacggcatcccccaggacgtggcggagagcatctacgacgagatcaccgatttcgccaactacgccttcaacaaggcccacgcggtctgctacgccattgtggcctaccaaaccgcctggtttaagtgccattacccccgggagtacatggccgccctgctcacctcggtgctggactcccagggaaagatcgcggaatacatcgccgagtgccgaagcctgggcatccgcctgctccccccggacatcaaccagtccggtcccgacttcactgtggccgggcgggacatccgctttggcctggccgccctgaagggggtgggtcggggcttcaccaacgcggttttggcccggcgccaggcagatggcccgtttacctccttcccggatttctgccagcggctgctggacgaggacctgaacaagcgggtgctggaaagcctcatccgggcaggggcctttgacgccatgggcgtgcggcggtcccagctgctggacgcctatgagcagctcatcgacagcctcacccggaaccgccggaaaaacctggagggacagtttgacctcttctccctggggcaggaaaagccggaacccgtggagctggtcctccgggacctgccggagttctcccaagaggagctgatgaccatggaaaaggaggtcaccggtctctacctttccggccaccccatggacgcctatcgggatacggttcgggcccagggagcggtccccatcgcctcggtgctggaggacttcgcccaggaggagggccccacccagttccaggacggccagcgcatcctcctggccggggtggtggccgcggccaagaccaagaccaccaagaacaactccctcatggcctatgtgaccctggaggacgacaccggctccctggagctgctggtcttctcccgggtgctggaggagagcggcagctacctccaggtcaacctgcccatcctgacagagggcagaatctccgtccgggacgagaaagccccccagctcatgtgtgaccgggtcacccccctcagccaggtcccggaaccggccggcgctgccgctcccctctccgggaagctctatctgcgctttgcccggagcgacgatcccctgctcacccgggtacgcaacctctttgtcctcttccccggccagcagaccgccgtgctctatctgtccgactccaagcgccggctgggggcccggtgcctgctccaccccgccctgctccaggagctgaaagagctgctgggggaggaaaatgtggtgctccaatgaccctccgccctctccataagaaaggcctaccatccctatgaaacgagtccagcaaaaagttcacagcgccttttccccccgccggcagcgcatgttcctcattgccgccggcattgccctgcagtttgccatctatgtggtgctgctggtcctcttttcccagtatttcgtctacttctactggatctgcgtgctggtcagcttggtgatggcactgttcatctccacctggaaatccaagctggcctataaaattgcctggatcatccccatcctcctggtccccctgatcggcggggtcatgttcattatcttgggcggcgcccgcgacccccactaccaccgggaggagacccggcggaccctcaagcgccagctgccctcccggctgtccaccacggacctgatgcggtatgggcccgacgccatgcagcaggcctggtacctggggcacgccgccctgtgcccggcctacaccaacacggagaccgcgtatttttcctccggcgcgtcctttttccccaactttctggaggagctggaacaggcgaaagactatatctttctggaatacttcatcatcgccgaggggtccatgtggtcggacgtcctggacatcctcacccgcaaagccgcccagggcgtggatgtccgggtgatctacgatggggtaggctccgccgccaccctgcccatcaactacccggaccagctccacgcccggggcatcctctgccgggtgttccagcccctgctgccggtgctctccattcaccagaacaaccgggatcaccggaaaatctgcgtcattgacggggtgaccggctttgtcagcggcctgaacatggccgacgaatacattgaccggaaggaacgcttcggctactggaaggacaacgccctccgcctccggggggaggcggtgtggagcctcacggtctttttcctgaccatgtgggaccaccagaatccccggtccgacttccggctcttccgtccccggaccttgcctcccctgaacaccaccggcggcatcgtggtcccctataccgacacccccaaccccgccgacaccgtctgcgccgacctccacctgcaaatgatcaccaaggccaagcggtacctctacctcaccaccccctacctggccattgacgagaccatcacttccgccctgtgcaccgccgcccggtccggggtggatgtgcgaatcatgcccccccatatccctgataagaaggtggtcttcgccgtgacccagtccaactaccccgtgctgttggaggcgggagcccgcatctatgaatttacccccggttttatccacagcaagaccgtggtggcagatgatctctacgcctcggtgggcagctgcaacctggactaccggagtttctatctccagtttgaaaacggcgtctggctctgcggcgaccccgccgtcctttcggtccgggacgactttctccagaccctggaggtctgccaggagatcaccctggcagactgccgcacccttcccctgttccgccggctgctccaatccatttaccggctgttcgcgccgctgttttaatggcaccatacagaaaccgcctggcagagcattgctctgtcaggcggtttttctctttttccactggtttttgtccaggctttctcctgtgatctcatccccgcacccgcagcctcaaagctgtgaggaagctgtcccggatggtcttgcccaggttcatcttgctctctccctccttgctgtcgtagtacagggtaaaggggacctcggcaaaggtacagccgcagcggtagagcttgtagagcagctccatcatgcaggcaaagctcttcttctccaccagcgcctgtccatagcgcgccacccctgcctggagggcggggcgggtatacacccggtagccgcaggtatagtccttcaccccagggacgtggaggaccaacgtgtagtagaggcgagcgccgtcgctgaagagctttcggctggcctggagcccctggacccgggcccccggctgataccgggaggcgatgacgcactgtttttcccgggtaattttcgccagcatcccgtggatgaaccggggcttatgggtgtcgtccccgtccatgaggcacatcaggtcccccgactgggacatctggaggaagtccccgatggcggtctttaccacaccccccaggttttggttgactgcgtgggcaatgacccggacccgcgcctgctcctgcgccagctggcgggcaatggccagcgtgtcatcggtgcttcggtcatccaccgggatcactgtcagctggtagcctgtccgggccagcgcctccgcctcggccagccactcctcggtcagccgccggaggtttcccgcctcgttgtagcagggcagatagacaaacaaggttggcatcctacgacccctttctcttgctctccagcttttggaaagcatatttccgcacaaaatacatcaggaagaagggccccacaatggatacccccttactcaccaaaaacgcccagcccttgggcaggaagggggagaccaggtgttcggtccacaggatcagcccgtcggcacacaccagccccatcaggaaggtggcaaaaaagatggcgaaggaggccgcgtcataccgggtctcaaacacctgccgggccgagagcacatagctgatgagaaacccggccactacgcccactgtgttggccaccaccagggacacccccgccaaatggtacaggcaccagacaatggccacatcaaacacggtggagatgatagaacaaaatagataacgaatgattttttcaaagcggtgccagatcgcctgcacccaacgcatcattgccgacgcctcactctccctgcagatcatagatcacgcagttggtcccggtggccgccacggggaactgctcccgcagataggtccggtaagccccgtcctcgtcattgtaaacccacccctggaccaccacgaaccagcgcacgccgtgttcgataaaataggtgacctccgcctccggcccggtgggaatgtagtcataataggcgatgtttgcccggtatccccggcggttggcggcgttcaggtaggacgggttgttcacgccgatggcaaccccctcgtcgggctgggtgtgcgcctggataaactgacccacctccgcaataatagggtccgcctgggtttgaggccacagggccaggtttccctgcaccgtcgtcaccgccaccgccgcgcaggccaccgccgccaggggaaggcggaggcgcgccaaagactggaccgccaccgcagagagggcgccgcacagcggcagcaggaacaccagataataggggaagcgaatcactgccacaatggtgacacactccagggcaaaggccagagcccacaccccataaaagtggagcttacgccgcacggcaaaaaacagccccacacagcccaaaatcaccgcgccccagccgaagcgggaggggagcgcctcccagaaaaactgctgcccctcggcggtaaagatggagagaatctccttgctgaaaatgtgcttgaggccaatgccatccacaaagcggaacaccgagtggtgggaggtatacaggatcagcgccaccggcggccccagggtgagcagcccgcagccgtagaacaccggagagcgcaggcaggccaggccccccagggaaaagagcacatacagaaacaccagccccacaaaggccaccggggtcttttccataatggccacggcggtcatggctgaggccccccacaggaaggccagccgcctggtctgctggaaacgccagagcagccacaccccgccacagtaaaaaaacagggcgcaggcctccggctggatcacgtgggcggtcatcatcgacaggggcaaaaaaaggtagatccccagccccaccagtgcaggccaccggccggagatccctcgcatcagccggtacaggaaccaggccgagcccaaaaagaacagcatacacagcagccggggcaccaccggggtcatggtgcctgtcagctgaaacaccagcgcggagagataggggacgatctgcagctccagctgggcgtagttttccgacaccccgtcatagttcagctgggggtggagcagatccataccgtactggacatagttgaccgcgatgctgtacgtgtccgactgacgccaggactcatactggtcccaggggacgctgtccagcttgggcagctggatggccaaaaacagggccagaagggccgccagaatcagggcctcccacagggggcgccggtccggctgggccgcgtgggtgggtttgtacacgtcgtcctccttcggggcacaccgccggcggaggcatgtccccgccgggcagcggcccgggtttttggccggagccaagctgccggctccactccatataatcgtagtataccaaattggggccaacattgccacaaaaagcccggaatttctttcttttcccgaaaaaacaccaaaaaataatggccgatccgacggaaacatccaagcagtgccgccgggttcgggcgtctgaatgcgtttccaccgcatttctcaacgccagaacaaggggccctccccctccccctccctttcccccgaatgacaacggaacagaaccaaaaaaccgaccggcagaggatactccgctggtcggttttcatcggttacagggccctgctgccgcaggggccggttattcctcctgattttccaacagggtttgcagaatgctctcatagagcttttccggctgggcccggaagttctccgccagctggccggcctgctcctcggacaccgtcagcatgtccagggtcataatattccccttgtcatcgtccaggatcagccgcagggtgaccccgctgtcctcccggggaaggatctccgcccgcacctgggcgtcccggcggaggacgccgttgacccgggccaggttccggtcacatttccgccggacggagaaggccaggctgctctcacagattttcccattgcgccggcccttctcggtgatggtatagcgttctccctccagctggaggtgtcccgtctccaccaactccgccaccgacgcggcaaagtcaaaatactccaccccgtcatcacaaaaggtcaggtccgccagcgtggcaaaatccaccggcgaggccacccgggccatcagatacaggatcaaaaacttgatgtccagtttgtcatggataaatccagtccggctcatgggctgtcactccttcccttccagggttatggattgttttattatagccagtttccccaaaaaggacaagccctttttccctccgtctcaagcagggacaccctccagacccatgggataatttgaaaaggtgtacgtttacaaattgccgaaataatctcttgccatttttataatagccgaaaaaatctcttttttcaaggcatttctcccccatttccatttcgattcttttgtttgcaaacgtacactttttgaaacaaaaggagaacacaacatgaaacgacggctgttgcccccctgcaccgccttggtgctgtgccttctgctggctcccgccgcgtgggccgctgtttacccctaccctcccattgaaaccctgcacatcggcagtcacgacgggacggaaatccaaaaagatacctattacctggtccgcggcgaaaccgtcaccactcagggtgccaacgcagacaactacaatatttattacaaggacgggacgctcaccctgcgcgcggcggcgctgccggattacctccttgtgcctggagagaccaccatccacttggtgggagaaaacaccattggcacgaaagactcccccaccgacgtgggcatccaaggcgtcacccccggggccatcaccatcactggcccaggctcctgctccattcacagcagcgcagaaggcatcatcacggtacaacccgacagcgccacagacccccaagtaacaagtgacatccgcctccagggcggcaccataaacaccaacgggtcctccatctccacccggtacggcggcatctgcatcacaggcagcgcccaggtgacgtccggctccctgtccacgggaggagaccccaacacggaggaagcccagcgggcaagagatctggtcatttccggccgcgcatccgtcactgcggaacgcctgtccgctttgcagcagattcagatcaccgggtccgccaccgtcaccgtggaaaatcccgccggcattgccataaacggcaaccgcgggattgccatttccgaccaggcccgcgtcaccgccatcggcaccaccggcggtctcaacgcattctccggcccaatcaccattgacagcaccggaaaaaccatcgcccaagccaccgataccacccgaaattatgcagccatctccatgggacagggagattctgccttgtctcttctgaccatccgcggggaaaccgccgtatccggcgctgtcggcatcggaagttcccaaggcagcatcctcattgacgccagcgcgctggagattaccgccacgtacgccggcatcataaacagtacctcctcttccgagaccaagatcaccgtacaaaacagcgcccaggtctccatcacctgctccggccccaagggcatctccgcttcctccggcacggtggagattgccgacagcacggtgacagttcaggccgcctcctctgcatacaccgccctgcccacattaacctatacagacagttatcaggtgacagccggcgcagaggccggcagcgccggcaaggttgaccgagacgacctgaccgccagcgtcttccaaaacccctatgtgcagatcatccccgtcaccaccatccctgtggaacaggtaatcctggatcagagcgcgctctccctcaccacaggcggcaccgcagcccttcaggcctctgttctcccggcggatgccaccgagccgcgcgtcacttggacctccagcgaccagacggttgccgtggtggaccaggccggtctggtcaccgcggtcgggccgggaaccgccaccatcaccgccagggcaggggaggcctccgccgcctgcaccgtcacggtgagccggcccgcctcctccggccccacccggtatcccccgattctgacagagcctatacacggtgccctctccgtctctcccacccggcccaaacggggcgacaccgtaaccattacccccgtccccgaccagggctaccaggtggaacaagtgacagtcacccagcgggacggcaccgcccttccggtgaccgaccacgggaacggcacctacaccttctctcagcccagcggccgggtgaccatcaccgtcaccttttcccccctcccctgtgacggtggggacacctgccccgcccgggttttctctgatttggaccccacccagtggtatcacgaggccatagactatgtcctcacccaccagctcatggccggggtctctcaagaccggtttgccccccaggcggtcaccacccgggcccaggcagtcacccttctctggcggctggaggggtgccctgccgcagacaccggcctctcctatgcggatgtggccgacaccgcttggtaccgcgaggcggtcggctgggccgacgccgcagggatcgcccagggcaccagtcccaccacgttttcccctgacgctgccgtttcccgggaacagatggcggtctttttccttcggtatgcccaatataagggatacgacaccacgcaaaccacggacctctccgggtatcagggcgccagccagatcagcggctatgcccgggacgccgtggcctgggccgcagaagccgggcttctcaccggggtaagccaagacaccctgctgccccagggcaccgccacccgggctcaaaccgccgctgttctaatgcggttttgcaccaacccggcccactaagtccttccctcccccgccaacaaaaaaccggctgaccaaagtttggtcagccggttgcgcctgttccgcgccgctccaaggccttccggcccgcttaacggcagcagctgcagctggcgccgccgccgcagttttcctcctcttccatccccggcagggtgctgggggggaagaactcgcccacagggaagcgaatctggcggaagatctcgcagggatcgtcgtccccatcctcatcgccgccggcacactcccgggtgggcatgcagtagtcgtacatggggatgagcaactgggaatcccgctccagccggaccatggagaactgccccagggtcacatagagccgccggcagcccccgtcgaaggccagctcgcagtcgaagcaggcgctgatgcaggggggaatttccgtcagctcgttctccgcgcagcacccgcaggggggtggaggcggcggggggcagggattgcagggattgcaagggggcgggcaggggggtgggcagacaaaatcgcagggatcaatgagcttcaagctcaaaacaatggggtccaccgcctccaccacagcctcggggagattgctccggcccaggccctggcagtcgggctcctcagggcggtaacgggaggtgaaaatcttcgcgttgccctcactgccgaagagcagaacccgtttgtcgaagaccgccaacccgctgatctccgccggccgggagccccccacaaaggcctccgcagtgatccgatagtagtaccggatatccacgctgaaaaatccccggttatagctggcgggctccacatcgatgtaagcctgcagcagctccgcccggccgccccggacactcagggcccggtcaatgaccgcctgggaggaacgggtgggatacacccgcaggtcctcaatgcagtctttgtcccgacagctgtcatagatcttttttgtatggatacacacggcctcccggataccgcagctgtcctgcacgggcccgggtacaaccctttcattcatggtattacctcctctgacttcatcagactggcgctcttgcctccccatactatgacgggcccctccgattcgtcacaaatagggcaaacaaaacacccgtggccagcgctgccgtaaaccaagagtctccggcgcctggtattccattctattgcgccgggctgccaggtgttccttcgggcccgcagcgcaaaaaaggccgaaacttttctcttgcatttttttcctggtcgtgctatactaagggagctttcaacgcaggtatagttcatcggtagaacgcaagcttcccaagcttgataggagggttcgactccctttacctgctccaacggcggtgagtcccatgtgaactcaccgccgttttgtacattttgctgatttgaaaaaagtttgcttgcagcctatgcttgcaaaaaaagacatctgcctaagcagatgtctttttttacgccttgatctggccgcgtacttacatgccgtacccttggcacaaacgcatcagtacagccgctgtttgggcccgggtcgcctggccgcggggggagagggtggtgggagaggtgccggagagaagaccggcatccacacaccatgccatggcctcccgggcgtaggtgctcacctgtgccaggtcggtgaacccggacaggtcggcctgtccctcggtgtcatagcccatgtgctgggcaaaccgatagaggatcgccgccagctgctcccgggtgacagggtcattgggaccaaagttcccgttgccgtagccgcccacgatgccctggccggccgcccagcgaaccgcctcgccgtaccaggcggcggggtccacatccgcaaagtccactggggcctcccccgccgggctgtccaccagccgccacaggatggtcacgatctgggcccgggtcgtcatgccgttgggagagaacgcgttaggcgatgtccccaccatgagactattttcataggcatatctcaccgcgtcgaaataccacgcgtcaggcgcaacatccacgaacggcaggccggggatttccttgtcccggaaggtaacagagatcgtcaccttgcctgtgggctgggtgaaggtatacgttccgtcccccttgtccgtgaccttgactggatcgccgttgcggtccgtgacggtgacgctgtccacctcgttcccctggtcgggcttgggggtgatggtcacggtgtcgcccttgtgggggcgggcaggggccacggaggtgtcgccgccggcggtgtctgtcacagtgggcggataggtggggcgggaggagccgccggaggacactgcggtccagtgggcataaatggtggtgtcctgggtaaacacggtatcggttgtgaccttctcgccgccggtggccgcagtgaaccagccatcaaacgtgtggttgctgcgggtgggggtaggaaggacggacagtttgccctccgcgttggggatcaagacagattcctccaacgtgtcaccgccgttcacatctaatttgaccgcgaaatcggcaatctgttcgcttacagatgtagtactaaacttaaaaatctggtaagccataggaccattttctgtctccgagacaaggaaataaccatagtcttgccccagttccccatttccatccaacgccgcggtaacttgttggcccttatcggtctcttggacggtgtacggctcgttagtagctgcgccggtgtcgttccagatgacggagaaaggaccgccctgttccactgaaccaaagccatccaccacggcctttagctgtccgcctacataagcacctccctcgataccggtcaaggggattgccagattggcaagatcatcgtttgattttggggactctattgaactgggagtgctgatacataggttgtatttgggagaaaatccggtggtctggttatctgtaaaaactcccggcgcagtaccgtagttcaaataaactttcgtaccggttgtagcctcattgacaaagctgccgttgtttgtaaaatctccacggaagaggatatagccgggcttcgtgtttcttgaatccccgtcattctttgcaatagcagatgcgccttcctccagcgtaaaggctccgttcatcagcaggtaactgtggaggctggggctgctgaaggaccaccaacaagtatccataaaggcaattgtgccgccctgttccacccggatattggaattacagactgtcgcgccgtagggagtataaaatccagaactgtattgtaaggtcagggtcatactgctttttatggtgatgtttttctcttggggaatgctgtcgtcgtaggcaaagctgccgaccacctcaatgtcagtgactgcgtcattctccagcgccgctttgagcccgtccgcgctgtccacctgtacggctccgccgggcgccagcgggatggcagccgccgtctcactggcggctccggtaccggcgtggttgttcgccacgacccagaaataataggtggtaccgttggtcagattggtaactgtggctgtcgtaacgtcagccttggtttccagcgtgtccccagaagtcggattttcaccggtgggcttcgtggtactccaacagaccgtgtacccggtgaccggaccggtgccagccttctccggtgccctccaggtgagggtcacttccccgtctccagagacagcttccaggtcctgcggggcgctggggacttggggaatggacaccagcactaccttggcataatctgggctggactcgataggcgcgccctccaggcccagaaggggaatttcctggcctatggttgcgtttgcgttgtatattccggcggggagagtggcggctgccgcccggtatcccttgggcacggtcagcgtcttggtgttgcttgcttctgtccccgtcagggtcagggagatatcccccacttgagaagggatggtcaaatcgggatcaaacttcatattgacaacgggggcgctgccgggggtgggggtgggtgtgccggtcatggcggcttttgccccgtcggaataggctgtcacatttgcgccagaggcaatcgtcagggtaaattgggcggcagaatcgccggagccttcccccaagccggcagcccctttgccgccgcaggcggtgaccgtggcggtgtcagagatcgtgacctcgtttgactcacccttgtctttgtcatatccaccgatacctgccgccaggtcaccgccgtagccagtgacctctgcattgccggaaatggtcacatcacagggcgcgccgccgataccggggcagccgtatccgccgtaggccttcacgatgccgccggagatgttgatatcgccactgccgcagccctggcttccgccgataccggctcccatttttgtatctgccggaacgcctacccagccatcggggtctgtgccgccgctaagcgcggtgaccacaccgccggagatattgatggtgccgccggaactgaaatttccgccgccaatgccagcgccgtagctgtagccagtggcggtgattgttccactctcaatattgatggcgccggtgtagtttgtggcctcatcaaaattggggccgccgatgccggcgtagccatctgtggtaatagaaccaccgccaccgcccatttctgcactgacataggtaccggcctttgccccggaaacagttaggcgatcagtgttgtcgtcagattgggattgaattgtcacggttgccccctggttcaccaaaataccaggcccatccgcaaaggcggacaaggtgttttccccttctaaaatcagtgtggcagaagccccttcggcaatctcaatggggcttcctttgcactcattcaagctcatattagcattgttcagtgtaatcgtagcctcttcttttacaatcagtcgctcatttctcgttctgccggcgacggtgacatcctcagtgacggtatactctttggtgtagttctcggcattttcacttcctgcgactgtttctccatctaattttgtcacggtaaaattccctgccgccagggcagtggcgggcagcagccccaggcagaacaccagtgccagcagaccgctccagattcgttttcctttcatggataaccttcctccttttctgcggcagcgccgcattttgccccaaacaaacgctgagacacacgcaaaaaacgcccaccgcaacacagtttctctgtgtcgcggcggacgttttttgtctggtaatatgcggttttagacagcactaaaaggcaggaattaccctgcctgcctgcctgcctgcctgcctgcctgcctgcctgcctgcctgcctgcctg

SEQ ID NO: 2223 - DNA, 122308 bp, KLE1738
aaatgcggtacggcgggggagagggggacggtgatgtccgtgcgaggtggagttagagaagactgcgaatttgagacaggatatcgtaaaggcgtctttgatctttttcagaaaggctggagaagagctcataggcccgcaagggatagttttctgcagaaggcatgggattggaaagaacatcgtcaaagacagaggaaatggggatacccagggcggtggtgatttttgccagagtttctacggtgatgtttttctccccacgctccacttggccaatgtacgtgggatggagcccggcgcggtctgccagggtttcctggctgtagccttttttctgtcggaactgccgcaatttacggccgatggtctgcgtcatcatagaaagatccctccgagaaaagactataagtattatctcccagagtgaacagactattgatatttttatggagctgatatatactataagtattgtttggaccaaaaccgatttttagtataaaggatgacgtgatatgttgcaaaagcttggcggagggacacccaagggacgggtgatgcttctggccttttacaataccaaggcgttgggggtgcggtatctggaaggggcgctggagcgggctgggtatcaggtgcaggtggttttttataaggagtttaacagccattgccctgggcagaccagccgtcgagaattggagcttctctgtgaggaggtgcggcgggcagagcctgtctttatcggtttgtctgtgatgagctccatgtatttggatacagtggagcaggtgatgaagaccttgcgtgcgcggtacgccattccgctggtttgcggcggcgcgtttgccagtttgtatccagattacttcttggaccggggagcagcgtatgtgatccggggagacggggaaattcctatggttaacttggcggaccgtttgatgtgtggggagagtggagaggacctcgcctctctttgctgccggcgccatggggagacagtggttcagcccattggcggggtattgaaggagattgatgggtatgggattcctgtggtgagcagcccacgggcctgtttgattgagagggatcgactgcggcggggggacccgcagcggcatacgctgcggtatgaggtcattgcctcccgggggtgtccgtttacctgtacctattgctcttgtgcaccccttcaccgccttatgccgcgggggatcgccacggtacgaacccggtcggtagagagtgtcatggaggagcttcgggaggccaagcgggcctgtccccgcatgatgatggtgcatttttatgatgaaatttttcccaatcttccaggatgggtggatgaatttgtggcggcttatcagcgggagattcaccttccctttaccatctggtcccatcccaaggcggccaaacaagaggtgctggaaaagctggtccgtgtgggattgacggaggtcattatgggaatccagtctggatcggaccgcgtccggcgggaggtatttcaccggtatgagacccgggaggagatcctccgggcggcagggttctttcaggcggcgggggtgccgtgggtcagctatgactttatgctgcagcatccgtttgaatcgttagaggatttgaaagagacctatttcctggtaaaagagcttccggggcgctatgtcctgcagctccacgggctgaattttctgccgggaacggatatcgtttccatggcggtggagcaggggctgtttacccaagcggagttggaccgtattatgttcgcccctatggaggaacagtttggtgcctattggaaacaggagacctcgctggagagccagctgtggtatgcgctgatcttcctatggcagtgggaggccatgcgagagagatgtctggtctatgaacaggaccctgtggagtataagcaggaaatttttaaggcatatcgtcaggcgcaggggctgtcccggcgcagggaatggcgtaaaaaattggatatggcggcccgacgatttgggctgcggtaagaaaaaacctccggccgaagccggaggtttttcaaaagcaaagcagaggagccaattagttggcgcccttgggattcatgggatcggtacgatcctcgatccaatacttgccgatgggatcctgagaagcgtccttgttgacgttgtgggcaatcatcagggtctggttgcggttctcaacctgcagggcgttgtcgaagccagaagcgtcgacgttggcacgcatagcctccttggtcagacggacagccatggggtccttggcggcgatgacgcgggccagctccaggccagcgggaaccaggtccttgcgctcgtcaacaaccttggacaccaggcccaggttccaagcttcatcagcgttgatgaagttaccggtcagcatcatctcataagcacggccggtgccgatcagacgaggcaggaagtaggaggaggacatgtcgcagccgccgatgcccacgttggcatagaagcaggagaaacgagcggtcttggtgcagacacgaatgtcagagcacatagccagagagaagccaccgccagcggagacgttgtcgatcagggtgatccagggctgaggagtcttagcaatgaaccactccagctcgcccagcttaatctgatagtgatagaagccgggaacggtctgctcgtagtcggtcaggccctgcttgacatccaggccggcgcagaagcccttgccctcgtcgccgccatacagcaggacaacgcggatgttgtagtactcgtcaaccagccactgggagagctcggtcagctcacgcaccaggtcgtgggacagggcgttgtaagccttgggtctgttcagggtgaccttcaggatgttgggctcgaccatctcgagcagcaggttctcataagtgggcaacgctctggctgcgggataaacaggtttcatgataaaatcctccatcatcaatatttggcctttaagaggggccatgggacctacttacctacgccaaccggcccacaaggggccggctgacggaagttacgaacaatcagcggaaaaccaaggattagttggtgtttccgttggcagcgacatacatgccgtggatcaggtactggatgtcgccggagccctcgatgttgggggcgacagcggcgtctctcaggaagcgctctgcctgatactcgtcgcagacaccgtaagcgcccatggcgttgacggccatggtggcaaccttggtggcagtctcagcggcatagcccttggcctgtgcggtacgggcctgaacagcacgcatggtggggatatcatcgccagcgaagtggttgtggtcgcagtagtcagcggcctccagcagcagcagctcggcggtgtgtgcgtaggtcagcatggtggacagacgcagctgggtggtggggaacttggtgatggacttgccgcggtgcagcttctcctggcagtacttcagcgcgatgtcagcagcgcccagagcggtgcccacgaacacggcggtgaagcccagcttaccataagcggtggtgcccagcagctgggtgaagccgtcgccgggcttgcccaggatctggtcctcggtgaccttcacgtcatccaggaagatgtcatagacctcggagccgcgatagccgatcttctcccagggggaggagatggagtagccctcgcagaacttgtcgatcaccaggccggtgaccaggtccttgccggactcttcgtccttctgcagggcgaacagcacgcaggggccgtcataaccagcgttggagatgaagcgcttcacgccgttgagcttgtaggtgccgtcggcctgcttctccaggcgggtcttcagcatcttggggtcggaaccggtctcgggctcagtgaaagcgaaggagacggtctgctcaccggagcagcagggagccagatacttcatcttctgctcatggttggcatacaggtccagagcctccagacccaggatgtacacgtccaggcacttgcccacagagggggaaacgcggctgagctccttgatgacaatggcctgctccacgtggcccatgcccatgccgttgtactcctcggggaagctgatgccgatgaagccgcactcagccagctgctgatgaatgtcgtggggcagctgaggatgcttctggccgttgctgacctcggtcatctcgccggcctcgatctcgtcgatccggggctgcaggacagattccgcaaagtccttggccaggtcgtggatcatctgctggtcttcgttcagtttgaattccatgataaaattcctcctgtataatgatttcttacgtaacaggcattaaaacaattgcctgggcatgagaagaatgcccacggcaacgtcttccaatacggggcaacttctacggtgctattatatcataagaattggggaggcgcatgccatatattaattatttttagcgggtgcaatacttaattagcactaagagagaaaagaaaagtggaaagagatgtggttataacaaccaaaaaacgggagagaaaactgaacaaaatatacaaaacgtaggaaaaggaggaaaaagatgtttgcacaataaagcgtatgagagaggagaaatctgccttccttccgtggaaaacgccatggaactgggaaggggagaaagaaaaaattgtgaaaatgtcaacagcagaccttgacgaagccgggttcttcctgtaagataggacaaacacaagctgaaaatggcggggtttttcccttcggtctggaggggaaggaaaaaggccccggtttctttatgattaaaaaggcatttccgggcaatccggcaaggctgattattagataccccatcgggaaattatcaatgtatttaaggagttgcagaaacatggaagttaagactgttggcgtgtatggcgcaggccttatgggcagaggcatcgcccaggtcgctctggagggcggctatgacgtggtcctgtacaaccacagaacccccaccctggagaagggcgtggccgggatcaaaaagggctttgagaaaaaggtggccaagggcaagatcacccaggagcaggccgacggctggctgggccacctgaaggccaccatcgagctggaggacctgaaggacgtggacatcgtctttgaggccatggtggagaacatggcgctgaagaaggaagccttcgccaaaatggcccccatcatcaagcccgaggcgatttttgtctccaacacctcctctctgagcatcaccgagctggccgcagcgtcgcagcgtccggagaagttcctgggaatgcacttcttcagccccgtgcccgccatgaagctggtggagatcatcaacgcctatgatacctccgaggacaccattgagaccggcaaggccgtggccaagggctttggcaaggagtttgtcaccgtcaccgatgtgcccatgttcattgccaaccgggtgatgtgccccatgatgaatgaggccgccatcctggccggggagaatgtctgctcctacgaggacatcgacaaggcctgcgagctgggctacaacctgcccatgggccccctgaagctggccgacgccatcggcatcgatgtgatgatcgaggtgatggagtccctgtaccaggagaccgctgactccaagtaccgtcccgcgcacctgtacaaggttctctaccgcgctggccgtctgggccggaagagcggcaagggcttctatgattacaccaagtgagtttgttcccatagcaggataagagcataccgcaggccaccgccggaaccaaggcggtggcctgcttttttgggggaaagagcaggatggcccgcacggggatttcctgccctctttcccattgtcccggggagaaaagtgtggtatcatacaggggatctttgcatagaatgggaggaccttgttatgcgaattgccaacacggtcaacgactccattgtggacggacatgggttgcgctttaccattttcacccagggctgtccccaccactgcccaggctgtcacaatccggacacccacgatcccgccggcggccgggaggtttccctggaggaactgatggcggagatggggcgcaatcccctcattgagggcgtgaccctctccgggggggaaccctttgcccaggcggcggactgcgcggcgctggcccaagcggcccatgcccgggggctgaatgtctggacctattccggctacctttttgagcacctgcgggacagtgggaacccggactggactgccctgctggcccagaccgacgtgctggtggacggtccctttttggccaaggagaagtcctatgagctccattttcgggggagccgaaaccagcgcctgattgatgtgccccggagtctggcccagggccgggtggtcctctggcaggaggaggaccctttggccaagttcactgtgccggagtcctgagaggaggaaaggataccatgaccattgcggaaatgaagcaccactttacccaccgggagctgggcatccagggcgcggtgggagagtatgccattttggtccccttggcccagtgggagggaaaactctgcctcctcttcgagacccgggcggagaccctggtgggccaccagcccggggaggtctgcttccccgggggccggcgggagaggggagagcgtccggtggaaaccgccctccgggagacctgggaggagatcgggattcccccggaggagattgagattctggcccccctggatgtcatccaggatatcagcgaccgggtggtgtacccctttctgggcaccatcagcccccagggggtggaccggcttgcggccagcgcggcagaggtgaagaatgttttctttgtccctctggactacctgatgcactaccctgaggaggtctatcgctacacggtctcggcccaggtggacgatcagttcccctatgagcggatgggctttcccaaaaactatccctggcggacgggatttatggatgtgcccatctatgagtatgagggccattttatctggggaatgaccgcccggaccgtccgctggctgctccgggagctgcgggcgatggaaggggaagggtgagccgtggagtcggtggaatttttgggccggtaccggcttacccaatcggacgcctgttttaagctgggccgggacagcgtgctgctggcccggttttgcaccctgcgcccccggtggtcggtgtgtgacctgggctgtggggtgggctccctcctgcttctgctgtcccagcgggaggaggccctggaccgggtgggggtggagctggaccctgtcgcggccggcctggcccggcggaacctgtcggacaacggcttggagggacaagttcttaccggagacctccgggaccgcgccctgctgaagggcgaccgcttccagctggtgattgccaatcccccctattttcgggcggggtccggcaagtcggggggacaggcccggatggacgacacctgcccggtggacgacctgtgccgggcggcagggcgtttggccaagacaggggggcgtttcgcgctggtctaccgccccgagcggctggcggagctttttgccgcccttcggggggcccggctggaacccaagcggcttcagctgctgtcctatgggccctccagccccccttacgcggttttggtggaggcggtgaaggaaggcgggcccggcctggagattttaccggtccactatcagacagagtctgcacactgaggaggatgctgccatggcaggaacattatatctggtcgccacccccattggcaacttgggggatctgtctctccgggcggcggagaccctggagcaggtggatttcatcgccgccgaggacacccgggtgacggtgaagctcctcaaccatctggggctgaagaagcctatggtgagttactaccgccacaataccggaacccggggagaggaactgatcgcccgcctgctggggggtgagagctgcgccctggtcaccgatgccggtactcccgccatcagtgacccgggagaggaactggtggcccagtgcgcagcgcaggagattcccgtggttcccatccccggcccctgtgcctttgtcaacgcgctggcggtgtccggtctgcccacgggacggtttacctttgagggctttttggccatgaacaagaaaaaccgccgggcccatctggagagtctccggggggagacgcgcaccatgctcttccatgaggccccccataagctccaggccaccttgagggacctggcggaggccttcgggccggaccggcgaattgcactgtgccgggagctcaccaagctccatgaggaggtccggcggaccacgctgggacaggcagtgtcctactatgaggcgcatccccccaagggagaatttgtcctggtggtggagggggcgccccctgtggccgagcaggcgcccaccctggaggatgggctggcgctggtggataagctccaactggagggctggtccaccagggacgcggtcaaagaggcggcagcagcctgccggctctcccggaaagtgctctatgaccgtgtgcttgcccgaaagaaagaatcttaatctggacgacagcggccgcagcgcctgccggaggctgcggccgtttggaaactcccacatagcccctggggttggggcggcgggaggaacaagggaaaggccgtgtccccacataggggacacggccttgttggttggaaagagcggggttatttttgtaacagctccttgagacagtgtgcgcagatattcttgcccttaaagacagagatatcctttgcactatcgcagaaaatgcaggcgggctgatacttcttcagcatgatggaggacccgtccacgtagatttccagggaatccttttccgcgatgttcagcgtgcggcgcagttcaatggggagaacgatacgccctaactcatccactcggcgaacgatacctgttgacttcatggtgaagcacatcctttcagcgtcagctgttttctctctcttttttgccggtgctactgggaatcccccagctgccctgacaaaaacagccaaaatagacaaaaaactcatggatttaatttgattataacaaaatgtggaaggaagtcaatcgaaacttgtcgtttccaggaaaaaagaggaaaataaggaaaggaatgatttttccgaaaaacacatagggtggaacgagaacaacccggggcagacggcgggcagcgaggaggagacaccatggcaatgacggtgatctggacaggaatgacggcgctttccctgctttgcgccctggcgatgggcaaccaaggggagctggcgtcggcggcgctggacggtgcggcgtcggccatcgagctggggatttccatggcaggggtcctctgtctgtggatgggggtgatggaggtcatgcagcgggccgggctggcggaaaagctggcccgcctgctgcggcccatcctccggcggctgtttccggattttgccggggatcgggggaccatggacaccatcgccgccaatgtctcggccaacctgctgggactgggcaacgccgccacccccctggggctggaggctgcccggcggatgagccgccggaccccgggggtggccagcgacagcttgtgcatgctggtggtgtgcaacaccgcgtccatccaactgattcccaccacggtggctgcggtccgcatggcggcggggagcgccacgccctttgacattctgccggcggtgtgggtgacctccgccttgtctgtggccacagggattctggcggccaagctgctgtccaggctctggcggtcgtaggaaaggaggcggagccgatgcagttggtgctggacctgctggtgccgggaatcattgcgggggtctcctgctatggcatggcaaaacgggtggatgtctatgatgccctgctccagggggcggccaaggggctggagattctgctgcggattctgcccgctctggtcacactgctcacggtggtggccatgctccgggcctcgggggcgctggaactggcggcggaactgttggcgcccgccctggagtggctgggtatcccgccagagacggtggggctgatgctggtccgacccatcagcggcagcgccgccctgggggtggggtcggagctcattaccacctatggcccggactccaccattgggcgcacggcagcggtgatgctgggctccacagagaccaccttttataccattgcggtgtatttcggcgcagcggggatcaagaaaacccggtatgcggtgccggcggccctctgtgccgatttggcgggctttttctttgcctcccttacggtgcggctgtttttgggataacagtgggatcggagatgggcagggcgggtttgcaaggggttggttgtgtgttataatgcaggaaagtccgatgcgaggagcacgggagcgcgtagggagaaagcggggggctgttgccctcaggtttactgctgtccctggaaaggaggctccgttatggcggaacggacgctgcacacccccctgacagacctgcccggcgtgggtcccgcccgggcgcgggccctggataagctgggcctgtccacagtggcggacctgctggcctattttccccgggagtatgaggaccgcacggtgcgggaaggcattgcctggcttccggcggacacgccggtctgctttgccgccgtagtggcggaaccctttcgcaccagctatatccgcaaggggatggagctgaccaagggacggatcgtggatggtaccggccaggcggcggttacattttttaatcagaactatgtccgtaaggccctccagccgggacagacttattttttttacgggacccttacgggggaagggtaccgccggtctatggtaaaccccgcctttgagcgggagggggcacatcagctcacaggaggcattttcccggtctatcctctaactgcggggatcaccaaccggtttctcacggggctggtccgggcggggctggcctgcctgccccaggtgcaggagaccctgggggacgacctgcgggagacctatgatctggtccctgtggagcaggcctatgggagcattcattttcccgcttcttgggaggccctgaccaaggctcggcggcggctgatgtttgaggagctgttctgcctgaacctgggtctgaccctcattcggggacggcgaggagaacagcgggcctgtccctttgtgcggcaggacctggaggcatttaccagccggctgcctttttccctcaccccggcccagctgcggtcggtgaaggaagcggcggcggatttgcggcgggctgttcccatgaaccgcctgctgcagggggacgtgggctcgggcaagacggtggtggccgcggcctgcgcctattttgcctggcagaacggctgtcaggcggcgctgatggcccccacggagctgttggcccagcagcatcaaaggaccatggaaacccttctggcggggacaggccttcgggtggggcttctggtgggctccatgaccgccgcccagaagcgagactgccgggcggccctggccgcgggggcgctggacctgattgtgggaacccatgcgctgctcagtgaaggggtatccttccggcggctggggctggtcatcaccgacgagcagcatcggtttggcgtggaccagcgggcggccctggccgccaagagcggggagaaggaccggccccatgtgctggtgatgtcagccacccccattccccggaccctggcgctgatgatctatggggacctggatctgtctgtcattgaccagcttcccccggggcgcaccccggtggctacctatctgatccgggaggacaagcgggcgcggctgtatgcctttgtccggaagcaggtggcccagggccgccaggtgtatattgtctgcccggcggtggaccaggaggacccggagggactgaaggcggcggagcagtatggccgccagcttcaggaagaggtctttcccgatctgcgggtgggaattgtccacggaaagcagaaggcacgggacaagcagggggtcatggcggcctttgccgcgggggaagtggatgtcctggtatccaccacggtcattgaggtgggggtggacgtgcccaacgccagcttgatggttgtggaggacgcggaccggttcggccttagccagctccaccagctccgaggccgggtggggcggggggagcacccatcctattgcgtgcttctctcggacaaccggaacgagctgacccgaaagcggctgaaaaccctcgcctccaccaccgacgggtttgccattgcagaggaggacttgaagctccggggccctggggatttcttcggcgcccggcagcatgggctgccccagctgaaactggccagcctggaaggggacatgcgcctgcttcaccaggcccaggcggcggctcaggaagttctggcccgggacccgaacttgacctgggaggagcacgcccctcttcggcggcgggtagagcagcttttccgggagaaccgggatattttcaactgagattctgatgggtggtttcctgttcggccgatccctggggggattgccatttggacgaagggaaagagaggaggcgcccataaatcagctttttatattattataatgataggcggcaacgggggatggggagcgcgaacggcaaggctgctgccataaaaatcattgaccgccctggccaatatggccagggcggtgcttttgttatggaaacaagttgtgtgtcagttcctgggcggcttgctcagagatggcaacatcaagggagagacccagggtggtcaaggtcaggtaaggggcgtcctggtagagctggatctgacagagctcccggagctcgtccccggcttccttctgccatactgtttgggttggctgctgagtgaaggagagggttccggcgggacgcaggccctggggaaggtccgcggtggaccaatgatccaaatccatggccaagatcaacgcttcgatctggctcttttcggtcaagacctgcgtgggcgcggtctccccggcggggatgacgcggacctcttgcgccttgtccaggtcgggaaggctgccggcggcggaatcgccgccctgacaaccgcagaggaggagaaaaagcatcaggggaaggagtcgaaacagacgcatagaaacctcgcttttcagaaatgaagggggaagagaaggacgggaatagacgtataaatcaaattgtgacagaaccgggatgagaggcccggcacctatgttgaagaattataccctgggcaggaagaaaggtcaagctggcgcggacagaaatcctgtggtatgatgagaaaaaacacggttgtaaccttttttatgtggaggaggaatcccatgcactataccagtcagtatccatcccctctgggagagctccttttggcggcggacgatgacggcctgacaggggtgtggtttgtcggacaaaaatactttgcccgctccctggcaccggactcggtggcgcgggagattccgctgtttgcacaggtgaagcagtggcttgccctctacttcgcgggacaggagccggaactggaaatccccatccacatggtgggaaccgcgtttcagaaggcggtgtggcgcatcctccgcaccattccgtatgggcagaccatgacctatggcgccattgcccggcaggtggcggaggagctgggtatccggcggatgtccccccaggcggtggggggcgcagtgggacacaatccaatttccatccttatcccatgccaccgggtggtggggaccaacggcagcctgacgggatacgcaggcgggctggaccggaaagtcaaattgttgaccttggaaaaagcggaggtgggttccctcttcctgcccaaaagaggaaccgccctgtaaagtaaaaagggaaaaactgggaaatatgtcgtattaagtcgccaaaggccgatactacttaataacataatatgataaagccatctgaatcaaaaggtggttttatcatgacaaaaacagagatggatattcgttccgtccttggccctgctggcggaagtattcggcctctcgcggctgcctccgatctgtttgcccggcggatgtttgaggagcgaatggattccgaggacattttcctgaccaaggacatctaccccattgtggcggtgtggctgcagaagaaacccggcgccactggcagagccatcgagcggctggccgcccgctgctgggatttgggagaccggggccggctgagcgagattgcggggaaaaatctccgggaaccgccggccccccgggacattatgatctactttgcctggtattctcacaaggggattccctattttgaggcgatgaagggaaaacagccccttcttttttgagggaggcgtctgtattcgggaaaaagtgggggaatttcccctgaaaagctgccagaagaggagcgcggaatgatatcctgtgatattttagagtgaatgaaacagagccgagtaaactttgcataaggagcatggctatgatttatgataatggaatttttgtaaatgatcaaattgggatcagtgcaaccttcagcttagttgctctgggtgtttctattcttggcatggtattacagattttggcaggtatcctattgtttcggggggctgcacatattgcgaagcaggaaggactgcggggattggcggttgcgttccgtatagtgggagcctgttccctggcctttggaggatatagtgtgatttccctgattcctgtgttccgctatctttttgtgatttgatctcgttctggcaggagatacgacgaaacaaggaggagaggcgcgcaaagaagagaagaaggacgattttatggactgcggctggagctccggctctgctggtgtttccatggtacgaagggtagaagaataaaacgctcgcccctgtcaaactttgacaggggcgagatttttttacgaagatatggattgacttggctatattgaaaatttttgattgaaattctaatggaaatttgttaaactaatactaaaataagggagatgtcccccaaagacgaatgaaaatacaggaaaagcaagccataaaaaggaaaccctgttgcttgtacccttgttcatgcaaagggaggaggattgcagtgaaaaaattactttgtatatgcctgtctatgctcctgttgttcattgttggcatttccgcctatgcgtttgggccagagccggagagcacgtgttctgtggtggaatacgatcagaccatttctggggaagcacaatttagaagtacggaattcacttgtgtgaaaggaaacggggattttctttcctatgggttcgacaatacggccgatgccgattgtatggttgagctctataaaaaaggtcttatctgggacacaaaggtgagttccatgacagtgcgcccgcatgatccaggaggaaaaacagaagttattaggaacccttcagacagcacattttactttgtcctctatgctgcggatgggggaaccatctgtgggcatctgcaggcatatcagtgaaaccgttaatatccatttgtcatcgtaaaacgctgtccctacccaaaaaagttgggcagggacagcgttttttatgcgttggaaagcaacacccggacggtgccggcgagggaaccgttggaagaggagaacgagatcacatgagctccgggttgggagtcgtccaccaaaaaggcgcgtgtgctttcaggaggaacgtcgaaggtgtgcggcggctgcctctgagaataccgtactgtgatcttggtgctggtttcattttcattttggagcaaaagaagataggaaggatactcctttggttggtcccattctacatcgcagtcacaaaatgtacgatcctgacaaaaaacatagtcttggagtaagactttctctgaataagcggaagcgtctgacagtgtgaaattttgttcgggacgatctcggaaggacaacgcaccgaagcacccgaaaataagaagcagagggatactgacagcaagaacccattttgacttgccgccccggggatgcgggtgcgtggtcatggtttgcagtaaggtctgtgccatgtgttcaggcggaccaaatgcccgtaaaagggcgtcgtaactgggacagggagtttcttccaacaaaggagacagggagcggcggaatgccgcctgtactttagagcgcaggcgaaagccggagaccgattttcgcaggcgtttttcatagagagaaagatcagtccggcgcatggcgttccccccttaataaaatatcattaaccccttggaaaaatgcttgataggtttctaacaatttctggaggtaggcgcggccggtctccgtaatggcataatactgccgcagccgtccatccggggcggttttctttttggtctccgtcaggtagccggattgggtgattcgatagatggcagcgtaaggaaagacgatactgagaacgccgtgactgcgtttctccaacaagggggagagttcgccaatgtagtgttcttcctctccaaagagaaaaaggatcaacagttcggtcaaggcttttttcagattgtcttccaatcctgaactataacggtttttttgctctgcgtcgtggtgtttcaagggtgtgcccgcctttgctattttcgtacttattttatcatgtttcattgttgacgtctaccggaacggataagaaatatttttttcaagaaataaaaattttcgttgacaaataaatagaggggtgataagatttggataggttaaaagcaacaataatttccgaaaaacaacgtaataaatagggtatattgcgaaggaggaagagtatgaaacaatggaaacgggttcttggtattgtcttggcatggtgcgcgctctcttctgtgtgtgcgatgggcgcggaatcgacagtggagaagagggaccaggagagttggaaaggaacagaaaccaaactcatggcaagtcatattgcggtggacaccacagtgacaaaatatggtgtctcctggtatcagccgaaggagtatgtttcctaccgtatctgggtagataatacgacgaacaacagcatgcgtgtaaccattacggacccacaggggaggctcagaacattttctgttccagcccatggaaacaaatcgtatgttggcaatggtgtagaaagcgggacctatcgcttgtcattcagtagcagcaatggtgtattgagcggaacggtgcgggtgcgagtgtctgatgtggcgctgtcatgaatagcaggttagcgaatgatatcaataggaaggaggggagtcctatgtggattaaaagtttttaggcataattaagaggattttgtaagaaggtatatactaccttaaagttactgctaatgaaggaggatatcatgaaaaaaagattggcgtctttagtgattgggttgagtgttgcgctttcgctggcaatcccagtgggtgcagcagagatgaaaactcctgttacagaatttgaaagtgtcacgaaagaagaaacgattatccatgatgtggagtttttgtctgatgcgacaatcacgacggaagatttaggcaatgacacgtacgcaattcagttgcggaatcaagaagaaccatacattaactctgaatctggggaaagtagcagcacaacagccacgattgttgcctttggagaggaagagttccaggaaattgaacaaagtgttcaggcagcggtttccagcgcaagcaaaaagaaggagagtggctggatctatatggggaactctgcttatgccgaaataaccatcaactataattacaaaagttcatctcgtggtacactctataagatgacgagtgcaacggtgaaagcactggtaagagacggaacatcactaaagaatcgttccgtggaattcgtgtcaatgatggcagattataatggaggaagacataaagtgtccgtcccatctggatcatctacatatactgcacaggcaccttcttcgtggccttatgtttcttctaatggtttgttgtacggagtttatttccacttcaccgctgtaagaccaggaggaagtagtcaggcgtatactttctataatgacctttttggatgagagccgatcgatagggaagtaagcgtaggtgatctgtatgagggccttaaaacaagatgcgaaagaaaagcggtacggaagaatttgtcttctgctgggtattatattgctgggaaccgttggttgctcccatacagtttcagatactccatccatagacgctgagattgccgaatttctacaggtttcggagtctcaggcggagtctctgtgggaaggaatccagacaatcgaccagaactcacgggcagagaagaccacggttcacgtccggcaggcgttcgggaatgaacgggaaatgtatgtcctgtacgatgttacgttctccacggaaattgatttgcaaaaagagaagaacaacggaatcctacctacaacggtgaccctgtctggtgtaggggaagtgtcgaaagcagggaagggaggaagcgtatataccatcgggataaatggtcagacgatcacgtatctctcctattttgagagcaatttagaccaataccctgagggagacctcctcctgactttggggcagtttaaggcaggtggaaaaaccgaggcgacttccatcgccgacgaggtccacgagttttcctggacgccaacaactcatggaaccattctgcgaggggatattgtcacgaaggaaggaaagaccattggcagcgtatccgtgtctcccttttctctgaggtttgcagcagattcctcgtcccagacagagtatgtggactttttacggtcgattatgattattgatcggaacggtacggcagtacgtccgaaaggaggcagtgggggtggtgcggcagaagaccctcttggaaaggagcccttaaccaacattgcaggaagcattgattttcgtgtgcttttggaactatcggatgtagcagcagttcaaattgacggatataccgttccactctcaaagtcataatgatccatgaccgcccgaatcaatatggttcgggcggtcaattttttagagtatcaaatacaggattctttccacagaaaccatctgctctgttgaaagaaggttaaggggatgatatactgtacacaaacccagcatagcatgggggaaccgaaagaaggattgcatacaaaatatgtgaagactggaccaagaaaggagaaattcacatgaagaagacaatcattgccgtgattctgtgcttagggctccttgttgtctttggagcggcggctgtgggaggagaaccggcagagaccggaaagaaaggcgcggctgtgtcgtatgcggaacaggacagaatccaggcgggaggcgtcacgttgggccttgacaaagggcagacaatggccgctttgattgagacagtgtttgggtatgatctgcgctcgtatgcgtatgtctccttcgcggaactgtggaatggggaaccgtccacagaggcgctgcgggccattcgcgggattttgacagacacatgcgcgggaatggaggccggagaacgaatgccggtggggtatctctaccagggacaggctgtctataccattgttgaacagccggacggcagtttgaagctgaccaactatgagctccagccggtggacagcgccggagggcttggggaaaccatcattccagactatcaggtggtcagcacggagcagcgcccggcagagccccatgaggtcgctttactctatccataatagatcagaaaaaacgcattcccctgaccatgacggccaggggaatgcgtttgaaaacgcgcatagaggaaccggtatggtttcacataggattggttctggattttgggaggggagcgccatgaggaaacgacctgtttcgatcgctattctattacttgtccttggttttgtgttgctttactataccatgcagaaacagtacatggaatttcaaaatacgtgcaatcagaaaatggaggagctgcgaaacactgctctgttatgggaaagcaatggcctgctggaggacagcttcgtctcagggacattttgcgcagaaagcggaactgcccagctgtacatcgaagtttctcccgtggagaagtcagaagagcttcaagtggtcctgacgtgtcaggggaaggcgttccccttgacccggacggggtcccggtttatgggtgagttggaggtccccgctgacacagtgtgcagaatttctcaggttacggtgacctctggacaggcggtccagaccgcgtccctgggctgggtgatcaacacgaaggatatgatctttccgcaggtggagagcacgtattacggcaaggggaaatccgttccggcaggggagccggccaccttttccggcaccatagaatgtaccgtttcctggccggggattctgcgggaagagattgttgacgcggaactcatcaagagggtcaacggtcaggcgtgtgattcccatagccttcgtgtccgtgatatggaggaagggagcgtgctcaagggaaggtttacggcgacgcccacggaagaggaacctgtcacctaccttgtccatatcacgctggccagcgggctggagctctatcacacggcgctggaccttccccaacctggcgtggagcacttcatgtgcaacctgaaaacagaggtatacagcagaacaggcgttctgttggccacgatgtaagacatggggcgaccccttctcaccctgccttggccgatttggccaaggcagggtttttgtcagggtgttatgatagagaggaggatacgcattccgttgcaaaagggagcaagatatggtatgatacaaaagccaacaaaaaaacagaaaggggaaagggaaaattagaagaatttaacaagcaagtggaacagtagatggaccaccctaaggagaaaggagaacatctatgaaaaaacagagacaaaaatgggtttgcttcctggcggtactgaccttggtcctggcggtgctgtgtgcttgcggcacgcagccggaacaagaagaagaaccggccccggtgcaggaaacggaacccaaggggacggaggcatccgccgggaacacggtggatatgggggactacgtcttgaccctgcccaaggactgcacccagcaggcccgggaggacgggggactctccttcctctgtgacggcgcccctgtgggcggcgtccagaccctggactgcccgggggcggatcaagtggactgggacgacctgaccggttataaggaggttctgcccaccctctggtctcagtttttggaggagggggagggaacccctgactacatcgcctctcccgccgcgggcagcggagcggacttggaggtcagcctggtcaccgaccagcgcagcgaaagccactacctttttgccgcaggggaccaggtttacgatctctggttcagcgatcccaaccccttgccctcctatgatgtgagcggcaccgtgagaagctttgccctgcaatcgaagtgaggaggggctaaagtgacaaaaacccggagaaatttagcagcaaagccgtaaaagtgataaaatttgaaaaaccgcttgcatttcttttccggcggtagcataatagggttagcacttaaagggttagagtgctaaccctatttgatacaggaggcgtttcgataccatggaaaagaaacaatttaaggccgagtcccagcggctgatggatttgatgatcaattccatttatacccataaggaaatttttctgcgggagatcatctccaacgccagcgacgccattgacaaactggcgtatcgggctctgaccgatgagaaggtggggctgaaccgggaggatttcaagattgttgtggtccccgacaaggaagcccggaccctcaccgtggcggacaacggcatcggcatgacccaggaagagatggagaacaacctgggcaccattgccaagagcggctcgctgcagtttaagaaggagaccgagaacgccgacgacgcggagctggacatcatcggccagttcggcgtgggcttctattccgcctttatggtggcggacaaggtgactgtgatctccaaggcctatggcggggagaccgcctggaagtgggagtccgagggggtggacggctacaccatcgagccctgccagaaggacaccgtgggcaccgacgtgatcatgtccatcaaggccaacaccgaggaagaaaattacgacgagtatctggcgccctattcgctttcgaacctgattaaaaagtattctgactacatccggtatcctatccgtatggagatggagcacagccgtcaaaagcccaagccggaggacgccggggaagattacaagccggagtatgagcaggtgaaggagtgggagaccatcaactccatggtccccatctggcagcggcccaagagccaggtgaccaaggaggagtacaacgacttctacaagtccaagttcggggactggcaggaccccattctgtccatccatgtggccgccgagggcaactttgagtacaaggccctgctgtatgtgcccggacaggtccccatgaactacttctccacggactttaagaaggggctccagctctattcctccggggtcatgattatggacaagtgccctgacctgctgcccgatcacttcagctttgtccagggcattgtggacaccccggatgtctccctgaacatctcccgggagatgctccagcatgaccggcagctgaaggtgattgccaacaacattgaaaagaagattaaaagcgaactggtcaagctcatgaaggacgaccgggagaagtatcagcagttctggacggccttcggcatgcagttcaagtacgccctgatgaacgcctatggacagaaccgggacaccatccgggacctgctgctgttctggtcctccaaggagaacaagctgacctccctgaaggaatacgtggaccggatgcccgaatcccaggagaagatttactacgtctgtgccgactcggtggagcacgcctccaagatgcctcaggccgagcgggtgctgaaagcgggctatgaggtgctctatctcaccgtggacgaggatgagatcgtgctgcaaatgctggagaacgcctatgacaagccctttgtctccgtggccagtgaggacgccctgccggtcaccgacgcggagaaggcctcggtggagcaggcggaaaaggaccataaggccctgctggacttcgcccaggagaccttgaagggagaggtatccaaggtgcgcatttccaagattctccagagcggggcggtctgcctgaccgccgaagggccggtttccctggagatggagaaatacttccgtaagatgcgccgggacttccccatgagtgcccagcgggtgttggagctcaacccggacgcccccgccttccaggctctgtgcaaggcctatgaggaagacaaggagaaggcggcggcctatgtggaggtgctctataaccaggccctcatcatcgcggacctccccctgcccgacccggcccggtatgccgagctggtgtgcggtttgatgaagtaatcacgcccaatgataaaataacaggtcccggccgcaaagggaggccgggacctgttattctgtgccgagcgcgtcaggacgttaatttttcgcggatgtaggttcccacctggctgtcctctacctggagaacaaaagagacttggtttgcaatgagaccctctgcccgctgaaggagggtctcatccgaggcgcccagcttcttgccggtggccaagagggaccgctttctgcgggagatacagaccaccaggcagatcagctcccgcagatcacaggctttcacaatggtttgaaagctggccaggcgggccttgcggtcttcgatccacgggagggggtgatctttgacggacaggatcagttggtctaattcctcccggttgggtaaccgggccattttctccaccagcgcgggactgccggtgggaacaaaaatggtggaggccgggttgctgacaggtttcaggatgtagaattccttgggtgtgcctttgccggcggggacgtccaggcggatgtcatccaccaggcagacgccgttgcaggcgtagcggacgtattcccctttgcggtatggttctgccatgttgaggtcctccttccaaattgagatgagccgcccggcggcgggcggaagaataaaaagcgacccaacaagcggaggtgcgttgtcaggccacttattaagtacagtatagcaaaaaatagagggaatttcaaagaaagatttgaggaaaaaagcaaaaaagtttgcaatgaatcaagttgccgcggaagcggttgtacactatgctgttttttaggaaaaaactgggcatgccgcctgtgagcaggcggcatgcccagtcatgtggaggggaccctttgtcccattggaaaccatctgcggccaaagggccgcatgcaggtttacagcgcctgcgcccaggccaccacggcggcttcgttgtcgtccggttcaccgtccaccttcaggggcgggcagaccagattggccccgcactcggtgaccttcttgctgaggatgtccgcagcccagcagaagtaatcctcatagttttccttgtcccccagaccaaacacggccacgttctttcccttgagcagggcgggggtcattctgttttcatagtaagggatgaagtcgtcctgcagttcgcccagacccatcgtcgagcagccgtacaggaccaggtcggcctctttcaccgccgtgtcgtcctttgcatcggttacatagatcacctgtacatcatacccggtcatggtctcagcgattttgtcggccacaatctcggtgttgccggtggtgctgccaaaaataatcgttgctttcttcatgatggaacactccttttttgcttcgagattagcttgtgctaaccttctgacttctaaaggttatcatatactaactgcgttgtcaagagagagtttgaaaaaagtggaggggagtgtgtgggggaaccgtcaagcagggtctgttccggcggggccgatgggggtggaggaagagagaaagatcacgcgatgcagttgacaaactttttcttgccccatataataaggaatggattcccctgagggagtctcattttcgtagatcaagtgaggtgaaacacaatggacgcaggcggtagtaacggcactttggcaggccgatgtcgaggacggagggcggtggcgccgggcaaggcgtccatgtgtcctcgttaacaaagctcggccgaccggtgtgtcttacttcctgctaagaaactggacgccaacagcgtcttgaaacgaaaaaagctgggaggagatgccaatggcagaaagaacggtcgtaacgctgggagagaccctggctgccctggtggagggcaaaaaatacgccacccttcgggatattcttgtcaccatgaacgcggtggatgtggcggggatctttgaggagatgcctgaggagaagctgcccctgctctttcggctgctgcccaaggagctggcggcggagaccttcgtggagatggagcccgaggctcaggaattgctcattcggggcttttccgaccatgaattgaaagaggtcgttgacgaactctacgtggacgacgcggtggacatcgtggaagagatgcccgccaatgtggtcaagcgcattttaagacaggccgacccggaaatgcgcaagatgatcaatgaaattttgaagtatcccgacgactgtgccgggagcatcatgaccacggaatatgtgagcctccggcccaatatgaccgcgggggaggccattcagcgcatccgctgcaccggggtggacaaggagaccatttacacctgctatgtgacggagaacaaccgaaagcttgtgggtatggtgtccctgcggaccctcctgttcagcgaggacgaggatgtgctggagaacatcatggagagcaatgtgatctcggtcaacaccctggaggaccaggagagcgtggcccagatgttcaccaagtatgactttgccgccctgccggtggtggaccaggaaaaccgcctggtgggcatcatcaccgtggacgatgccatcgacgtcctccaggaggagaccacggaggactttgaaaagatggccggtatggctccgtcggataagccctacctgcgtacgggcgtgtttgagacctggaagtcccgggtcccctggctgctcatcctgatgctctcagccaccttgaccagcatggtgctcaccgggtatgagacctctctggccgcctgctcagccctgatcgcctttattcccatgctgacgggcaccgggggcaacagcggtacccaggcttcggtggcggtgatccgcggcctgtctctgggggaagtggaattttccgacaccttccgggtggtctggaaggagatccgggtggcggttctctgcggcgtgaccttggcggcctgtaattttgtcaagctcatggtggtggaccgatttctattacacaacgaaggcgtcaccgtgctggtggcagcggtcatctgtgtgaccatggtgtttaccgtcctgtgtgccaaggcggtgggctgtctgctccccctgctggccgagcggattcacctggacccggcggtgatggccagcccctttatctccacggtggtggacgtggtcaccctggtgctctactttcaggtggcccgggcgattctgcatatttagggaacaaagccacctgcggcgctgtgtgcgccgcaggtggcttttcttgccagcggggggtcagccccggtaggctttgccggtgagggcgacggggtccaggcggagcaccgcggttttgtcaatctgctttgcaatcatctggaagccgatctcctcatagccggggtgcttctgggtgacaaaggcctccaatgcagcctgcttctccgcccggtcctccacgaagacggcctgcccggtgagaatgacgctctcatacgcggcggtgattttttcggggatgatccgggtgctgacaatggcggaaaaacagcacttgggattgcgctccaggcactggattttatagccgtagggagcggagtgaagatagaccttgtcatggacaacgatgtagttgacgggggtggcgtaggggtatccgtcgtcgccctggacagacaggattccgtggtcccctcttttcaggagctccagggtctcatcctctgggagctggcggctggccttgtgcattttgtgttccatgcttgcgtcctccttgctgatttgataagatgatcatagcaaagacagccggatttccctgttgcggctgcatcgtttggacattattttttacgcctgagggggaggtgaggaaagatgactgtggaggagctccgtgggtgccctctcttccgcgacattgcgcctgaggatttgcaggccatgctggggtgcctcagcgcccgggaggccgcgccccgccggggggacttcatcctgcggacccctgacgcgcatcccctgctgggtgtggtcttggagggggaggtggagatgatcagcgaggattctttcggaaagaagtcccttctgtccgtgctcccggtggggagcatctttggggagagctacacctgtgccaaggccaggaatcggaccatcgcctaccaggccagaacccacagccgggtgctcctgctggactatgggcggattctccacgcctgcaagctggtctgccggtttcaccaccggatgattgaaaacatggtggagctcattgcggagaagaacttgaccctggtggaaaagctggaggtggtttcccgcaccaccattcgggagaagctgctgacctacctggcccggcaggcggaggctgccggggcgcggacctttaccattcccatgggacgcaccgccttggccgagtatctctgcacagaccgctccgccatgacccgggagctggcccggatgagggacgagggactgattgactacaccaaacggacgtttaccctcaggcaatagcgcagccggctggcacggaacacaaaccgccccggcctgctttggggcaggccggggcggtaaatgggtgtatggggctgggctgcttaaaagtggaagtatccctgaccatgcccgccggtgcagtgccgcaccagcagggcggtggcggcgatcagagcgcccaggagcatcatcaaaagggcggtttccccgccctggcttgtggggccggtggccagaaaataaagtgcggaggcgatgatctgccagcggatcacgcattcccgggcatccgcctgagaccggtcccaggtgagcatcaccagcccgaccggcagcgcgaagaggatcaccgtcaaaatccagaagtacaacatgatttggcctcctttccagggtcaaaagaaggatacactgcatcacgtccgtccagcggttcccctgcggggggcgtctggagacgatggaatccggacgcacgctttctgtctctattatatcggaaagaagcggaaatgtccacttaaatttgtgcgaattggaatatttttgcctggaatttcacggcgctttgtggatgaggcccagaaagcagagcggagggtccgcctttacaaattcctttggccgtggtaggataaaagacagattcgcgcaagagaaaggaagatgtccatgaagcacgggttggtcatggaagggggcgctatgcgggggctcttcaccgccggcgtcattgatgtgatgatggaggagggcattggcttcgacggggccattggggtgtccgccggggctgtgttcggcagcaactataagtccaaccagccggggcgggtcatccgctataacctgcggttttgtcaggaccccaggtacagcagtttccgctccctggccaagacgggggatctgtttggggcggatttctgctaccgggagatccccgatcacctggacccctttgatcgggaagcctacgagagctctcctatggatttttacgtggtggcaacagatgtccacacgggaaaaccggtttaccacaactgtcggaagggggaccgggaggacctggactggttccgggcatcggcctccatgcccttggcggcccggattgtagaggtggggggataccagctgctggatggagggatttccgactccattcccctcaagtatttggaatccgtgggctatgaccggaatgtggtcattttgacccagcccatgggctatgagaaaaagaaaaacaaggcccttcccctgatgaaagcggcctattcacagtatcccgacctgctcaagaccatggcccgccgccaggatgtctacaacgagaccacggcgtatattcgggagaaagagcgccggggggaggtctttgtgatccggccggaggcggcgctgaagattaagcgggtggagcatgaccgggccaaaatccaagcggtctatgaccaggggcgggcggtggcccgcaagcgcctgcctgccctgcgggaatttttgcagaaggaggggaaagcaacatgacggaatctgcacgggaggcctgtttgcagggccttgccacagagtggcggaccatgacctatacctggcgggactgcgcgctgtatgccctggcggtgggggctgggggagcagagccccagtatacctatgaaagggacatgcaggccatccccacctttggggcaacgccctattgggggaccgtgaatgtcacccccaaactgccccggccccggtccatcccggtgctggtggaggagattttgaaaccagagcagtcctatgtcaacctggcgtatgaatttttgtatcaccgccccatccccccggtgaaggggagcttcgtataccgggatgtcctcacggacttgtttgaccggggggagggccggggcatggcggtccggtcccaggtggaggtgtttgatgaggggggaacccttctgtgcaccaaccggtgtaccaccttgttccctaccctggggggatatgggggccggccgatgccccggggggacagccccattccggaccgcccggcggacctggtggagcgggaccacattggagcggcgcagaatctgctctatcgcctgacaggggataccaacctggtccatgtggaccgggcggtggcggtcagccgcggcctggacgggccctttgtccatgatctgtgtgcctatggatatgcctgccgcctggccattgccgggctcttccccgggcagccggagcggctgcgccggatgtacgcggctatgaagacggtgctctatccagacaccccggtggagctccacctgtggaagcttgcccccggcagggcggccttccggctgtgccatggaaccaccgggaaggcaatcctggaccggggagagctggagtgggacgaagtagtttgaggcaacaaagaaagggatctcccatgggagatccctttctttgttggagggggtcaggcatgttcgtggacctttccggggtagagaatgaacttccgacccaggaaattccaaaagaacaccaaaatactgctgatgagcttggagaccataaaatagagctgaagccggctggtaaacagatacatcagcaccatggtgagcaccaaaccgccgccggagatggcggcgaagacaaagacttccgcggtggggcccacagtggggtccacagacttgaaggcaaagaacttcgtgagcagaaaattgcaggagattcccaccaggaaggagacggcggacgccggaagataatacagccctgccagctccagcagaaacaggaggagaaaatccaccaaaaaagaggaggcaccggtaatcacgtagcgaaacagctggatgatggtgttttccgtgggctcggccaagagcggacggaaccttccccgccgcagcagctgccagaaagccaaggcgtcctggatggtatgatcttggagcatgcgttttttcatgggtttcatgggaggtcggcggtgtgggcggcttccttgcggctctgttccagggccaatgcccggggcgggacatcttccaggtggaacaggcccatatcgtaaaaaatctccaggcggatttctccccaggccgggctggggtagtttccccgcatccaagtgtttttctggtgcacatcccggttgagaaagttttccaccaggtccaaggaggacagatggccgtattcgtggttgacaaattggcgcaggcactgctggagaaaggggaggacagcggggtcctcccgggtcagctgggcaaccttgtcgtccagatagaggtcgggaaaggggaaggcgctggccttggcataaccgtgctcccgggtccagtcccggctgtcgggatcggtccggcagattccggcagggcgaaagagttccatcgagatacctccctggagaagattgattgcggaagcaagtatactctctttttttccaaaagtaaagagaagataaagagaatggaaaaaaaaggaaaagttccatggggactccatggaacttttttcccaatcagacgccgacgcgctcttttcgcgagaggcagcccgccagaaccagcaggatcgcagagcccgccagaatggccagggggacccaggccgcagtctcctcctggaaggtgacctgtgtggcctctgcgggagcggcggcctctgctttcgggacctccgccagggtttccacggcgccgccgcccagcaggcccatggcctggggtccccaggagaacagcgtgtcatcggagagcaggcagacggtctggtaggttcctgtgccgactgcggcggcctgggtcaccgccgggacttgggcgggcagagagacggtgggggccgtctggtccagacccagctgctgggtgtcgttccgcccccaagtccagagggagccgtcagccaggatcacggcggtgtggctggtgcccgcgctgaccgcagtgacggggccggtggtggagagggaaaggggcagggtctgcagctgggcgccggtctggtcggtggtgtttccctggccgccgttgcccagctggccgtcgatgttgctcccccacagccagagggtaccgtccgcccggagggcggcggcgtggtagccgcccatgctgacagcagtcacctggtccaatacttttgccggtgtggaccggctcgcccgggtgccgtcccccagctgaccgaagaggttgtctccccaggtccacagggtctgatcgcccagcagagcggcggtggacccggccccggcgctgacggcggccgcctggtccaaaacctttgccggggcagaccggctttccaaggtgccgtctcccagctgaccatagaggttatccccccaggtccacagggaaccgtctgcacggagggcggccacatggtagtcgccggcactgactgcggtgacctggtccagaacacagatggggaggtcagagggggtggtactgccgttgcccaactggccgtagtcgttgccgccccaggcccacagggtgccgtcggttttcagagccacggtgaagtccgcgccggcgctcaccgaggccacgtcttccatgacctggagcggcctgctggacagaggaatgacggttccctccaaatcggttccggtctcttgggtttcggcccccagctgcccggactggttgctgccccaagtccacaggaccccctcctggtccacaaacgcggtgtgggacaggccggcgctcagacgaacgggggtatctggggcgcccatgtcataggcgctggcgggggaggagagaagaactgggagtaagagggctgcggcgatggaagcaagagtacggagtctcatccaatcgcctcctttccataaaaactgtgtaccatcaaaaaatgaatattttaatcaatatacagggaaaaaaccagtttggcaaggtttttttgtcaaatcccgtgtgcaatgactggaaacgggccaggtgtcagcctgccttatccatggggggtggggaagcttccaacggtgtggtggaagaaccatcccccgatgagggcggggagcaggggagagatggcctgcccgatccacagaccgggatagcccaaggcgagggggaaggccagacaccaacagacaggcaggcgcagcaggaagctgtccaaaagggcgttgaccaaggccaccttggcatggcctaaaccaatggcaaaggagtcaaggaggtacatggcagtgtagaacaggctgttgacgccgcagcagatctgaaagtagagaaccccggcggagaggacctccgggctgtctgatccaaacagctggagaatgggaagagaaaaacggtgtaccagcagcaggagaatcagggtgctggccagaccgcaccaaaggcccgtgcgggtgattttccgcacacggtccatggcgcccgccccagtgttctgccccaccatggcggttaccgcctggcccagggaccagcacggcatggcgaccaaggtatttaccttcagcccgatgccggccgcggcggcgacagacacgccgaatgtgttgcacatgcccgctaagatgcagtaggagaggtttaccaccatcatttgaagggccgtgggcaggccaattttgacaatggcggccaggggctggcggcggagcgtgaagcgggggcggcgggaaaccgccccatcctgccctctgcccagggagagggacagcagaagggaggctccctgagaggccactgtggcgtaggccgcgcccacggttcccagggccaggatgcccaccaggagaaggtccagcaggaggttgatggcggcggccgccgcgatgcagagaagggggactttggcgtcccctgttcccttgcggaaggcagagtgggccaggtaaccgaaggagagaggcgtgcccaggcagagcacacgcaggtaggcgctggcatctgtcatggcctcggaggggaccgacagcagttggagcaggcagggggcagtcagggcccctgccacagccaccagaagggagacgaccagggaagcggagaaaagggtccccgcggtttcctccaggccggtggtgtccttggcgccggcctgctgggcgacgcggaccatgccccctgtggtcaggcccgtgcccagggatgtgataagaaagcataccgtggaggcgctgctgatagcggccaatccggtctctccgacgattctgcccaccaccaaaaggtccacaagctgataaaaggactgcagcacattggccagcagcagggggagggtgtagagaagcagcggtctgccgatgggccccgccgtgaagtcgtagctttgtttcatggaaatcctgtcctttcaaatacaaaaacgcggagagcgtcacgctctccgcgtttcaaccagaaacggctgacccaaggaaaaacggcgcagagcatcgtccggcgccgtggtaaaagaagacagcagaaaaacatcccctcccaagcagacagcttagatgggaccagttttcactgtggaattgtgaactgggtcaggctccgtacaatgtgtttcattcccttgtccggagcccaggtccaggccgagcttgtttccccccatggggctcacaacctttctgtgcgacagcacgtttatcataccgttcttcccatggcctgtcaagaggcggcactgtcctgtggcgacaagaaaacctcccttgcctggggcaagggaggttcagaaaagcagagcgttgggggatttagattgcctccgcaatccggcggcccatttccgcggtgcccaccagggtgccctccccggcaaagaggtcgggggtccggtaaccttggtccaagacggacttgacagcgttttctatggcgtcggcctcttggcccagaccgaaggtatagcggagcatcatggcggcagagagaatggtggccatgggattggccttgtcctggccggcgatgtcgggggcagacccgtggacgggctcatacatgccgaaattgccctgggccagggaggccgaggggagcatgccaatggagccggtgatctggctggcttcatcagagaggatgtccccgaagatgttgctggtgacgatgacgtcaaactggcggggattgcggaccagctgcatggcggcgttgtccacatagagatggtccagggtgacctctgggtagtccttggccacctcggtcaccacccgccgccacaggcgggaggactccagcacattggccttgtccacactggtcacgtgcttgctgcgcttcatggccatgtcaaaggccaccttggcaatccggcggacctcctcctcggcatactgctcgatgtcgtaggcggcggggcccaggtctgtgtccttcacgcccttttccccgaagtagatgccgccggtgagctcccgaaccaccacgatgtccaggccgccggccagaatttccggcttcaggggggaggcgtccgccaactgttcaaagagcagggcggggcggaggttggcaaacaggcccagggccttgcgcagacccagcagagcccgctccggccgctggtccccggggagggtgtcccacttccaaccgcccacagcccccagcaggaccgcgtcggaggctttgcacacatcgatggtttcctggggcaggcagccgccggtggcgtcgatggcacagcctcccgccaggaccttgtggtactggaaggtgtggccaaatttttcccctaccttgtccagcaccagcagggtctgctccaccacgtcggggccgatgccgtccccgggaatgaccgcgagtttatagttcatggctctcagccctcctgtctcttcttgatatcggccatgaggccgccggcctgaatgatctctttgatgaagtcggggaaggggttggcctgataggtttcccccttggtggcgttggtgataaggccggtgtcaaagtcaatggacacctcgtcccccgcctcgatcttttcgctggcctccgggcactccaggatggccaggccgatgttgatggcgttgcggtagaagatacgggcgaaggtcttggcgatgacgcaggagatgccggactccttgatgaccatgggggcgtgctcccgggaagagccgcagccgaaattgaagccccccaccatcacgtccccggccttcaccgcgtggacaaagtttttgtcgatgtcctccatgcagtgggtggccagctcttttttgtcggcaatgttcagataacgggcggggataatcacgtcggtgtccacgttatccccgtatttgtgtacaaatccctttgcattcagcatgaaatgattcctccctggtcttagttccgcgggtccgcgatgaagccggccacggcggaggcggcggcaacggcggggcttgccagataaatttccgaggtgatgccgcccatgcggcccacaaagttccggttggtggtggcgacgcacttttctccgttggccatgactcccatgtggccgcccaggcaggggccgcaggtgggggtggagacagcgcagccagccgagatgaaggtggacagatagcccaggtcaatgcactgctggaaaatgtgctgggtggcaggcatgacgatgcagcggacatggtcggccaccttcttgccctccaggagcttggccgccacggccatgtcctccagccggccgttggtgcaggagccgatgaccacctggtcgattttgatctgtcccacctgggagatggggtgggcgttttccggcagatgggggaaggccacggtgggctcaatctggctcaggtcaatctccacggtccgcacgtattcggcgtcgggatcggcctcataggcggtgtagggacggttgacccgaccgtccaggtaggcccgggtgatggcgtccacggggaagatgccgtttttggcgccggcctcaatggacatgttggcgatgcacagccggtcatccatggacagggcggccacaccgtccccgcagtattccagactctggtacagggcgccgtccacgccgatcaggccgatcaggtggaggatgacatccttaccgctgacccagggctggagcttgccggtcaggtggacccggatggcctcagggaccttgaaccaggtctcccccgtggccatgccggcggccatgtcggtggagcccaccccggtggaaaaggcccccagggccccataggtgcaggtgtgggagtccgcgccgatgatacattccccggcggccaccaggcccttttccggcagaagggcgtgctccacgcccatctggcctacatcatagaagttgtccagatcaaactgccgggcgaaggtgcggcactggaggcactgctcggcggccttgatgtccttgttgggggtgaaatggtccatgaccatggagattttgctcttgtcaaacaccccggtaaagccctccttctcaaattcccggatggccacgggggaggtgatgtcgttgcccaggaccatgtccagcttggcccggatcagctgaccggccttgacctccggcaggccggcgtgggcagcgaggattttttgtgtcattgtcattcccatgggaaaagcctcctctttcttgtgggtgtgtcaaactgaaaccggagcggtctcagtcggtttcatgggtggggatgaattgcttcaccttgttttcccggttcacggcggtgatgagggcgtagaccgaggccatggtgatgtcgctgtcgacacccaccccccagtagtggttgccctcctcatcggcgatgaccacgtaggccgaggccagggagtcggagtcggtctccagggcgtgctcctcatagtccacaaactggtactggatgttggggttggcgatcttcagcacattgctcaccgcgtccaaggggccgttgccccgggcgctgaggtagtacagctcgttgtggatggccagggtggcatcggcgacggtggagcccttctcccgaatccaggagatgtcctggagggcgatgggcacgtccttgttttggtactcatgctggaaggccaccagaatctcgtggggggtgagctccttgtgggcgtggtcggagatgcccttgatgaagtagcccacctcggcggccatctccttgggcaggtcgtagccgaagttgtgctccaggatataggagatgccccctttgcctgactggctgttgatgcggatgacatcggtctcgtattcccggttgacgtcgtgggggtccagggggagataggggacggtccagaagggctcctgacgctcctggcggaacttcatgcccttggagatggcgtcctggtgggagcccgagaaggccgcgaagaccaagtgaccggagtagggctggcggtagcccacggacataccggtgagctcctcatagaatttcaccgtcttgggcatgtccgagaagtccagcttcgggtccaccccgtgggtgaacaggttcatggccatggtgacgatgtccacgttgccggtgcgctccccattgccgaagagggtgccctcgatgcgctgtccccctgccagcagggccagctccccggcggccacggcggtgccccggtcgttgtgggggtggatggagacaatgacgttctcccggctgtggagatgcttgctcatgtactcaatctgctgggcatagacgtggggcatggacatctccacggtggaggggaggttgatgatgaccttccgttccggccggggctgccagacgtcgatgaccgcgttgcagatccgcagggcaaactccacctccgtgccagtgaagctctccggggagtattcaaagcggaagttggtctcgggcattttgtcggcgtactcgttgaacagcttggccccggagacagcgatgtccacgatctcgtcctccgccatccggaagacctgctgccgctgggcaaaggaggtggagttgtagagatggaccaccacgttcttggcgcctttgatggcctcaaaggttttttgaatgatgtgggggcgggactgggtgagcacctggatgtacacatcgtcggggatcagatggtcctcgatgatggtccgcagaaattcatactcggtctcggaggcggcggggaagcctacctcaatctctttgaaccccacgtccagcaggaagcggtaaaaggccagcttttcctccagattcatgggggtgatcagggcctggttgccgtcccgcaggtccacgctgcaccaggcgggggcctcagtgagccggtccttcttgacccagtccatacagggttccgggggcatgtaatacccagggcggtacttttcaaagtttttcatgggaaacacgatcctttccgagataggcggagaggataaaaaaagctccgcctctttttcgatcaaagagacgaagacaaagattctccgcggtaccactcttattggcgtccagcaacgcccactcaaatagttcacactccggggtgagacgccagctcgctccatacggctttgcaccagacagccgctctctgggatggaggcagaaaaggcatattcccttcattgtgtgtcggtattcaatttcactgcttacaggatagccgatgcaccggcgtttgtcaatggggaagcgtcgaaaaaataaataaaagccggtgagattttcagaggatgcagggcgacgtgtccccctctccgtaggaaaaagctgccgacctgctgcaatctgcacaaagggacaggaacggggaaaaagaaattttatgaagagaaaaataggaaatgcaaactttccctttactttatcgaagtagagtgatagtatactaaacaacggaagaaaggggagcataccatgcaactggattggacgatcctgcgcagcggggaacagatcatgtaccggctgcgggggctgtatgagcggtacggctaccgccggtttaagatgagcaagtttgaggagtatgatttatacgtacgcaataaggattttctggtcagcgatcggatgattacctttaccgacgcccgggggattctcatggctctgaagcccgatgtgaccttgtccatcatcaagaacacccgggcggaggaggcgggcccccgaaaggtctactacaatgagagcgtctaccggtccggccagggggaggagaccttccaggagatcatgcagaccggcctggagtgcatcggggaactggacctctatcacatttatgaggtgatcgccctggcggtggagagcctgagggccatccatccggactatgtgctggatgtgtcccacatggggctggtctccggttttatggaggcggctggcgtgacggaagcggagtatcccgaggtgatgaccgccgtccgggccaaaaacctggcggggctggaggacttctgccggcgccggggcctcagcggcacggtgcaggccctgctggagcgcctggtgaccacctacgggaccatggaggcggtgctggaggaactggcccccctgtgcgtgggaggcaaaaagacccgggaggcctgggaggagctcaacagtctctgcggcctgctgaaggccaacggcttggccgagcgggtctatctggacttttctgtggagggagacatggggtattacagcggcatcgtcttccggggctttttgaaaaatctgtctgcgggggtgctctccgggggacagtatgataaaatggtggagaagatgggcaagccctgtggggccatgggatttgccatttacctcaatgaactggagcggctgggtcccgcccagcccccctttgacgcggaggttctggttttgtacgacgaggcgaccgatttgaaggacctcaccgcccggttggcggcgctggccggacagggaaagcgggtcctggcctggcggcaggccggcggggcgctgcgggcgcgggagacgatggatttgagaggaggccggacgacatgaaggaatttctcaacgtggctctccccaagggacggttgggggagcgagtctatgccatgtttgcccaggcgggctttccctgtgaggaactgctggaccccaagcggaagctgatttttgaaaatcctgaggccggtgtgcgctacttctgggtcaagccgtcggatgtccctgtctatgtggagcggggcgcggccgatgtgggggtggcgggaaaggacattctgctggagtacggcccagaggtttatgagctgctggacctgaacatcggcaggtgccggatgtgcgtggcggcaaagaacggctttcgggacgacccggagcggaccctgcgggtggccacggagtttccccacatcacccggacctattacaccgcccgaagccgggacatcgacatcattcggctccacggctccattgaaatcgcgcccattttggacttgacggacgtgattgtggatattgtggagacggggaccaccctgcgggagaatgacctgacccccattgagaccattgtccccatcagtgcccggctcattgccaacaaggtgagtttccaattcaagcacaaggccatccagaccctgtatgaggggctgaaggaacaggtggcagcccaagagaaggaggcagaggagacatgatacgcattctaaaggaagcggagaccaaccggggagagatctttgcccgggaggacccggtggactcggtggaggaaccggtccgggccattctggcccaggtgaaagcccggggggacgaggcgctgaaggagtataccaaggcgtttgacggggtggaactcacctccttggaggtgggccccggggcggtggacgagggcttccgcagcgcggacccccttttggtggagattctctatcgggccgccgagcgaatcgccgccttccaccagcaccaggtccgcaacagctttttggtcaatgaggaggacggcatcctcatggggcagaaggtcctccccctggcgcgggtggggctctacgtccccggcggcaccgccgcctatccctccagcgtgctgatgaactgcatccccgccaagctggccggggtaaaggagatctgcatggtgaccccgccggggaaaaatgggaagattccccccaacatcctggcggcggcccggatctgcggggtggaccgggtgtttcgggtggggggcgcccaagcggtggccgctctggcctacggcacggagagcatccccaaggtagataaaattgtgggtcccggcaaccagtttgtggcggaggcaaagaagcaggtgtttggccaggtgggcattgacatggtggccggccccagtgagattctggtgattgccgatggcaaatgccgcccggagatcgtggccgccgacctgctcagccaggccgaacacgatcccaatgcctccgcggttctggtgaccgacagcgcggcgctggccgaggccgtccaggccgctgtggaggaacagctgcccaagctgctgcggaaggacatcgcccgggcctccattgaccgcaacggcaagattattgtggcccagtctctggacaccgctgtggagatcgccaatgagatcgccccggagcatctggaactctgcgtggagcagccctttgactacctggacaagattcagaacgcggggtctgtctttttggggcgcaactgcccggaggccctgggggattacttcgccgggcccaaccacaccctgcccaccagcggcaccgcccggttctccagcccgctgtctgtggacgattttgtaaagaagatgcagtatacctactataccaagagggccctggagaaggcccagatgtccgtgtccaactttgccaagaaggagggcctcaccggccacgcccgcagcgtggacatccggtttgaccccgcctttgccgaggagaccccatgagccgatttttgcacaccaggtacgcgggcctggagacgtacacccccggagagcagccccgggacaagcagtacatcaaactcaacaccaacgagtccccctatcccccctccccggaggttctggcggccctgggcccgggggaggtggcggacctgcggctctactccgacccagagggggccgggttgcgggagaagctggcggggctgtacggcgtgacgccgggccaggtctttctgtccaatgggtcggacgacattttgaacttcgcgttcatggcctttggggagaaaggcgcggtatttccttccctgacgtacagtttttaccctgtgtttgccaacctccatcaggtgccctatgagacggtccccctccgggaggacttttccgtggatgtggcggggctgtcgggaaagggaaagctcacggtgctggccaaccccaacgcccccacgggtctggcgctgcccctggatcaggtggaggcccttgtggcctccaatcccggccatgtggtggtggtggatgaggcctatgtggacttcggcgccgcgtccgccgcagcgctgctgggtcggtatgagaaccttttggtggtgatgacctattccaaatcccgttccatggcaggggcccgcctgggctttgccctgggcagccgggaactgattgcggatttggagcggctgaagtatgccaccaatccctataatgtgaaccggctgaccttgcggctgggagaggccgcggtggattccgatccttacttccgagccaacgcccggcggatcatggccacgcgggacaagaccgcccgggccctgcgggagatgggctttcgcctcccggattcccaggccaattttctgtttgtaacccacccccggatagacggggcccggctgtatcagaagtgcagggagcggggcattctgatccgccatttttccgacccggccattgcacagtataaccgggtgaccatcggcgcggaggaggaaatggagaccttcctgacgatggtgagagatattctgcgagaggagggcctttgatgcggaagagcgagattgcccggaagaccggggagacagagattacccttcagctgaacctggacggcacggggcagtatcagattcaaaccggcgtgggctttttggaccacatgctgaccgggtttgcccgccatggttcctttgacctcgccgtgcagtgccagggggatacctgggtggacgaccaccacaccgtggaggatgtggggatctgcctgggacaggcctttgcccaggccctgggggacctgcggggggtggagcggtttggacacagtgttctgcccatggacgaggcactgatcctggcggcagtggacctgtccggccgggggatgctctgctgggatgtgcccatgcccacggaaaaggtggggacttttgacacggaactggtcaaggagttctggctggcctttacccgcaaggccggctgcaccctccacctgcgcaagctggcgggggagaacagccaccacctcattgaaggggtgttcaaagccgccggacggagcctgaagcaggcggtggcccggaccggacgggatgaaatcccgtccacgaaaggaagtcttgtatgattgcagtcattgattatggcgtggggaacctcttctccctctgccgttccctggaggccgttgggcagacgccggtggtcaccggggacccggcggtgctccgccgggccgataaactctttctccccggggtgggggcctttgccgacgcggcggagaagctccgccggaccgggctggaccgggtgatccgggaggaagcggcccagggcaagcccattctgggcatctgcctgggcatgcagcttttgtttgaggagagccgggagtttggcacttggcaggggcttggccttctccccggcaaggtggtgcctatggagggggttgttccccaggcgtataaaattccccacatcggctggaacggccttcattttcccgccggccggcggcatcccctgctggccggggtggaggagggggactgtgtgtattttgtccactccttttatgcggctgaatgtgacgacgtggtcatcgccacggcggaatacggagcccagctcaccgccgcggtggcccggggcaatgtcatgggctgtcagtttcacccggagaagagtggcacggttgggctgacgatcctgaaaaccttctgtgagggggaatggtgatatgatactcttgcctgccattgaccttttcggcggccaggcggtccgcctgtaccagggggattacaaccagatgacggtatacgacccggaccccctgcacaccgtccgccagtttgagcgggcgggggccacccacctccacctggtggacctggaaggggccaaaaccggccggaccaccaacctgcctgtcatccagcgcatcgccgcccaaaccaatttgttgattgaggtggggggcggcattcgcaccatggacaccgtccggcgctacctggaagccggggccagccgggtgattttgggcaccgctgcggtcaccgacccggcgttcaccgcccaggcagtggcccaatatggggagaaaatcgctgtgggcgccgacctgaaggacggcaaagtggccatcaagggctggctggagaccagccaggacagctgggagacgttttttgaccgtatgcaggccctgggggtgcggacggtgatctgcacggacatctcccgggacggggcgatgaggggggccaatctggcgctctatcgcaccctggccagccgctattccatggacatcattgcctctgggggggtgtccagtctggaggatatccgggcgctgaaggaggcgggggccgccggggccatcatcggcaaggcctactataccggcgccatcgacctggcccaggccattgccctgggggaaggaggagaaccatgattaccaagcgcatcatcccctgcctggacgtgaaggacggccgggtggtcaagggggtcaactttgcggggctccaggatgtgagctcgccggtggagctggcggaatactacacccggagcggggcggatgagttggttttttacgacatcaccgcctccgccgaggggcggggcctgtttcccgacattctgcgccggacggccagccgggtgttcattcccctcaccgtggggggcggcatcaataccctggaggattttgaccgggtgctcaagtgcggggcggacaaggtcagcgtcaactccggggccatccgcaacccggacctgatccgtcaggcggccctgcggtacggcagtcagtgcgtggtcctctccgccgatgtgaagcgggtggatggccagttccgggtctttggccggggggggcgggatgacacggggatggaggccatcggctggatcaaacactgtgtggacctgggggccggggaggtggtggtcaactccattgacaccgacggagtcaagggagggtttgacctggagatgctggccgcggtgtgccaggcggtgaaggtacccgtcattgcctccggcggcgcggggcgggcggaggactttgtccggctcttccagaccctgcccggggtggacgcgggcctggcggcctcggtgttccattttggagagattgccattccccacctgaaggcccagctgcggcaggcggggatttcggtgcgataagattgggaggaaccaccatgattgacatggagaaactgaagtttgacgagaagggcctcatccccgccattgtggtggatgggaccagcggccaggtgctcaccctggcctatatgaaccgggagagcctggccatttccatccgggaggagcggacctgcttctggagccgctcccgccaggaactgtggcggaagggggagacctccggggcggtgcagcacatcatcgacatcaccgccgactgtgactgtgacgccctggtgatccgggtgaacaaggaggggcccgcctgccataccggggcggagtcctgcttccacaaccttctgtttgagagccgggagaacgcagccttttccctccagggtttgatggaactgctccagggccgaaaggaccagccccaagaggggtcctacacctcctacctttttgacaagggactggacaaaatcctgaaaaaggtgggggaggaggccaccgaggtcatcatcgccggcaaggcggaggacaggaaggagaccgtctatgagattgccgacctggcctaccacgtgatggtcctcatgctccagctgggcatctccctggaggatgtggggcgggagctggcctcccggcacgtcattgacaagaaggtcaagcaggaaaagatgacctaaggcaaggcagagcaaaaaaacagcgtttcgcggagaaagcgaaacgctgtttttctgtacggtgatccggcgcgtcattggttggaaagtatacggcgtaagtccgacaggatggtctcaggactgggagaggcgatggaataccaagtggagtcataaccgcggctgcaacgattgatgtctgatgtaccaagggtacagtatagagattcattttgggagtctccaatactgaaataaattgcaactcttgataaggaaaaatggcgcttatcagagaatggcttccggcgcatcgtgcactgatgcaggtactctaatatctcctgttcaacgtcgtcgctgatggagatatcaaggggaatgctgtcgggattgccaaaatcggggtttaccatgatccattcaatttttgaagaatctggatgggatacgatggggactggaatagagaagaaaaggatcacggcaatgacgagggcgaggcagacaaaaagaaaaatttttttcatgtcaaacacctcctacaagggacgacacaggtcgcggtttggcaggatttcatctgtcacttcattataccttggccacacagggggcgcaagggtgacatggaccatgagaagtggattttgggggattctgtgatctgccctgttttgcgcttgtaatcgcttaaaatacaaggcttttcctattgtccacaggtacacgtattttcttggactttataacatcgctatgctacaatgaagtcaatggcaaatcggaatttggaggaaaggaaatgactttaaatagaatagatcattttgtaattaccacaaaaaatttgtgccaatgtttgcacttttatgttgacattctcggaatggaacataaaattcaaagggaagagaacgatcagcatacgcttcattttgggaatcaaaagattaacattcatacgtatgtaggcgaatttcagccgacggcaaaacatgctgaaagaggttgtgctgatttttgtctgattacaaatgatgacatcaatcaagtgaaaaaagaaatggaaaggaacggggtagaggtgattgcaggtattataaaaactgaaggagcacaaggtgaaatgaagagtatctatgtgtatgacccagacggaaatcttgttgaaattgcttcttacctctaaaaggcaacttctgatttgtcggggagatggcaaaggcagctgagccaatcatcggcaagatgaacaggcgcataaatgcactgtcggtggcagctctccccgcttttctggtgggcaatcagggtgagaaagctctaaaatggatttcccaaccgtttcaattttgagaaaagatcataagcaatgtcaaaattaataaaaattcagtatggtagaaacaatatctttcctgaaaaaatcagacgggaaaagacgaccagatcatcaaacaccaagaggaaacgagccgtggaagatcaaccgtcagttcctctggcggcgggcccctggcaacggtcccggttcaattccctcttgacgggtggggaaaagcgtggtaaaataacgccagcatgaaggaaggaatggtttgctatgaaacaccagaccatcagcatgaacagcgcattcgcctttacctactattactttatgacctccaagggaatagggtaatggcaatttgtgctggagaaaattgatgggtccttctgtttgagaagatcacgacacgccacacagattccgttctgtgtggcgtttttgttgttcagagccgctgccgggagcggagcccagtggcggggataggaaaggagtaacagaaccatgattgcagtcttaaagcccggcgcgtcaccggaacgcacccagcatctcatccactggctggaggagcagaatttaggggtccatgtctcccaaggggagtaccagacagttttggggctcatcggcaacaccgccaaggtggatatggagatgatccagagcctggacattgtggagtcggtgacccgggtctccgaccccttcaaggcggtcaaccggaagttccacccggaggactctgtcattcaggcggggcccgcggccatcggcgggggccattttgccctcatcgccggcccctgctcggtggagacggaggagcagatcacctatgtggcccagcaggtcaaaaaggccggggccgccttcctgcgggggggcgcgttcaagccccggacctcgccctatgacttccaggggctgggagaggagggcatccgcctgctgctggaggccaaaaaggccacggggctgcccattgtcacagagctcatggatatccgaaacctgcccctgtttgagcaggtggatgtgatccaggtgggcgcccggaacacccagaactttgacatgctcaaggaactgggcaaaacggacaagcccatccttctcaagcggggcctggcgggcaccattaaggagctgctgatgagcgcggagtacatcatggccagcggcaacgaaaaggtcattctctgcgagcggggcattcggacctatgagtccacctacacccgcaacaccctggacctgtcggtggtgccggtgctcaaggggctgacccacctgccagtggtggtggaccccagccacgccaccggccatgcccacctggtggaacccatggccatggccgccgccgccgccggcgccgacggcattatgattgaggtccacaacgatcccccccatgccctgtgcgacggcgcccagtccctgaccccggagcagttcgcccacaccgccggaaagatcttccggattcgggaggcgatggagggatgaccgtcggcatcatcggcctggggctcattggaggctccctggccaaggccttctgccgggaggagggaaacaccgtcctgggctgggacacggacagtaccatcgtggagtttgcccagatcgcccaggccatccacggacccttgaccgatgagcgtctgggagaactggacttgctgctgctggccacctaccctgaggcggtggtggaacacatgacccgtctggcgccgctgctgtcgaagcacaccatggtgattgactgcgcggggaccaaggagaaggtgtgtgccggcgtgtttcccctggcggagcggtatgggttccgcttcctggggggacaccccatggcgggcacccatttctccggctttaagtacagccgggcggacctctttgacggggccccgatggtcatcgtgcccccccgatttgatgacatccggctgctggacgaggcgaaaaagctgctggctcctgtgggctttgggcgggtttccattaccacggcccaggagcatgacaagcggatcgccttcacctcccagatggcccacgtgatctccaacgcctatatcaagagccccacagcccgcaaccacgacggattctccgccggcagctacaaggacctcacccgggtggcctggctgaacccggcgatgtgggccgagctctttctggagaaccgggagaatctgcttttcgagctggatacgctgatccggtctctggaacagtatcgggaggccatccaggaggatgactttgccgccctctgccagctgttggaggagggccggagaatcaaggaggaggtggacgggacatgaccaccgtcacggtaagggcttcccggccctacgaggttaccatcgggcgggggctgctggacactgtgggccggcaggccgccggacagtggaagggtcggtccgccgctgtcgtctctgattctacggtggcgcccctctacctgaatcgggtgaaggacagcctggagcgggcgggttttcgggtccattcctttgtctttcccgcgggggaggaccaaaaaaacggaggaacctatctcaaactgctggagtttttggcggcacggcgcctcacccgggccgacggcctgattgccctggggggcggcgtggtgggggacctggccgggtttgccgccgccacctttctgcgggggattggatttcttcagctgcccaccaccctcttggcggcggtggactcctctgtggggggaaagaccgccattgatctgaccaacggcaagaacttagcgggggcgttttaccagccccaggcagtgctgtgtgacttggacaccttggacactctcccggcagaagttttcgcggatgggtgcgccgaggtgattaaatacggcatgattggagacccggccctgctggcgcggctggagacagtcgatttccgggccgacccggaggaactggtggcccggtgcgtggcccagaaacgggacctggtggagcaggacgagtttgacaccggcgcccggcagctgctcaacctgggccacaccctgggccatggggtggaggcttgcagcggatacacggtttcccatggccgggcggtggccattggcatgaccctggtcacccgggcggcagtcgcctttggcaggtgccccgccgaggtgctgccccgcctgcggcggctgctggagcggtatggcctgccggacgccaccgcctattcggcccaggcgctgtatgagaaaaccctgtcggacaaaaagcggtccggagacaccatttctctggtggtacccattgcctggggcgccagccagctggtgcggattcccgtgtcagaactgccggcgtggatagaaagggggctgggcctgtgaacgtcaccatacagccgggagcggttgcggggaccgtagccgccattccctccaagtcggcggcccaccgcctgctgatctgcgcggccctggcagaccggcccacccgggtgatctgcccccagctctcccaggatattgcggccacggtccggtgtttggaagggctgggggcacagctccggcgccagggggagggctatgaggtgatccctctggaccggacaaaaccggtgggaacctgcctgctggactgtggagagagcgggtccaccctgcgctttctcctgccggtggcaggggccctgggggccgaggccacggtgcgaatggcgggccgcttggcccagcgccccctggggcccctggtggagcagctgcggaagggcggctgtgccgtgaccctgtgggaggaggagaagcgtctgaccatctccggccagcttcgcccaggggagtaccatctgccgggagatgtctcctcccagtttatctccgggatgctctttgccctgcccctgctgccggatggcagccggttggtggtggagggcgcgcgggagtcggccagctatctccagctgactctccgggccctggcgacctttggcctgacgcccagagagcaggaggagggctggacgattgcttcccaggggtacgccagccccggcgtggtacaggtggagggggactggtccaacgcggccccctggctctgcctgggcatgctggggggagagggcgtcaccgtcaccggaatggacctggattccctccagggggacagggcggtctgccgggtgctggcggcaatggggggacaggtccgtaccgccgccgaccgggtgactgtactgccaggaccccgggttcccacgagaatggatgcccgcgatattccggacctggttcccgttttggctgcggtggcagctgccacccccggcgtcacggagatcaccggggccgcccggctgcggctgaaggagtcggaccggctggagaccacagcgcggatgctgaacggcttgggcgggcaggtggaggagacggcggatggacttctcattcggggaaggtcccacctgtccgggggacaggtggacgccgcaggcgaccaccgcatcgccatggcggcggcggtggcgtcaggggcctgtaccggtcctgtcaccatcaccggtgcccaggcggtggagaaatcctacccgacgttttgggcggagctccggtccctgggaaagcaggtggaggaaacgcccgttgggccttgacggaccgcctgggatatttcataatgaggatagcgcgatgagcagtatttatcacggtcagctgaccgtttccatctttggtcagtcccacgccccggccatcggggtgacggtggacggcctgccggcgggtgagccggtggacctggaggagctccaggtctttctgaaccgccgggcccctgggacggggaactggtccacccctcggaaggagggggaccagccggagtttctgtcggggctcagccaggggagaacctgcggtgccccgctgacggcggtcattcgcaataccaatacccgctctggggactatgctgatctccgggacattccccggccgggacatgccgactataccgcccaggtgaaatacgggggctttcaggatgtggcgggcggggggcatttctccggtcggctcaccgcccccctgtgtatcgccggcgggatctgcaagcagatgttggcccgtcggggcatctgggtgggggcccacatcgccgccatcggaggaatttgggaccgggcctacgatccggtggccctctcccgggaggacctgctggcccccggcaggacgcggttttccgtccttgccccggaggcgggggagcggatgcaggcggccattgccgcggccaaggccgaccgggactctctgggcgggatcattgagtgcggcgtggtgggtctgcctgccggtctgggggaccccatgctggacggaatggaaaaccgcattgcccggctggccttcgccattcccgcggtcaagggcgtggaatttggcgcgggctttggcgtggcggccctgcgtggcagccagaacaacgacccattttacatggacgggggacaggtaaaaacccgaaccaaccacgcgggggggattctgggcggtatcaccaacggtatgcccctggtattccgggtggcggtaaagccgaccccttccatcgcacagccccaggacagcgtcagtctgtcccggggagaaaataccaccttagagatacacggacgccatgatccctgcattgtcccacgggctgtgccctgtgtggaggcggcggcggccatcgccgtctgtgacgcgctgttggagcagcagagaaggagtgaactgttatgaacttagaggaactgagaacagaaattgatgccattgacgacaccctggtcaacgcctttgcccagcggatggacgtggtggcccgggtgagccaggccaagaaggagcagggactgcccaccctggaccctgcccgggaacgggccaagctggcggacatcgcctccaagctgcccccggagctggcgcagtacggctatgccctgtggtccatgctctttgagatcagccggggctatcagaacgccatgaatccccagccctccgccctgcgcaaggagattgagggggctatggcatctacccccaacctcttccctccttctgccacggtggcctgtcaaggggtggaaggcgcctactcccagctggcctgtgaaaaactcttcaagcacccccaggtgatgtatttcggcagcttcgagagtgtgtttagtgccattgagaacgggttctgtgactatggggtgcttcccttggaaaacagcaccgcgggctccgtcaagcagatttatgatctgatgctccgccacagcagcttcaaaattgtccgctccacccgcctgaaaattgaccataacctggtggccaagaagggcactaagctggaggacatcaaggagatcttctcccatccccaggccatcagccagtgctcggcctatctggaaaagctgggtaaggatgtgaagatcaccccctgtgagaataccgccgccgcggcggaggctgtggcccagtcggaccgaaaggatgtggccgccatcgcctcccacagctgtgtggccctctatgggctcgagcgcctggccgcggacatccaggaccggagcaacaactacacccgctttatctgcatctccaaaaagctggagatctatcccggcgcggacaagacctccctcatggtggtgctgccccaccggcccggttccctgtaccagattctggcgcggttctatgccctggggctgaacctcatcaagctggagagccgccccctgcctgaccgggagtttgagttcatgttctactttgatctggagacctcggtctattccgacgagtttatccgcatggtggacgacctgtccgcggtctgtgaggagttccagtacctgggaagttacagtgaggtgatttaatgcgatgcggattgttgggagagaagctggggcatagctattccccggaactgcatgccttttttgggaactatgactatgagctctttgaggtccccccggaccaactgggcgattttatccgggcccgggattttcagggcttgaacgtgaccatcccttataagaccaccatgctggccatctgcgacgatctcaccgaggccgctgcggccatcggcagtgtgaacaccgtggtcaagcagctggacgggtctctgctgggggacaacaccgacgcggccgggtttgagggcatggtctggaagagccggatgcggattctgggccggaagtgcctggtgctgggctccggcggggccagcctgtcggttcagtatgtcctgcgaaagctgggggctggggagatcgtggtgatctcccgcaccggcgaggacaactataccaacctggaccggcatcgggacgcctccatcctggtcaataccacccctgtgggcatgtatcccaacaccgctgcgtcccctgtggacctgcgggaatttccccagtgcgagggggttctggacctgatctacaaccccgcccgcaccgcgctgctccagcaggcggaggcattggggattccctgtctgggcgggctgtatatgctggcggaacaggcccggtgcgccgcccagatttttacgggagaggtcatccccgccatccgcaccaaggaggcctaccacgccctgagccgccggaaggagaaccgaatcctgatcggtatgcccggctgtgggaagagcaccgtggggcaggcgctggcccagcgcctggaccggccgtttgtggactgtgaccaggagctggaaagaattttggagatgccggtgggcgagtacatcacccactatggggaggaggccttccgggcccaggagaccgccctgcttacccagctggggaaggcgtcgggactggtgatcgccacaggtggcggttgcgtgacccggccggagaactatccccatcttcaccagaacggcgccatcatcttcctggagcgggagctgtccaagctgcccaaaaagggccgccccctgtccctgcgggggagcctccaggatatgtataccatccgtctgcccatgtaccggcggttcgcggacatcaccgtggccaacgacggcccggcggagactgtggcccagaccgtggaggaagcctatgaacattttagtgattaacggccccaacctgaatctgctgggggtccgggagccggacctctatgggaaacaggactacaccgccctggtggccctggtggaggagacctgtgcccaggaggggatggaggtggaggtattccagtccaaccacgagggggccattgtggaccggattcaggcggctctggggactgccgacggcattgtaatcaatcccgccgcctatacccacaccagtgtggcgattttggacgcgctgaaggcggtgaacctgcccgcggtggaggtgcacatctccgatgtctcccagcgggaggacttccgccaggtttcctacgctggcatggcctgcgtgcagacctacatgggattggggctggagggctaccgaaaggccatccttttcctgaaggactatttgcagcaccgctgacacagaaaggaaaacggccagactgtggtcaattccacggtctggccgttttttgtcttgtcatggttctgccgcgatccggcggcggatgtagtcctccagaaaatccgtggtgccggagagccccaggcgggaggagttgatggtgaggtcataggtgtccccatgtccccactgggtgggacagtgttcgttgtggtaggcggcgcggcgcttatctcccttgcggataaactccagcgcctcgtcctgggtcaggtgatgggcctgctggatgctggccacccggtctgccaggtccccccggacgaacagagagatcagcccgggaaactcccgcagaatgtaccccgagcaccgacctaagacgacaaaggagtcccctttggccgccttttcccgcaggaagagaaactgcatgccggccagtcccgcctcggcggagttgctgaggccccggatactccgggaaaggtagggatgccggggcgcctcttcatactttcgcagcgtctccgggtccagctcccgctgggccgccagctcggcaatgagatttttgtcgtacagcggcagggagaaccgctccgccagagcctccgcgatcttatgaccgccgctgcccacctgtcggcccagggaaatgatcagttgcttcatggcaaaccctcctttttgtcgctttcttttcctccattatggcaaaggcgcgaagaaaaatcaatgtgaaaggacgggaaaacccttggttttttcttaaaaacacgtttttaagacgtacacttgtccataaaaaaggagtggcgtttctgactgcccagatgggaacgttgacagagcaaggacaaaaatgctatattctgaatagaacatatgttctaatttggcaaaataaaggaaaatgtttagagcaaatggagatgattcatgagaaagcaggcaagcaggagcagtccgcctaagcagagattacataccgtaaagcaaagaagatatttcttccgctggtcggggtattctttggcaacaaccttgtaggaaatgaggctggccattgaggcgatgagagaaccaagtccccctaagttacatccgatcatcagtgcttgccattgggaagtaaacccggatagtaatagagcggttggtacattgctgatcacttgactggtcaacatagccaccggtgccacgtgatttgtaaggagggaggcaaggaaagtctggaagtcaccaatgcatccgaggtttccaatgaaaataaaaagagcaaaaaatgttcccagaagggaatagtcaaggtcagccagtacacttttgtctgtgaaaaaaagaaaaataaaaatgcaaagggcgatgagaataggagggatggtttgaaaaatccctaaaagacatagggagaagccgacggaggaacatagaaagcactttgggtccggtggctttgctggggagaaagacatcggaacggaggtggacctccggaaaaggatgagaagcgtcaagcagagcgcggatagtaagacatagggaagcatgagttggcagagttgtccaaaatgaaggttaaacttggtatacaggtatagattctgggggtttcccatcggggttagcatactacctaaatttgcagcgacggtttgcatgacgaccagagggactatgagggattcttgatttgccatttgcagcacggtgagaccgaaaggaacaaaaataagtaaggaaacatcgtttgtaattaccatgctggagataaaaggtaaaaaaacgagagagaatagcattttccgggaggtagtggctctcttgattaagtgattcccaaggtagagaaacaatccggctttttgaaatcctttggtaactgccatcaggctaaacaaaagaaatagtgtgtcccaatcaacataggcaatgtaagaaagattgggagggacaatcatggagaagatgagagctaatgcaattgcgatacacagaatcgtttctttctgaacaaacccaatacagcgttttacaaattttgacataaggacatgaactccaggaaaaggaaagaaatgaaaaagtgaccgattataaaatcgatcactttcttgtggtggaggaggatggattcgaaccatcgaagtcgtcgacaacagatttacagtctgccccctttggccactcgggaactcctccatatgaaattggagctggtggacggactcgaacccccgacctgctgattacaaatcagctgctctaccaactgagctacaccagcataggtactcatccgcagcgaggattagtctaacagatggcagctgttttgtcaatagttttttgaaaaaagaagggattttttgtggagtgaaaccggaggcaggtggggaaggaggacatggaagctgaggagaaggcagagtgggtttccctttcgggacaagcagcgggatttcccctgggcaatctgccccgtatgcggacaggaacagtatcaggaggatctgccgctggaggaaggccggtgcctggcgtgccggcggcgggcgcgtaagagagaggaggatgctatgacattgcgggagatgtccgtggagtaccgggcccaggcccaggcgctccggggacggatgcaggagctggagaaggcgtggaaacagacgaaggacccggcggagcgggccaatttggagggaagaatctggacgctggaggtcctctggcgggagacccgggatcaggcggttttgctggagcgttactatgaaagggggtaccaccgcaatgaaaagtatacgttataggagaggacgggaaaacgaacgggacctggcggtgtacacccgcctgatggccgaggacaacggcagccagctccagcagctgcgccgaaatctggcccaggcgcttcgggaggaggtgacggagcgccagaagcaggtcctgtttttatactataaccaggggcttaccatgcgggagattggagcggcgctgggggtggaccggagtacggtgtcccgcaccataaagcggggagaagcccggctccaccgctgcctgcgctatggcggggcggcgttgctccgagggtctctgggggaggagggaagaaaaaattttcggcacgccgttgacaaacgggttttccggggaagataatacagacacgaagtaagccaaagggggaaggcggcatgaaagaaaatccgatccgggacctgttggcccagggaaactggggggaggaccaggccctgctccaggggctgaggcagtggcagtatgcacctgtgctctggcaggcctatgagaccttgcaggaggaggctttgtttcacagccaggtgcatggccccggccacattcaccgggttcttctcctggcggcgctgctctgctggaaggagggtgcgccggaggagatggtccggcaggtgttccgggcggccagctatcacgatgtgggaaggacctttgacggatatgatatctaccatggggctcggtccgccctccgtctggcggcgctgacaggccagacgggggaggccctggtggagctgcaggcggcggtgaccgcccattcccgtccggaccgggagatggcgtccattgtggcctcgttccagccgcgggacctgccccacgccatggcgctgacccgtcttctgaaggatgcggacaacctggaccgagtgcgtctgggcgacttggacccaaagtttctccggcatgacagcgctaaggacttagtgggttttgcccagcgcttgtttcagagggaccaggcggcacgagaaccataaggatgcccagcgggatggccggcagtaagccggctgtcccgttttttgtcgaatctgcctgaaaacgcccctggaatgttgtgcagtcggtgcagcggtttggaagaaagaaacctttacatttgccgggtcgaatgatacaatagccgcgttggccggcccccaatcgcttttgaagggccgggcggcaaacggatggtattccgaataggaaactgtaccggcatattccctgcgggtccgctgctccggcacgggacccatcgcgtcaccctgacctgtggaaaggcaaggtgatcggatgaagattggattcattggagcgggaaaagttggcttctccctggggcagttttttgtccagggtggcctcccagtgaccggctattacagcaggcaccgagggtcggcccaggaagcggcggcatggactggcacgaagcaatacgaatctttggagtcgttggttcgggcgagtgacgcgttatttttgaccgttccggatggagcgattgcctcagtgtttgcacagctgagggaatttgacctggcaggaaaacagatttgtcattgcagcggcgcactgaccgcccgggaagcctttcccggggtggaggagacaggcgccggtcactattcgatccacccgttgttccccctctgcgacaagaccgtcgcctggcgggaattaccgggtgcttttttctgcctggagggccatggcccccacctggactggtgggcggagcggctggcttctctgggggccagggtgcggattctccccagccggggaaaagaggcctaccatgccgcctgcaccgtggccagcaacctgatgtgtgcgctggttcaggagagtgtggcactgttgcggggctgcgggttctcccagcgggaggccctggacgcattggcccccctgatgaaagccaatctggcccatcttctccaggtgggtccccagcaggctttgacagggcctgtggagcgaggggacactgccacggtggccaaacatttggcctgcttgaccggggaggatgcccggcaggtttatcggggggcctcccgcatgctggtggagttggcacgaaacaagcacccggacattgacgcggagtctatgaacgagatactaaaggaaggatcgaaccgatgaaacagaacaatgttgtcaccttagcagccatgaaagcccggggggaaaaaatctcccagctcacctgctacgactattccaccgcccggctgatggaccaggcgggcatcaacatgatcctggtgggggacagcctggggatgaccatgcagggctattccgacaccctgccggtaaccctggaggagatgatcctctatggccgcagcgtggcccggggatgccggaatgcctttgtggttttggacatgccctttatgagttaccaggtctccccggagcaggccctggccaatgccggccgaatgatgaaagagaccggcgtggacggcgtgaagctggagggcggcgaagggatctgcccccagatccgggccatcaccgccgccggcattccggtctgcgcccatgtggggatgaccccgcagtcctaccacgcttttgggggctttacggtacagggcaagggggaagccggcgcggcccgtctgctgaaggatgccttgacggtgcaggaagctggggcctttgccgtggttctggagtgtgttccccctaagctggccgcgctgatctcccggaagctggacatcatcaccatcggcattggggccggcgggggctgtgatggccaagtgctggtctaccaggatatgctggggatcaccgaaggacagacgccaaagtttgtcaaggcgtttgcccaggtgggacagcagatgatggaggcctttcaggcctatgacagccaggtgaagagcggtgcttttcccgccccggcccagacctatgccaaaagcgactgcggcgatgaagtgctgaaccgactggacgagagccagtcggccccgctgctgtccgtctgttctacgcagtgaggaggaagaccatgctgattgcaacaacctgttctgaggtgcgggcccaggtggcggcctggaaaaaggagggactgaccgtggggctggtccccaccatgggatatctccatgagggccatgccagcctggtggaggaagcggtccgccagtgcgaccgggtggtggtgtccgactttgtcaaccccacccagtttggccccaatgaggacctggaggcctatccccgggatttccgccgggactgcgctattctggaggcccacggctgccatttggtgtttcatcccactgtggaggagatgtacccgcccgacgcggcgacctatgtggaaatgctatctgagatgcccaaacagctgtgcggcaagacccgccccatccatttccggggcgtgtgcaccgtggtggccaagctattcaatattgtcaccccggacaaggcgttctttggccaaaaggacgcccagcagctggccattctccgccggatggtccgggacctgtcctatggaatcacgctggtgggctgccctattgtccgggagcccgacggactggccaagtcctcccgcaatacctatttaagtaaagaggaacgccgggccgcattggtgctttcccaggctgtggccctgggggaggacctggtggcctccggggagaccgatgcccgcagcattgtgacggcgatgaccgaccacattgccgcagagcccctggccagagtggactatgtctccgctgtggatggggagaccatggagccggtggatcaaattcgggaaggggttctggtggcgctggcggtctatattggaaaaacccgtctcattgataattttcttgtggagggcagatgatatgacggtggagatgctgaagggaaaaatccatcgggccacggtggtccaggcggagcttcattacgtggggtctatcaccgtggaccaggcactgctggaggccgctgggattttggagtatgagaaggtccagattgtggacatcgacaatggcagccgctttgagacttacaccatcgccggggagcggggctcggggatgatctgcctcaacggggctgctgcccggtgcgtcagcgtgggggacaaaatcatcatcatgtcctatgcccacatgacgccggaagagattgcccggggataccaccccaatgtggtttttgtggacgaagagaaccaggtggcccgggtaacagcctatgaaaagcacggcctgctcaaagacatggcctgagccattccccctgtggggacgtgaagaaggatgcgtcggtatgccggcgagattggagcgagagattcatggaaaatctgcaaggaaagtgcgtcctgctgtgtgtgtccggcggcattgccgcctataaaatgcccaacgtggccagcgccctgcggaaagcgggggcggaggtccatgtggtgatgacccagaacgccactcagtttattacccccctgacctttgagtccctgaccaaccaccggtgtgtggtggacacctttgcccgggactttcagtatgacattgcccacgtctccctggccaccgctgcggacctgattttggtggcgccggccaccgccgatgtcatcgccaagctggcccatggcattgccgatgacatgctcaccacggtggttctggcggcccgctgcaaaaaactggtggccccggccatgaacacggcgatgctggaaaaccccatcacccaggacaatcttgctgccttggagaagtacggtttttccattatccccccggacagcggcctcttggcctgccaagcggtgggcagtgggaagatgccggaaccggaggttttgctggaccacattgcccgggaactggcccgggagaagaccctggccggggttcgggtgacagtgacggccggccccacccaggaggccctggacccggtgcgctaccttaccaaccacagctccggccggatggggtatgccattgcccgggaggccatgctccggggggcgcaggtgaccctggtctccggaccggtggacctgcccttggttccctttgtggagacccgtccggtgaccacggcggcggacatgttccgggcggtgcgggatctgctgcccgccacggatgtcctcatcaaggccgccgctgtggcggactaccggccggcccaggtggcctcggataagatgaaaaagtcggaccaggacttgtccatccccctggagcgcaccgatgacattctgggatgggtggcggagcaccgccatcccggcctctttgtctgcggcttttccatggagacccgggatatggtggcaaactcccgggccaagctggagcgaaagaagctggatatgattgtggccaacaacctgaaagtggccggcgcgggctttgggaccaagaccaatgtggtcaccctcatcacccgggagggggagcgggaactgcccctcatgggaaaggatcaggtggcggcccatctgctggacgagattcagcggcgccggtgaatgcccagtgccgaaggacccaggaagtgtatacacttcctgggtccttatttttctcggaacaatcgcctgccagcctttgccctttcccttcaactttcgcctgaccgtttttccagaacgccgccccttgccgccgaagaagacgggacaagggaaaatgctggagaaagcccccatctttccccatgcaccgtccgacagcctttttttcctccggtgggtataatctgggcacacgatgcatagaaaaacaggttcgccaaacacaggagggatcatccatggcaacgaaagaaagagcggggggacggctgcttcggttcccacgccgggacaccgtcaatctgtcccgacgggccttcatgggcatggcagaggcgggggtgggattcctcctgggggctgtgctgtcgggggcggagatctttgggctctattcccccttcggggtggccgcggtggcggcggccgggtcggggatcagcgggttttgcaccctggccggggcctgcctggggtacctctgtctggaggggatgaccgatgggatgcgctacgcggcctccgccattttgacatattccgtggctttcgccttttatgatgcaaagttttataaacgggcctggttcatgcctgccattgccgcagtgctcagcgccctgacggggatcatctgccgaggaggcgagggctggtacggggaggacctggtttactttgtcacagaggtcctgttcacgggggcggcggcctatggctaccggatcattttcacccagtggcccgaggctctggacggacccagaaacttaacgccaaggcagagtatcggtctgatgatgttggcgggcacggtgctcatggccctggcccgggtggaaattttggggaccttctccatgggccgcctcctggcggcggtgggggtgatgctggcggcccgcaagggcgtgggggaaggggttctggccggggcctgtgccggggtggccctggacctggcctctggagaacagccctattacagtatggtttttgccctggcgggcctggcctgcgggctgtgtaagggaacccgaaagatcgtggccgcgctggtctacgtgctgacctgctttgtggcggtgctgtggagctgggacgggggactccatgtgggcctgcccatggaggcggtggtgggggccattgtcttcttggtgctgcccgtccgcccgaagaaggaacaggcccttccagccgccccgggggcagggcggggaccggacctggagagcagccggcaggcaatttcccgtaaaatgggggagatggcctcggccttccatgccctgtatgatacggtgcaggagaccctccatcccgagagcgccaatacggagaatccagcggaaatttttaccagtacggcggacaaggtgtgcgccaaatgtgtgctgcgcaccacctgctggcagaaggagtaccaagacacgcggcgggcattcaacgatgccaccggccccattctggaacggggccgggcattggccacggacttttccgggcagtttagcgcccgctgtgtccatttcccggagctgttgggggaggtaaaccgccagctgaccgcctttctccgccggaggcaggccctccggcggacttggcagacccggtccgccctgtgcagtcagtatgcccggctggacaagttcatgcgcagcgcggccacggagctctccacagggctgacccccgacctgccccggcaggaaaaattggacgggtttctgcggagcatgaatctctccggcggggtggtatactatgacaaggagggacgtctccgggtggaggttcccgccgcagaggagctcaaaacccggtcggcccgccgggagctggcggagattttgggtacgcctctgcgggagggagaggaggaaaacaaccgaattttgtttgcccaggcagagccctttcgggccaccgccgccctggccggggcccccagacagggggagccggtgagcggagacaccggcatctggttccggcgggaggacgggatgctgtttctcctcctctgcgacggtatggggtccggcccgggggcgaagcaggagagcgcccaggcggccaagctgattgagcgatttctccgggcgggcatggacccggcggaagcggtggagaccgtcagttccgccctgtccctccggggagaggcggggggcagcaccaccattgacctgctctccgtggacttgttcacagggcggtgctgtgtccataagcagggagcggcccccacctatgtccggcggggaaggcagatcaaatgcgccgtggggagttctctgcccgccggcattgtgacaggggagcaggcaaagcccgatgtccatcgtttccggggggagcagggggattggatcgtcatggtgacagacggaattctctgcggacgggaggacatttggattcgggacctgatgaccgcctaccagggggacagccccagtgacctggcccagcgaattttgcagcagagtgaggaaatctgtcagggagaggacgacgggacggtactggcagtgcatttggaacggggaaaggagggctgaggcagagaaatccggcagagcagaatcgggagaggaggctgcctgtgttgacagaccgcaggggcgcgttgcgcgcccctgcggtctgtcaattttcctggcaatttgccatccggtatggtatgctgttgatgactggtttccacaccccggtccaaccggcggagagatgtctcttcgccgctgcgtggcccgcgcaccacgttctaaatacgaaaatggaggcaatttattttgacgcgcacaaatacccacttgttggccctcaatggggtcatcgcggcggcctacgccgccctcacttatgtggctgcggccatgaatctggcctatggcccggtgcagtttcgagtttccgaggctttgactgtgctgcccttcctatttcctggcacctggccggggctctttgtgggctgtctggtggccaatttaatgagtccttacggtcctttggatatcctcatcggctcggcgggcacgcttttggcggcatggctcacccagaggaccaaccacccgtggctggcgccgctgcccccggtgctgagctgcatggttctgaccggggggatgctgacctggtacgaggtgggcttctccgcccagttccccgccctgtttgcagccaacgccctctgggttggcattggagaggcggtggtatgctatctgctgggcatgctgcttctccggggacttcccagggtgccctccctccggcgctatattccggaagcccgccaagggcttgcccgggcccgaaaagagtaggatcgttgcacaaatggtagaaaaagcaggtccccgtgcgcggcggggacctgcttttttaaggaagtgcctggggcggcgccggagaaaagacgcccggggtatggagcaaggcctccagttgttccggagtatccgccagggccgccgcaccggcttcccgcatggcctcgacctggccgtagccccaggtgacgccgatggtggggatgccgtggaccttggcccccagaacgtcaaaggcggtgtcccccaccatcaccacctggccggggtcgccgatctgggcgagaagataggagatgacgtcctccttggtctcccggcctgcgtccagggaggccccgcagacgcgctcgaagtaacgggccagctggaaatgctccagcacctcctgggcggtgacctggggcttggaggtggccacgaaaagacggtatcccgcaccttgcagccggtccagcaggccggcaatgccggggtagggggtgttttcaaattttccaatggggacataccgggcccggaaacgggcaatggcctcgtccagggacgccgggggaaccccgaagcgggcaaagctctgccgcaggggcgggcccacaaagacccggagctgatcgcggtccggcacctggatgccaaaatgggccagggccagctgggcgcagttgatgatcccgggaccggagtcggtcagggttccgtctaaatcaaagaaaatggcgcgtgacatagggggtctcctctcgactggaatgacgctgtttgggtattatacgacaatgggcggcggtttgcaatgggggcatttccattgacacaggcggggaaggtgtgctatcctaaagcaaaagaaatgctttcttcggaaacgaggtattctctactggcggtcaaagcccgcgagccatgcgctgattcggtgaaattccgaagccaacagttggtctggatgggagaagaaagaggttcaggcgtgtcgccggcggcctcccatccccttgttgtctggaacgtgagcttgggatggcatccggtggcccagagaccaggggcgtatccgggtgctttttttgctgcccgtccgccccgccgtggaagaaaggagcaggaacgatggaacaaccccaacggaaacagaatcccctggagaccgaacccattggccgtctgatccgccggtattcgatccccacagccctgaccctgatggtcaactacttgtacaacattgtggatcagatctttgtcggccagggggtgggggtcacggggatggccgccaccaacgtggcctttcctctgaccattgtcaccattgccctggcgctgatgatcggggacggctgcgcggcgaatatgagcctctgcctgggccgccggcagcaagaggaggcggaccggaccgccagccataccgtgaccctgctggtggccgcaggggttttcctggcggtggcgggaagcctgttcgcccggcagattgtcctgctgttcggggccacggagacggcttttcaggcgtctctggattatacccggatcatcgtctgggggctgcccttcctgctctttagctctgccctcacggccattatccgggcggacggcaaccccaaatacaccatgaagtgcatgattttaggggcggtgatcaacacggtgctggaccctgttttcattttcggtctgcacatgggggtggtgggggccgccattgccaccgtcattggacaggtggcggccggcggtctgtgcctggtctatctgcggcggcttcagtcggtgcggattcgccgggcctggctgcgtcccacggcggccctcacgggccggattttcaagctgggcatccccagttttctcacgcagattatgaccgctgccgttcaggtgaccatgaacaacttgatgacccggtatggggcccagacggcctatggcggggatgtggcgctttcggtttatggcatggtgatgaaggtgtaccagattgcccacgccatgtttgtgggggtgtcctcggccacccagcccatcaacggctataatttcggcgccaaacggtatgaccgggtgcgggctacctaccgtatggcggctaccatcgcgctggtggtgtccgtgggctggttcgcggtctatcagctcttcccccgggccattggcacattgtttgtctcaggggacccggtgtacctggacgcctgccagcacatcttccgggtttacatgctggcctttttcctctatgggattcacatggccacttcctcctttttccaggggattgggagacccgtgcaggctctggccattcccttggtccggcaggctgtggtgctgattcccctggcgctgctgttgtcccaggcctttggtttcaatggggcgctgctggcagcccccatcgccgatgtggtctcctttctcctctccctggcgctggtactgcgggagttccggcgttggaaaaaacagggctggctctcgtaagccggcggagatggaaccaaaccgcacaccgcgccgtccaattaggacagcgcggtgtgcggcttttctatggagaaccggggctccctcaggggcggtcctgctttcggaacacgtgaatccgaaaagagatggtggtgtccagctggggcagcccagccaggcggagggcgccctgccggggcgttttccagaaatacggggtcatttgaaacaggtccaggatggcctgggtatccggcagatggatggtgccgtccaccgcctgaatttcctggtaagagaggccggggtatggggtttctttttcctcgttgggataaggcgtgtcatagagcacctgcttgagctcccacaggtggcgggcgccgggaaccacatagcagtagagcccgccgggccgcagcacccggagaaactcctccagggccaggggggagaagcagttgaccagcaggtcgatctgctggtcggccaccggcaggtcatagacggaggccacggcaaactcaatgctgccctggcgcttagccgcccggcgcagggcgtgcttggagaggtccaccccagccatcctggggtgttttcccgcctggagcagggcctggaaaagggcggcgctgtaatatccctctccgcagccggcgtccaggatctgagcccggtccggtgcgtaggccagcgccagacgggtcagggcatcccggagcgggtcgtaatagccccccgacaggaaacggttccgggcagcggccatggccttgtcgtctcccgggtctttggagtggagcttgttggcggggaggagatgcacatacccagcggcggcccggtcaaagctgtggccccgggggcagagatagcgggtgtcctgccggtccaggggctgggcgcagagggggcagcgcaagagactttccatgggatcgcttccttttcaatggatgagatgggtcagagggacacgatggtcttgaccagttcagggggcttgtccctcatgagggcaaaggcggtctccacctggggcagtccctggaaccggtgggtgatcagcgggaccgggtccacccggccgtattggagcagggccaggagcttttccatccgggcccgccccccggggcactcaccgccccgaatggttttgttccccatgccgaagccataccgcacattgggaatgggcaagtccccctgggtggtaaaatagttcacattgcccacggtgccgccccagcggaccatggtgacagcctgccccagggcgtcgggaccgccgccggcacagatgcagcagtcggcgccctgcttgtgggtgagcaggtggatttgccgggtgacgtccccctctttgtagttgaccaggtcggtggccccgtagaactgggccaatgccagcccggctggccggctgccgatggccaggatgcgtccggccccccggagctttgccccggcaatggccataagccccacaggccccacgcccatgaccaccaccgtgtccccgggctggacgtcggccagctgggcgccgtagaggccggtgttcagcatgtccgccgccatgacagccccctcccaggagaccccggggggaatccgtgcggcattggcgtccaggtcacggatgcggacgtactcggccagaagaccgtcctctccgttggacagcttctgcccggtgattagccccgcgcagtgctggtgggcgcccagctgggaggggacggtccgccagtcgggggtcacagggggcaccaccacgatctctcccacctggaagtcacgcacctggtcccctacggccacgatctctcccagaccctcgtggcccaggatgcggtggggggccagacagccgatctccacattgtggacatcagaggtgcagggggagaccagcagggggcggatgatcccgtcaaagcctgtggcctggggcggcgccttctccacccatcctgcctgaccctgggacaggtaagcaaatgctctcataggacaacctcctttggggcgcgatcccggcgttgggatggccgattttttaccagtgtagcacagtgggggcctggggcgcaagggcggagacgggctttgacttgtgttttccccaaattatgatataatgaggacctattgcaggggagaaggcgattcttgtccggggacggaggggccgccttctgccgtgcactgtgtcaagaggacagaccggcgctgtttgccggagaaaggagggacgcatgcaggaactcatagcccgtttgggcgtgattttctcccagcttggcgaccaggtccgggccgcggtggaaaacgcggacaccggcgcggcgctgggcgccgccattgatgtgattctgcctgtggcctgcgggattctgcgggtggtggcggtcattgtcgccattgtgatcattgtccgctgcctaatgtccctgttccgggagaaacccggaaaggaaatctgggggtggctcaccctgggagatgggacccgtctggacctgtgccattgggagaacgccattggacgggggcgatgggcggatgtcagtctggattttcccaccgtctcccgcagccatgcggccctgctgcgggacgacaaggggagctggaaactccagcccctgcagaccaagaacggaacccggctcaacggaaagaaagtcacccacaccgtgccggtgaagacaggggacgtcattgacttgggcggcatcggcctgtcgttctacgccatcagcgagaaggaggagcgggagcaggcgatgcgctggggggtggcggagcggcccctgagccccggcagaaccctgggatacctgaccgttttccaaatcatgatggcagtgcagtgcctgcccgaccgggagagcccggagatcgccatgatcggggtggcctttggcattctcatggcggccatgtgggggacctatctgctctaccgcacgctgaagcgaacggcctttgaggcggagaccatcgccttttttctgtgtaccatttcctttgccgtgacggcggcctattccccggaggccctgctgacccagaccatctgtgtgatcgcgggcatcgcggtgtttctggtgctgagcctgctgctgcgggacctgaagtccacggtgtccctgcgctggccggtggccgtgtttacctgcctgctgctgattttcaatgtggtgctgggctcccggattttcggggccaagaactggatctcccttggccccattggattccagccctcggagtttgtgaagattgcctttatttttaccggcgctgccacgctggaccggctgtttgcccggcgaaacctgatttttaccgtcctcttctgcggcttctgcatgggatgcctggccttgatgagtgactttggcacggcgctgatcttctttgtggccctgctggtcatcgcctttctccggtctggagacctgggcttcctggccctgatggccacggcggcgggggcaggcggctggatgattctccagtttaagccctacattgccaaccgttttggggcctggcggcacgtctgggagcacgccgcggactccggcggcttccaacagacccgcaccatgtcggccattgccagcggcggcctctttggcaagggaaccggggaggatgccttcctgaagaacatcggcgcggccaacacggacctggtctttggggtcatcagtgaacagtttggcctgattctggccctgtgcacggtgtttattttgctggtactggtgctctatgccacccgttgtgccgccacggcccggtccagctattatgtcatcgcggccaattccgccgccgccatgctggtgttccaggcgaccctgaatgtgctgggtgcggtggatatcctgcccctgaccggtgtgaccctgccctttgtctctgtgggcggctccagcatgatctcctgctgggggcttctggcctttttgaaggcggcggacacccggcccaatgccagctttaccctgaagctgcccaaacgcatccggggttggattcccccggacgcggaccggatgtacgatgaccggtacaacggctggtatgacgactacgatgaggatgcctatgaggactatgggtatgacgacggatacgaggactatgacgagtatgaggactacgacgactacgaccaatttgcggaggactggacccaggaccggggcggctgggaggacctgatcgacggccccctgtggccggaaggggaggaccccttggccgatcccccgccggcctgcggacggtcggatgaaaggaggcggcgcagatgaaacgactcagacggcggacaatcatcgctctggtgctggccggggcgctggccgccggggtgctgttcttttgcttccagctgatcgggaagggcaatgactgggtgggcttcttcggcacccggtactatgattccggcgccatctatgatagaaacggtgtcctcctctacgacgggcagaccaaaagctatgcggaaaaccaggctacccgggtgtccacccttcacctggtgggggaccagaatttcggcacctccctgcgctcagtgctggccagccggctgacaggctataatctggtcaccggcacctccctgggcagccatgacgtgaccctcaccattgatgcggccctcaacgagacggcctacgccgccctcaacggacgcaagggggtggtggcggtgtatgactataccacgggagacctgctgtgtgaggtgagctccccctcctacgaccccaacaatcccccttcggacatcaacgagaaccccgcctatgagggggtgtatttgaatcggttcttttccagcacctatccccccggctcggtctttaagctggtgaccacggcggcggccattgagcagaagaaggacctggaccagttccgctatacctgcactggcagtctggaagtggacggagatgtcatcacctgtccctatgcccacggcgagaatatggacatcaagcagtgtctggccacctcctgcaatggggcctatgccaccttggccatggagctggggggcaagaccctgggagagtacatggagcaggcgggcctgctggattccctggcagtctgcgacatccataccgccaaaggaagctttgtggcccaggaggatggaagcgcctttttgggctggtcgggtgtggggcaggacaaagacctggtcaacccctgcaatatgctggcctttatggggggcattgccaatgacggcgtggcggtggtgcccaaactggtggagcgggagaccatcaccggaacgtccattccggcggcctttcccgacggcaaggacacctattccatctatggagaggagacctgccggcagctgaaagagatgatgcgcaacaatgtggccagccagtatgggcaggcccagttcggggacctggcggtctgcgccaagtccggcacggcggaagtgggcgggggacaggagccccacgcctggtttgccggctttatcgacgacccggagcatcccttggccttcctggttctggtggaaaacggcggcggcggcgcccgggtggcgggttccatcgcggcccaggttttggcccaggcaactgcggagtaagagaaaacgcctcccttcaaagggaggcgtttttcttgggttgcgctttttccagtgcccgcagaacccggtccaaggtgtgctcgatgtcctgcccgccgcaatccaccgtaatatgggcgtatgtctcgtacaggggaatgcgctgttcgtagagcattcggagggtctggcccgggcggagaaccaccccgcggtttttgaggttgcccagccggcgggccagtgccttgtagcccagcttcaggtagacgacggtaccgatttcccggagatgggccatggcctccggctcataaaccacgctgccgccggtggcgatcacggcgttttccgcctggaggccggcgcagacggtgccctccagggccagaaagccgtcgatgccgtgctgggcgatcagctcccggagcagggcctttttttgatcctgaatgacaagatctgtgtcaagaaaggtcatgcccagggttttggccagcagcacccccagggtgctcttgcccacaccgggcatgccgatgagaatgacgttgtgcatggcgctctctccctttctgtttttggagatagcctgagtataccaccggaggaattaaaagggaagaggaaaaaccccagtggcaaaaagccagatcaccgaggcgaccccgccgcccgccagggcggagaccgcgggaatccagatccgccgccgtttcccctggggggaggtgcgaagaagataggcgtcggccacttcctgggcccgtttcagcacttgctcctccggcgcgtcctctgcgccggcctcttcccggagcagaaagatggcctgttcaaaccattttgggtccggggacttgaccaccacgacccgtcgggagactccttttaccatggataccactcctttccgtttccctcagtatggacggggcggggccattttataccaggggggaagggaggattaccggcagagcgcggggtggtagagctggggctgccggtggtggaggtagttgagaaaatcgtcgggggcggtggtgtcctccatatctatgagggcatagagggtggtctcctcctgggtgccggcctccgccagaatgcgcccggtggggtggaaggctccgctctggccgcagtagtggaaccgcttttcatctccgacatagttgcagtagagggtatacgcgcggttctccatggcccgggtccgcatgtacaggaagtggtagtcctcataggggctcatgttggccgcacacatgcagatcagcttggcgccatccagagccagcgaccgggcagtctcggggaactccccgtcatagcagaccagaatccccatgcggccgaaggaggtgtcaaaggccctgaggctggtgcctggcgcgaacatcttctcctccccgccaaagaagtgggttttggcctggaacccggcgggggtaccgtcccggtcgatcatgaccacggcgttgtagggcttgccgccggggtttgccaagggcatgcccatgaccacccccagggaaagggctttggctttctggcccaggacggtgagggcggggccgttggggtagggctctgccagctgtgccagctggtcccggatgagatagccggtgaggaacatctcggggaagagaatcagggacgcgccccgggcggcggcggcctccatggcgcgcagggcccggtccaggttgccctgcttgtcatagggcagggaggtggtctggacgatgcaggcggtaaagggggacataaaagcatctcctttcaggttgtctgggtagaaaaaagacgcgccggagatgcggcgcgtcttttggtagaaaccgaaatcagtcggtgacgtaaggcagcagagcgatctgacgggcgcgcttgatggcctcggtcagctggcgctggtgcatggcgcaggtgccggtggttctgcggggcagaatcttggagcgctcagaaaggaaacggcgcagcttggcggagtccttataatcgatgtgctcgaccttatcgacacagaaagtacaaaccttacggcgtttacggccgccgcgagggcgttctctatccatagccatgatagcaaacctccttaaaatagaatgagagtggtctgacagggtctctcccggaggagaggatcagaaaggcagctccccatcgtcgtcggtgagatcagcaaactgatccaccgcaggggccgcggtgtaaccgccgccggagggggggtagctgttgttgccggcgggggcaccgtagccgctgctccggccagcctggggggcgggtgtgtagccgccttctccatcccggcgggaatcgccgaaatagacgttgtcggccaccacttccgtggcgtaccggcggttgccgtcccggtcggtgtagtcgcgggtctggagcttgccctccaccacggccagacggcccttggtgaggaagcgggagacgaactctcccgtctgacgccaagccacgacattgatgaaatcggccttccgctccccggtttcccggtccttgaagtcccggtccaccgccaggcggaaggaagccacggccacgccgttctgggtgtggcgcagctcagggtcggccaccagccggccctggaggaagatcttgttcagcaaagcaagagcccccttattcgtccttgcagatgatcatggaacgcatcacgccttcggtgatcttcagcacacggtccagctcagcggggagctcgggcgcggcggtgaaggtcatgaggacatagtggccctcgttcaggtcgttgatgggataggccagacggcgcttgccccagtcgtcgatggcggccaccgtgccctgggtttccaccagagtcttgaacttctcgatcattgcggcgatggcctcttcgcccagcgcggggtccatgatatagaccacttcatagtttgcgtttacctttgccatggttcgttgcacctccttatggacatttggccggcaatcctcgttgccggcaaggatctgcctgcatagaaagacaggctatactattatatcgaaaagggggaatttgtcaaggcttttttccttttcccgggttttccggaagggagcgtgtgctggggcaggcataatttgctttcaccgggacatactgcctgtgaggtgatatccatggagttgaacaaactgagcaatgaggcgtacaacgcctatgtccagagcaaggccaagccctcccccatggggaagaacatggtgtgggcttttctggtggggggactgatctgtgtgatcgggcaggggctgctggactggtaccagacgatgggactgtcccgggagctggcgggcacggcggtttccgttaccctgattttcctcacggcgctgctcacagggattggggtgtttgacagctttgccaagcacgccggcgcggggacgctggttcccatcacagggtttgccaacgcggtggtggcgcccgccatggagtttaagcaggagggactggtcaccgggaccgccgccaaactctttaccgtggctggcccggtgctggtctatgggatttccgccagtgtgctctatggcctgattctgtggctgatccaggttctgtaagacagactgcccgtgccttccctggcacgggcagtctgctgtatggggcttgtctccggcggacgagtggcctgccgggctgttgtggctctgtctgcccgaaagccatgggggattggatggggagcgaccgattcaaaaaagaagatccagggcgcagagggccagcacggcggccatggccccgttgaacgcccgggtgtgccggcgcagaaaggactgcagcagcccgccggccactgcccaggtgagaaagcccgcagtgccgaagagggtgaggacaaagggctgtatggggaacagggcgccgctgccggcgggcaggacgtagccggtatagatggtgatggcgtacagaataattttcccgttgacaaactggagaaaaaatccgctccaaaaggtagaccggggactgacatcctttgcaggggtgctccggagcagatggagggccagccagaagagatagagggccccggcgaaggggagcacctgggtcagcgcggggagcagccgctccagctggtaacagcccagcgcgcagaccgccatcacggaaaaaaagccggcgacaatcccggccagggtggcccgcccctggacccagcccttctggcccacggtgtggaatgccaggatgttgttggggcccggcgtaaagctggtgactaaggcgtagggaaggtaagatagaacaaccgaaaaaaacacttgagatcagcctccttttctgctatcctacacgcgagaaaaactgaaatcaaattgaaagtttttataaaacgatgcaaaaaaattgaaatgagtgaggcggcctatggatctcaagtatttgaatacctttcgggtgattgcggaggaggggagctttaccagggcggcggagcggctgggttatacccagtccaccatgacctttcagatgggacagctggagcaggccctctccgcccggctctttgagaaggtggggcggcggatggtgctcagccaggcggggcggcagctgctgccctatgtggagcgggtgctggaggcggtcaatcaaatgcactgttttacccaggacctgacccaatgccggggggaaatcaccatcggggtggcggaaaccctgctgtgctaccgactgccgccgctgctgaaggcctttcaccggcgggcgccccaggcccggctgctgatccgctccatgggctgctatgatatccgggatgggctgatggatgggtcgctggatgtggggctgttttatgagaacatcgggggacttagcagccagttggtgacccatcctgtgggaacctttcccgtggtgctgacggcggcgcctcaagtcaaggcattgggccctgatttcgtggctcctgaccatcaagtccccctgcccttcctcatcaacgaacccaactccatttttcgccagatgtttgagggatacctgcgggaaaaagccatccgaatggaccacaccattgagctggggagcatccccaccatcaagcacctggtggaaaacgaggtgggggtgacctttctgccccggtttgccgtggaggatgccctggcggcagggcggctcgtggagctggagaccgggatggaggagcccgtgctctcggcggtgtgcgctcatcacaagagcaagtggatcagcccgctgatggcgtgctttttggagattgtcactgcagcgggcgtatagccccctccgccgctgagaagcaatgacttcccaggcgggggaggctcccgccccgactgcttaggggcaagggccccaacaaaacgcccctccccaagacgagatgtcttggggaggggcttgtgctttgcaggcagcgttatttgaactttaccgcggtgccgtaggccatgacctccgcggcaccctgcatcacggcggcggaggcgtaacggacgttgaccacggcgtccgcacccagatgctccgcctcccccaccatgcgtttggtggccagggcgcgggcgtcgttcatcatgtcggtataggcgcccaattcaccgcccaccagggtcttgaacccctgggtaatatcccggccgatgtttttggactgaatggtgctgcccttgaccaggcccagcatttccagctcctggccggcaatgtaatcagtattgactaagatcatcttcttctcctccattgatttctcgaattcttgcacaggctgccacgatcaccgcgacggcggcagcggtcagcaggagggccagcacccaaaacagagggtgagagcccagcagggtccagatccaagcgacccctgcgatctggacagccagaggcgccagcacggctgccacagacaaccacacaccgacctttttcccacggtgtatatccatgttttccgactcctttcccggctactcaaggtccaactccggcggtacatcaagctcgtcggagacatacttgccgtttttcttccgctggcggacgcattctgtgagcaggtattcaatctgcccgttcactgagcggaagtcatcctcggcccaggccgcgatggcggcgtagagcttggcggaaagccggagagggatctgctttttcgcgtccttcttgccctcagccatcttcagcaccttaatacaggctgccggtgttcaccacgggctgggcctcgtggttgccgcagagcaccaccagaaggttggagaccatggcggccttccgctcctcatccagctccaccacaccgctctggttcagacgctccagggccatttccacggtgcccacggcgccctccacaatcatcttccgggcgtcgatgatggcggaggcctgctgacgctgcagcatggcggcggcaatctccgaggcgtaggccaggtgggtgatccgcgcctctaagatctccagaccggcctcctggaccttggcctgaatttcctcccgaatgcgggcggccaccacgtcgctggacccccggaggctgccctcatcggggacgccgtcgccggtggtgtccacgccgggagatacatcgtaggggtagagccggacgatgttccgcagggcgctgtcacactggagggagagaaactccttgtaattgtccacgtcaaagaccgccttccccgtgtccaccacccgccaggtgacggcgatgccgatttccacaggattgcccaggcagtcgttgattttctgccgggcgttgctgagggtcatgatcttcagggagatcttcttggtgacagcctccttgggcagggagaccgagctcccgcccagggcggccaagaccttggagcctttggcgctgtccacgtcgccgctctggctcagctgggtcttggcggcggggttcaccgcggtgcagaaggggttgacgaagtagaacccctctcccttcagggtgccgatatagttgccgaacagggtgagcaccagggcttcctgggggcccagtaccttcaggcccagcaggggcagccaacctaagctcaggtagaggatgcacaggaccaagggggcgatctgcgcctcgtccgcgaaaaagatggtgcccaaaacggcgagaatgtacaggacaatggtgagcagaagcacgagcataccgtgcttcttattggataaaataatttccgtcatagacagtcctcctggttgatctatttgatatcaaaaaaatatcatattgatttttcgctgtcaagaggaatttgaaaaaatcaggtggaaaacttatcccagacccccgggaggcgtacacaggaaaaaggccagcagcaggggcagactcacccccaacaccaggccggggaggacccagggcgcgcaggcaagcaggccggtgaacaggggaaggcccaggcacagcagcagggcggccagcagacgagtcaaaagggcgggcaggggactgccgccggagaagagcagggggaagagatcgggcagctgagaaaaacaaaaggtccagagagaggaccacagtgcggccaacaaactggacgggagagagagggggtgcatatagattctccttacgagggatagttgatatccaaatggatatcacatgggcattatatcgtcggggcggattaatgtcaagatatccaaatggatatcaatggaggaattatgggatactataaacggatccgcgatcttcgggaggaccatgacctcacccaacggcagctggcggccagacttcggatgacccagacccagtatttccgctatgagcagggctaccgggatatccccagcgacattctgattgccctggccgatctctacggcacatccacagattatatcttgggacgcaccgacgatccccggttttccggggccaaggggaagtgagccggcctggggagggaatggcgccttgccaagagtggaaagatatggtattctataaaggtatcccagcaagcaaatcgacgtttaaggggactttgccttgaagacagccattgtaactgataccaacagcagtatttctgccaaagaggcccaggagatgggcattgatctgatcccgatgcccttttttgtggatggggagacctatttggagggaaaggactgtacccctgagacgttctttcaaaggatgaaagcgggggcggagatcagcacctcccagcctgccccggaggagattacctccctgtgggacaccctgctgaagacccatgacgcggtgctccacttccccatgtcctcggggctgagcggctcctgccacaccgccaaagccctggcccaggagtacggcggccgggtgctggtggtggatgaccggagaatctccgtcacgctggcccagtccatccgcaacgcccaggtgctgctggcccagggaaagacagcggcggaggtccgggacattctggaggcggagcgggatgcgtccagcgtctacatcgcggtgaacaccctggagtatctgcggaaaagcggccgggtgaccgcggcgggcgctgcgatggcggcggtgctccatattaagcccgtcctgcagatccagggcggaaagctggacgcctacaaaaaggtccggggaatgctccaggccaaaaagaccttgttggaggctctgcgccatgacttggccacccggttttcggggatgaaaatggccgtgttttccggctattccggcggcgaccccaccctgggggagacctggcgcagggaggtgcaggccgcatttcccgattacgcggtggggatgatctccctccccctgagcatctgctgccacacgggagagggcgcggtgggcgtggcctgtgcaaaactttggtgaagggaacgcagcggttccggcatccacgccgggaccgctgctgtattttaattaaaatttaagaaaaatcctatcctttcttcattttcctcccgtataatcaaacccagaagaggagggaagtccatgaagagcaagcgcaggttggggatctgcttggccgtggggattctggttttggcggtgtcggcggcagcggcctttggcagcgtcaatgggtatgcccggtataagcaggcggtgaaggacctgctgctgcgggaggacaatttcacggtccaggcccagacccacctgtcagtggacggggagagacttctgtctgtgcagatggactatgcaaaagccggcctcaacagtgcctatcacagcagggaagaccacggcggggagagccaccaggagtaccgcaccgtgctcgacggagtacgtacccggtttgccggggacagttccttttactcctgcgagtccatagagcggggggaggccttttccaacctcctgggctatgatgtggacaacgagatggagcggcgcctggtggacttcgcggagaccgcggtggatctggtgctgggcgagctgaagaacaacgtggtacagttgggcaccgaaggggatgagacgatctatcaggtgcgggtggcccggagtcagattcccaccctcctcaacgctggactttccctgtttgtctatgacaacgtaggtgtgccggtgtcgcggtttctcacctatgaggatgagataggcctgctgttccagcgctatgaggctgtcacgggggaaaccctgccggaggaattccgcgccaaatacgccagcggagattacgatgacgcctggtaccaggccaaccggcgcctcatcgaacggctggacaccttcagcacggactggaatgcgccatattggaccctgtttgagaaaaaggaccagggtgtgctctatgtgaaagccgatggcagcgtccaggactatgacacggtccaggcatttttgaccgaccatcctgaacagaagtaccactatctggagtattacatgggcggcagcgctgccctctgcgatgtggtctgcaccttccgggtgaacggggcgggaaagctgaccgccaaccaaatacaggccaacttgaagaccacggacagcgccggcggaagccacgccatgcagatggtcctggacctgaccataacagactatggcaccaccaccgtggctcccctggatgtgggggaccgggtgatgcgttcctgataccaagttctctctcattttgattggatcaaagcgccgccgccctccgggaatcctgtccccggagggcggtggtgcgtttccatgacatgagggaaggagaaccgtgtattttttaatgaatttttaagagtttccccattctttttttagagatgtacggtataataacaacagtcaacaaagcccgtctcggggcggtgcgctggcagaaccgagcgcgaaggtcccgtgacgcagtgaaggaggaactgaggatgaagaagcgaaatcgattgaccatctgcctggtggccggtgtgctgatcctggcggtatccgccacggcggcctttgggagcgtcaatgggtacagtaagtacaaggaggcggtcaaggccctggccctggaaacagacaatttcaccgccaacggaaccctgaaaatgatctgtgacgggaaagaggtcgtgcatgtgacggaggactacgccatggacggtcataatatgtccagccatagcatcagcaaggacagcatggggtctcatgagcagtacgaaaccattctgaacggcgtgaatacctggtttgatgtgaacgaccggtactattaccagtcggagtatgaaaccgacagcagcagcctgggaggcaatctgctgggggtggaccaggacgacgagatggcccggcgcatggtgaactttatggagatcgccgcggacaccgtggtgggtgagctgaagaacaactttgtccaggtgggcaaggagaacggcgccaccctgtaccaggtggaaattgccaagaaccaggtgccctccctggtcaacgccggcctctccctttttgcttacagtgtcggccagtcccatgactacgattataccgtgaattatgaggattactctgccaccgccatccagaactatgagaaggtgacgggggagaccctgccggagaccttcaaagagggctatatcaacggcgggaatgagcagtggtatgaggacaacgcggagaactgggaagaaaagtattacgaggtcctggagaagaacaacggcggcattgtctacgtcaaggcggacggcacctatgactactatgccgattacgacgcctttgccgcggcaaagccggagctggtggcggataacctggagtcctatatcggccaggacatgaccttggaaaaggtcctgtgcaacttcggcgtggacgacaagggcaacctgacctccaaccagattacggtgaacttcaacaccaccgatcaggacggggaacaccacacgctggtgatcaccggggatgtgaccatctccaactacggcaccaccacggtacagccgctggatgtgggggaccgggagaaatacgcgtgaggcatccgcggaggcggaaagcagactgataccatcgagggcgaaaccccggaggccaagggcctccggggtcgtcccgccctcacaggtcctttggaccgcgggaaaggagcacagaatttggataccgttttgaccttggaccacgtttccaagatttatcacaacggccggggcgcccggaacattaccttctctgtggagcggggacaggtggtgggactgctgggccccaacggctcagggaagaccaccattatgaaatccatcacggggctttcccagcccacggaggggaccatcacggtgttcggcgcccctgtcaccgaccgggagaaggcgctgatgcaggtgggggccctcattgagcagcccgctctctatgaaaatctcaccgcccaggaccacctgcgtatggcggcccgatactaccccggcgtggaccaggcccgcatggacaaggtgctggagattgtgggactgaccccgtaccgcaaggagcggtgcggaaaattttccctgggcatgaagcagcggatgggcctggccctggcgctgctgtccgagccggagctgatgattttggacgagcccaccaacggcctggacattgaggccaccgtggagatgcgggaggtcattctccgcctggccaaggaaaaaggcgtgaccttcctggtggccagccatctggccgcggagattgagaagatgtgtgacaaagtgctggtgctctacgagggggagatgctctcctttgacaccaaggaggaggccctgcggctcaacccttccctggaggactacttcctggcgaaggtccgggacaagaagggctctgtggtcctgtaaggaggagacgatggaacgatttttggccagtttgagcaatgagctgtttaagctccgcaagcggaaaaaatatctggtgtttctgatcatcggcgcggtgatctgcgtggccagcgccctgcgggttctgattgtcaactacatcaccgacgggggcgtgtcccgggaggccattctgggggggctgatgtcctccaacctcccctttatcctgttgatcttcctgcctttgatggcggtgatggccgccagcgacctctttgtgggggagcaggtggaccataccctccgattttccctcatgcgccctgtgggaaagggaaagctcttcttttccaaggcggcggcggtgttccttttgtgcgcctttgacctggcggtgctgtatgtggtcagcaccgtggcccaggtgggcctgggagggggcacggaggggatcctcaccagcctgggggcctgcctgctggacctgatccccctggcggtgctggttcttttcttctgcctgatcaatcagctggtgagagggtccagcctgacggtcctgctgtgtgtggttttgtacatcgggctgctggttatggggacctatctgcccgcggtgggggggctggtgttcaccgggtatctccggtggcacaatctttggattgggattgccctgcccttcttctcgttgctgccccgcattggccttctggcggggtacggcctggtctttggatgctgcggctatctcctctttgacaggaaggaagcctgatggtaaaatggcggggagaaatccaaaaggaggcgggcgccatgccgaaaaaaaccaccctgaagggacagttcctgcggaccagtctggcgatgctggtgctctccctgctgatcggcgtggcggtcatggtggcggtgatgatttttttcaccgtgcgggttcccgatggagagaagtttctgatggagagcctgtccttcctctttggcaagcagaccatcggccccagcaggatggtgcctgttttggtgctggcgggggttttgctgtgcctgatggtgacgggggtgtgcattcttctcacctcccggctcacgggaaggatcacagccaccctgaaaaccctgcgccaggcggcggacaatctgcgggacggagagctggatttccaaatcctctcctgcgacgagcgggagctggacgagctcagccactccctggagagcgtccgccagcgcctgaaggccaccgcggtggcggaggccgccgcccaggaggagcgggggctgctgatggccaatctctcccacgaccttcgcacccccatcaccgccatcaagggatatgtggaggggattcaggacggcattgccaataccccggaaaagcagcgccattacctggagattgtctataacaaatctgtgattctggagaggctggtccggaatatgtccgatttctcggagtatgagctgggacggatgcagtatcattttgaatatgtggagatggggcccttcctccgggacctggctgaggaataccaggtggacgtgcagcagaacggcatgacctttaccgcccagatcccccagggccattacgtggtgaccgcggaccggagcaagctcaagcgggtgctggacaacctggtctccaacgccatcaagtatggacgggcaggcggggccattgccctgaccgcagaggagtatgagcggggcttggtgatccaggtctcggacaacgggaagggcatcagcgcccaggcgctgcgccatgtgtttgacagctttttccgggaggacagcgcccgaaccagctcggtgccaggcagcggcttggggctggccatctgccggagcattgtggacagccaccacggcaagatttggctgaccagtgaggagggagagggcacccgggccttcctctatctcccgctccagaaagaagaggggttgctgtgatgaaaattttgattattgaagacgaccagagtgtggcggagctggagcgggattacctggagatcaacggcggattccaatgcgatctgtacaccgacggtacccaagggctccaggcggcgctggcgggggactatgccctggtcattgtggatgtgatgctgccgggactgagcggctttgagatctgccggcggctgcgggaggtgaaggacacccctgtcatcatcatctctgccctggccgacgacattgacaaggtgcggggcctggggttgggggcggatgactacatgaccaagcccttctcccccagtgaactggtggcccgggtaaagggacacattcagcggtaccagcgcttggtgggcagccgggaaaaggcccggccggagatgctgaaggtccgggggctggagatcgaccgggagagccggcgggtctgggtcaacggcaaggagaccaacatgaccagcaaggagtatgatctgctcctctttttggctgagcatccggacaccgtgttttccaaggaccgtctgtttgacagcgtctggggggtggatgcctatggagatgtctccacggtcacggtgcacatcaaacacatccgggataaaattgaactcaaccccgaccgcacccagtacattgagaccgtctggggggtagggtaccggtttcgcggctgatttgcccaagggctcctttgcaggagccctttccttttgcctggcggccctttcgggagcgtgtacggaggagaaaccggacccaaaaagccccctgcccggggttccgccgggcagggggctggctgttttcaaaaagtgctgatgggaatgtccgggtcctcgcctgttttctcgatctttcggatctggacgtagtagtggtagctgtcgctgacatggatgcagacccggtcgcccacctgatggcccaacagggcctttcccacaggggactccttgctgatgaggcctttgagggcgtcctggcgaagggtggtgaccagctggatggtctcttcggtctcctcctcttccaggtaaaaggtgactttgtcaaacagggccaccccgtccccggcggcggtgccgtcgatgaccacggcggtcttgatcatgttctccagatagcgaatgcggctgtcgttgcggttcttctcccgcttggcggctttgtactcaaaattttcactgagatcgccaaaggagcgggccaccttgacctcctcaatgagctgggggcggaggacctgaatccggtgctggagctcttccttcattttgtcaatgtcaacctgggtcagttcgtcgtgcatgatcatacgcctcttttgtatcaaatccgtggggactgtctgccggtccagtgtcacggtgtccctgaattatagcacggaagaccggcgggggcaagccttatgggtggagacggacggtctcatccccctcaaagaagagggccagcgcaccggggccggcgtggcagccgttggcgggatcaaacggcgcgatgagaatctccttgggcggattggtctggcggaggcgctgggccagggcctccgcctcctggggggcattgccgtgggcgatgcacaccgtctggtccccggggtaccggaccagggcgttgtattggtcggccagcttcccaatggcctgggcccgcccgcgggctttgccgcacaggacaatgcggccgtttgggtctcccttgagcaggggcttgaggcccagcgccgtccccagcatggccttggcgccggagagacgtccgccccggctgaggtacatcaggtcatccaccgtgaaaaggtgggcaatccggtgccggagggagaggagggtgcgggcggtgtcctccaggcacatccccctctcccgcaggtcgaaggcccggaggaccagtagtccctgccccagggaggaggagagggagtccacaatctggagcttccgctggggaaattcctcccgcagctgttccgccgccatgcaggcggactgataggaggaactgaggccggaggaggcgctgagaaagagcaggtccaggccggaacggagcaggggctttagaaaggtgagaaaccgatggggcggaaccatggaggtggagacctctccccgcagcttcatcgtctgaaaaaaggcggcgctgtcatagccctcgggcgccaggcagaggtgttctttgccgcttatggtataggacagggggatgaccaccaggccgcgccgggcgatctgcgccaggggcaaaccggccagggaatcggtaacaatggcaaatgacataatttctgcctccttgacatataatatacaacattagattaacaggagattgtgattatgtcaagcagtaatgaacgtgaaatttcttgcacagagaacaggaaagcgcccttccccatccggaacaggacagccgggcgggggagggcgctgcatcgggcggcgctcagccgaacagagaaacggttttggtggccatacgctgaccgtagagacggaagagctccttgctctcctccaggtgtccgtggagggccacaggccccaggtggatcacgggcttgccaaaggagccgcccccggagtaggtgagcatgcccagaaccatcatgtgattgaggatggtttgaatgcccaaatccccgccgccgtggagatagtccgccgtggcgaacgcaccccccaccttgccggccaacccggctttcaaagcggggccgtccagccagaccttgacggcactgcacagatcagccagatagatgggtgttcccagaacgacacacttgctctccttcacccaggcggcgtcccaattttcaatgggaaaggccttggcctccacccctgccacggtcatcatcccttccgcaatgacttgggccatggttttggtgttgccggtgacagaatggtatagtacggtcattttcatcatgggttcctcctttgcttctactgcgagtatgggaagggggacggatgtggggcccgccttcctctcttaccatagcatagcacaagatggtgcgaacggcaaagaaattaagaggaggaaacggctcaggggacgaagtcgctgctttttgagtggagctgattgtaacacgacatcgcagcggcagtataacaattgccgtagcgggacagcaattctggcttgctgtaatcaaacatcagggaatcagtgtcggtcgtatttacccattgataaatggtttccgttccggtggttttccgataaaagagaaggtagggctgaccagtgcttccccattctgtcagccaattctttccgtggatgcgctctgaggacatgcctcccactaagaggctgtcgagattcccctctacacacaggcgatattccaagcggtatatctcgaccccgtcgtttaagcttgcaacgcctgtgggaatcggtgttaagccggtaatttttgcctctgtgatgaggcggttgtctttgtgctctgaccagctttggttcaaagcgtgaattttttcggcgaggaaatcctcggaccaggacaccacggcatcgggaacttggtccgaaaaggcatgttctatgacaatatctcctttggaagagatcgaggctgtgcgccctccagtgaaggtgcagcctgccgccatcagtacgaagagcaaaagagcaagcacagtaccgcgtgtaattttatttttgcctttttgaacaactcgagcaattcgctctcgaaggaactgacgattgtcagccagcggagcggaaaggataaaggggtttacggatttctggcaggccatacggattaaggtcctcccgtaggcggcccgctcttcctggcccaggcgctgaagggtggcttcatcgcaggcagtctcgctgtcccggtgagatagaacggctgcccaccagaccaggggattgtaccaatgcagcgccacacatatcccccgtaataaggaccagaaagcgtctccgtggaggaaatgtgtggtttcatgggcgatgacatggcggaacacggtaggatcttccagtgcctcagacgtcacatagatggcggaagggaacagtccaaaaagacagggggagccaatggcatccgtcttataaacaggaaggcgggcctgtttgcattttaccgcctgccgggaccgccgcaggcggagggcaaagtgaaggttgaccgccgcgaagtacgcgccgatccccagcgtcccggccaaccagaaatagaacagcacccgcgtcggggttatctggtcaggtgaggagattggctggggcgagagggagggacctgtttcttgctgggaggaggcaagagatgtaatgccgtcaaaagaggaatctatccccgcagtgagcatctggaccggcgggacattcatcacagaaaatcctgtttcaccaaagctgaatggcaggagaagacggagtaggacaatggcccaaagagcgtattgcagccgacggctcatcgctgccgttagaatatgccgcaggacaaggaaccctgcaagcaggacggaagaactaatgatccatgtcaacatcatgcttttcctccagttctcgtaatagagcgtacagcgcgtcaatttcttcctggggcagggcctgtttttgggtgagcgaggagaccatgaggcttaggcttccatggtaaacgcggtgcaggaaatgttttgtttcctgcagaacagcggcatcccgcttgacaagggggcgaaaagactttttcccatggtcggtatcactggcgactgcccctttgctctccagccttcgcagtagtgtcagtgtggtgctgcggctccagcccattgttttttccaggcagctggtcgcctctctgccagtgcatggggtatggtcccaaagaaattccatgacatgccactcggaagaggtcagatgaatgttctcggcagacatgttgggaaacctccttttgtctacgtctgtaaacaaattgtactacatatgtttacaaacgtcaacaaaaagaggagaaaagttattggtagaacacaagatgccctcccgacacacgacaggtgttgggagggcatcttgaacttgttggtgccggtgaccggactcgaaccggtacggtgtcgccaccggtggattttgagtccactacgtctaccaattccatcacaccggcagagggatgacttggaatcgcaaccaattatacaacagcttctcccacttggcaagagtttttctgcgggaaaattgaaataaatgataggaaatgagagacaagtgtggtatgataaactactggaaagaatttcgaggcttgtaccgtccttcggcggggcaggcgggaaagaggagggccggcatgggaaagcggatgctgggctgtctggttctggccatttgcatgctggggctggggggctgtatgtttggaaacgtggacgagatgtacgccctgcccaagtcctcagaggcctatgtcaatcttcaggcgaagatcaaccaggagaaaggaagcgcggagtacattgcccccctcagcggggaaaaccggcagaccattcagctggtggatgtggatggagacggcgtgcaggaggccgtggcgtttttccgggacacaacctcggaaaaccccttgaaaattgtgattttcaagcaggatgaacacgaggaataccaggtctatacccggattgaaggggtgggcagcgagattgagtccatcgactacctggacctggggggaagcggcggcatggacatcctggtgagctggcaggtcagcggggcggtgcacaccttggtgggttacaccttggcggaagaacagcctgtggagatcatgcgcagcggatacagccagtacctggcaacggacctggatggcgacggcaaggaggaaatcgtcctggcccaggcggagagcggcagcaaagcccagctgcgaattgagtactacgatggccgggacgggatcatggaactgacctccaccgcccccctgtccgaggggaccacaagcatcagcagctggaccgatggattcttggaaggggagattcccgcgctgtttgtcacgtccttttttggaaaggacgggctcattaccgacgtgttttacctggaggagggccacgggctaaagaacatcgccatggacccggagacccgccgcagcaagaatgtgtttcactactacgcgggggtccagccggaggacattgacggagatggatgtatggacgttccggtggcccagtctgtgccggcctatggagagagctcggcggaccggttctggtggctccagtggatgcactaccgggtcgacggaagccgggacctggtgatgaccacctaccacagcggggatggctggtacctggaaatcccggaggactggaccggggaattctcgatgcgccggcaggagagctccaccattggggtgcgtacggtgacctttgccagaggggagaaggcacagacggaagcggaggagagcaaaaccgtccccttcctggagatcagctgtctggtgggcagcgaccgtacccgccaggcccgccagggaaaccggtttattctctatgcggacagcaccaccatctacaccgcagaatttctggagagcggctgggactgcggtttggaccaggaggggctgaaagcccggttccatgcgggcttggacggctggaacaccagggagtaaatgcccccggaataccaaaaacccagggagagccccgtctgaaccgggctggggaacctccccaaatttgaggcaggaggagcaggacgatgaaaaaaattctggttctggaggatgaggccaacatccgcagttttgtggtgatcaatctcaaccgagccggctatgagaccattgaggccgggactggggaggaggcgctggagcagctccggctgaaccccgatgtccgggtggcgctgctggatatcatgctgccggatatggatgggtttgaggtttgccgccgaatccgggcgggcaactccaaaattggcatcattatgctcacggcccggacccaggagatggacaaggtcacaggctttatgaccggcgcggatgactatgtgaccaagcccttttccccggcggaattgaccgcccgaattgacgccctctaccgccggattgggggggacatgatggatgacggagagattcagcagcctccctttgtgctcaacacccgcaagcggactctggagaaaaacggccagcggatcaagctcacccaggtggagtatgccattatgaagatgtttatggaaaatccggggaaggccctctcccgggaggagatcctgaagttcgtctggggagagaactatttgggggagttgaagatcgtggatgtgaacattcggcgcctgcgggtgaagattgaggatgaacccaccagccccgccttcatcaccaccatctggggctacggctataagtgggaattttgaggaacaatcgggaggaagggagagagccatgattccattcctgaaggtgaaggggatccgccagcggtggctgctcaacagcatcagtatcttggtgatgattctggtggtggtggtcgcggcgttctccctgatcatcaagaactactacgacagcagcattctcacggacatggagagcaaggcccggatggcggccagttatttcagcacggaggccagcagctacaattacaacagcagcggggattatctcaccgcggcccaggattatgtcagctcctttgaggacggcacgcggattgagctgcagtttctcaaccccgggggcaaggtgatctactcctccaacggcctgaccctctcagggaccatgccggggaccggggacatcacccaggtgcagagctaccaggaggtggccacctggaagggggtctccagccagaccggcgagcggatcaccgcggtctccgccccgctgctgtacaatggggagctggtggggatcatgcgctatgtcacctccatgcggctggtggaccgccaggtgctggtgatgactctggtggcggtgatcctgtcggtgagtatcctcattttggtctatatttccaacatttactttgtccgctccattgtggacccggtgaaaaacatcaccggcatcgcccggcggattgccggggggagttatggcatccaagtggagaaaaagtttgacgatgaggtgggcgatctcaccgacgccatcaacgacatgtccctgcggatcaaacaggccgaaagcatgaagtcggagtttatctcctcggtatcccacgagctgcgcacgcccctgaccgccatcaccggctgggcggagaccattatgagcggcgaagcccgggatgagggggatgtccgaaagggcatggggatcatcgccagcgaggcccgccgcctgtcgggcatggtggaggaactgctggagttttcccggattgaggacggccgtttcaccttgtccgtggagcccatggatattaaggcggaactggaggacgcggtttacacctaccatgagtttctggccgcggaggggattgccgtgtaccataccgactgcgaggaggagttcccccccattccaggggaccccgaccggctgcggcaggtcttctgcaacctgctggacaacgcggccaagcacggcggggccggcaagcggattgacaccgctattttccccgacggcaatgaggtggtcatcaccgtccgagactacggcccgggcattccgccggaggaactgcccaacgtcaagtataagttctataagggaagctccaccgcccggggcagcggcatcggcctggcggtgtgcgaggagatcgtctcccggcacaatggagagctgatcatctccaacgcggaggatgaggccggaggctgtgtggtggaggtccgcctgccgactggaacataagttcgaaaaaagagcgccatattcttgcatttttggctggggtctgctacaatcgccccagaaccaaggaaacactgtttaggagatactatgaaacaagaaaacaactgcgcgctgccccaggagggcgcgtttcgcaccaccatcggcgggcaggcgctcattgagggaatcctcatgcgggggccggaaaaacaggccattgtggtgcgcaaccaggagggagaactggaggtcaaggagcaaaccctgaagctcatcaaggaccgctatcccattctggggcttcccttcctccggggggtggtaaactttctggcctccctggtggaaggggtgaaggccctgatgtggtcggcggaattttaccctgacgaggaggaggagaagccgccctccaagtttgaaacctggctggaaaagcactttggcagcgaggggctgatgaagtgggtcatcggtttttccgtggtggtgggcattgcctttgccattgccctgtttatcatcctcccgacgctggccacctccgccctgctgtatttctttcccgacgcccccatgtggctgcggaacctgctggagggtgtgctgaagctggtgatttttttcctctatctgttcctctgctcccggctgaaggacattcaccggacctttcagtaccatggggcggagcacaaaaccattttctgctatgagcggggcctggagctgacggtggaaaacgcccgccggatgccccggcaccatccccggtgcggtaccagctttctctttgtggtgattgtggtggcggtgctggcctcctgcgtggtctttgccctgccggtggtgcgggaggtggccgccaatcccattgtgcggattcttctccatctgctcctgctgcccattgtggtggcggtgacctatgagatcaaccgcttcattggccggcatgacaatccggtgactcgggcgctgtcggcgccgggcatgtggatgcagaattttaccaccttcgagccggatgactccatgctggaggtggccatccacgccctgaagctggtgctgccccgggaaaagggggccgacgcctggtgaggccgggcagatttggttccaaggaaaggattctttgaaaaatgattgattggggtggagatgtgtggcgatcacctaccatgatttgtatttgaagacccggatggcgctctcgtcagcggggatcgaggccgcccagctggaggcccgggagatcctttgcgccgcggcggaaaagactgcggaggaactctatcgagacatttctttgtataccacagacgccatcgcggagaaaacggaggcccttcaggcccggcgtctggccggggaacccattgcctatcttttgggggagtggtccttctgcggtctgccgtttttcgtctccccggccgcgctgattccccgggtggacacggagatgctggcccagctggccatgaaccgcctgaaggagcaccccggccatacccggattctggacctgtgcgcggggacgggctgcgtgggcctgacagccgcggcgctgctgaagaatacccgggcggtgctggtggacctctccgacggggcactggacctgtgcaagcggaacatccggcggcataaactcaccggccgggcggtttcccttaagggagacgcgctgcaggcccccagccatgccctgggacagtttgacgtgctggtgtgcaacccgccttacattcccaccggggacctggcggccctggatacctcggtcaaagattttgagccgctgctggccttggacggcggggaggacggcctggatttttaccggggcattacagagctgtggcagccggcgctgaagcccggcggccatctcctctatgaggtaggcatcggccaggcggagaaggtggcctggctgctggtgaaagctggctacgagaacatccgcatcacccgggacactggcggcattgatcgggtggtggagggccagcggcccaaggagcgggagattcccgatatgctccacgagaccatggaggaggacgtgtaacaatggcagagaaaaagaaaatgatggagtccgcggcccctgccgcggacaagaagaaggcactggaaaccgccatggcgcagattgagaagacctatggcaagggggccatcatgcgcctgggcaccaacacccgggtggtggtggagagcattcccaccggctcggtggccctggacctggcgttgggcatcggcggggttccccgggggcggatcattgagatctatgggccggaatcctccggcaaaaccaccctggccctgcacatcgcggcagaggcccagaagcgggggggcgaggtggccttcatcgacgcggagcacgctctggaccccacctatgcccgggccctgggggtggacattgataatatgctgatctcccagccggacacgggagagcagggcctggagatctgtgaggccctggtgcgctctggggccctggacgtgattgtggtggactccgtggccgccctggttccccgggcggaaattgagggggacatgggggacgcccacgtgggcctgctggcccggctgatgagccaggccctgcggaagctggccggttccatttccaagaccaactgtgtggtcatcttcatcaaccagctccgggaaaaggtgggggtgatgtacggcaaccctgaggtcaccaccggcggccgggccttgaaattctactcctctgtgcggatggaggtgcgccgggtggagcccattaaggcgggcagtgagatcatcggcaaccggacccgggcgaaggtggtaaaaaacaaggtggctccccccttccgggaggcggaatttgacatcatgtacggggagggaatctccaagtatggcgagctggtggacctggcggtgaagctggacatcatccagaaaagcggctcctggttctccatgggagaggagcggattggtcagggcaaggacgctgccaagcagtacctgcgggacaacccggaaatctgcgagcgggtggaggcggaaatccgtcagaactcctttaagctcctgtccaaccaggcccaggcggcggcccgggcggccggacgggccccccaggaggcggtggtccacagcgcccagcccgccgcggcgccggcagcgcccaaagggatcgacgtaagcgccgacgactttgacgacgatgaggattgagcgcctgctccccccggcccagccaggcagaccctggactgtggtactggaggggggagatgccctccgggtcccagaggggacggtggcggcattttccctctacgatggtctgaccctggaggaggagcggctggcggaactgaagtctgcggccttcgtggccaccctgcgggaaagaacggttgccctcctctctgcccggatgctttccgccggccagctccaggagaagctgatggccaagggcgccacggaccgccaggcggcggaggtggtggcctgggccctggagatcggcctgctcaatgaggaagaatatgccaagatcctggcccggcactatcaggccagggggtatggcatatataaaatcaaagacgaactgtaccgccgccaggttccccgccggtattgggagcaggccctggcggaactggaggacccggaggaattcattgacgcctttctcgcccggaaagtccaggaccccggggacaggaaacagatcaaaaaagcctcagacgccttggtgcgccggggcttttcctggcgtcaggtgtctgagggggttgcccgcctgcgctggggggattgacggtccctggtctggaacgggcccaaacgcgacggagaggagaagaccatgaaagtaggatttatttcccttggctgtgccaagaatcaggtaaactgtgagcagatgatttggcagacctacgaggccggctatgaggtggccttaggcgctgcgggctgtgatgtggcggtggtcaacacctgcggctttctccaggaggcccgggaggaggccctggcggagattcagaagctggtggagcaaaaacaggccggtcagctgcaaaagattctggtcactggctgcatggcccagtggtggcgggaccagctggcccagcgctgtccccaggccgacggctttgtgggggtgagcggctatgagaacctgccccaggttattgaccaggccctccgaggggagcacccggcgctgtttggggacattgacgcacccattcccgagaccgaccgggtggtctgcacctcggactactgggcctggctgcggattgcggagggctgcgacaaccgctgcgcctactgcatcatccccatgatccggggaaggttccgcagccgcccggaagaggccattctggccgaggcggaaaacttggcccaggcgggaatgaaggagctcattgtggtggcccaggacatcacccggtatggcctggacctctatggccggcgcaccctggcacagctgctgcccaagctctgcgccattgagggcatccagtgggtccggctccattacctctatcccgatgagatcaccgacgagctcatagatgtcatcgcccgggaaccgaagatcgtgaagtatttggatattcccatccagcatatcagcgaccgggtcctccgcgccatgcatcgccgggggacggggcaggagattcgcacgctctttcgaaagctgcgggagagaatccccggcctggtcctgcgcaccagtttgatcgcaggatttccgggggagacagaggaggagttcgaagaactttgtgaattcctgctggccttccgggtggagcgggcgggggttttcccctactcccccgagccgggcagtgcggcggcggccttccccgaccaggtggacgaggatgtgaagcgccgccgggtggaactgctcaccgatctgcaaatgcggattgtggacgactactgcgccgcgatggtgggcaaagtgctcacggtgttgtgtgagggctatgatgaggagaccgagcttttctttggccggggagaggcggactccccggggattgacggactgatccactttgaaggagaggaagggggcgtccgcccgggcgaattctattccgtgaaaatcaccaacacctatgacggggaactggtgggtgtgctgtatgaggaggaagaggcatgaacacggcgaataaactgaccctttgccgggtggtgatgatccccatcttcatcgtcctgctctatctggagtttgccggccatctgtgggtggctctggcagtgtttatcctggccagtgtcaccgactttgtggacggatatgtggcccggcactacgaccaggtcaccgactttggtaaatttatggaccccctggcggataagctcttggtgatgtccgctatggtctggtttgtggaagtgggttggatgcctgcgtgggcattctttatcgtgattgcccgggaactggcggttaccggattgcgcctggtggcggtggagcaggggctggtcattgccgccggcaagtctggaaaggtaaaaactgcctccaccatggtctgtatctgcttgctgctggccattcccaacgagactctccggctggtctgtgtggcggtcattctggtgacgacggtctactccggggtggagtattttgtgaagaaccggcaggttattttgaatgggaatatgtgaaagccgtcctgagacgggatggaagcgcagccgcctccccctttcgtgccccggcgcggacacgagagggagaggcggctggcggtttgagaggggggctgggcgagccctctttttttatgttctaatctcaatttcctcttgcaatttataaaatatagagtaaaaataagaatcaggccaagaagaatgcttttcttaatagttacttttgcgcacctgtaagcggcgaaagcggggcggagagagggagaaggtcccccggcacaggtgcgccgggggattggagaatggaaacgggttagacggaggattttttccgtttctcagcctcccgtgcgatgatctcaataaactcagagaccttggggtaggtaaagagcgtatagcctgccatttcccggagcttggcagggtccttccgccaggcctgctggatgatggtgcggatgttccgttccacgttgtcggaggtacagcggcagcgttttgccgcgggtttataaatttcgtcgatcacggcggagagtcggttggggtcttccaggtagagctcgacggaagccacgagcatgggaaagcccgcgtagcgaggggttacgccaaagggccgcatgatgtcttggatgatcgcattcataacagtgtctcctttgtgaaatatagatttggcatttagaaagaagaaaataaaccgttatgcacgatttggtgggggaaatacccggttatatgccatggtgaagggcggggaaatgtagtggctcacaacgaatcacctcctttccaaagggggtctctgcccaaccggttagccggcgttggtaccttggatggggagcatggcttttttcaggtgggagaccatgatttgcagaaagtcagagacagagggcggcgcgagcaaagggtattctgacaaggcctggagccccggccggttgactttccaggcgtggtggatcacggtacggatgtttcgctccacatcggaccggttgcatccgtgcagctccgcggtctcccagtagacctccttggtgaccgagcgcaggcggctggggcgctcgaagcagaggctgatggctgtgacagcgagggaaaacccagcatacttctctgtgatccccagacttctcaatgtactttgcagaatgagcttcattaacaaaacctccttgttagttggtaattaaatcatacgacaaattccaacaaaaatgtcaaaaacgactattttggacataattcgacacatagaaagcttgcaaaacagaaaatcccctgacgcagcacgtcaggggaagggaagaaaggggatcggggaagggaaaggcccctcttgacaccttcgatggggcatggtaatatactactaccatagtaagatggaaaactttatctcgtgtggaacgggaagagtaccctgtcagatccggacagagaggggcggccaccgactgcaagccgccctgcggggagggaggggaacgtgcgcccgggagcgagagggatgcagatgccctccggtttggcaccgttaccggccctttgagtgagaaacaagagtggaaccgcggtagacatcgcctcttgaccctgggggtcgggcggtgttttttctatgcggttttccgtcccctttggggcggcgcgggcatagcatgctatggtatttgctgaaattttttgtgaggtgaccggaaatgtcccatctgagtgaaaccctggcggcctatcaggcccgagacccggcggcccggagtaaattggagatcttccttctttaccccggggtccatgccaccctttaccatcaggcggcccatttctgttactgtcacaagatgaaatttttggcccggaccatctcccaatggagccggttctggacggggattgagatccacccgggggcgaagatcggacgccggctggtcatcgaccacggcatgggcatcgtcattggcgagacagctgaggtgggggacgactgcctgatctaccacggggtcaccctgggcggcaccggaaaggaccagggaaaacgccaccccaccattggcaacaatgtgctcttgtccaccgggtctaaggtgctggggccctttaaggtgggggatggcgcccgcatcgcggccaacgcggtggtgctgaaggaaatcccggagaatgccaccgccgtgggcgttcccgcccgggtggttcgcatcgcgggggagaagaccaactttgtgggggatgtggaccaggtcagcgtgaccgatcccgtccaaaaggagctggaggccatcaactcccgcctgacctggctggagaactatttagaccgcacccatcaaccggaagagaagaaagacaggaaggagaaccaacatgaagctgtttaacaccatgacccggcagaaagaggagtttgtccccctcacccccggagaggttaagatgtattgctgcggccccacggtctacaactatattcacgtgggcaacgcccgccccatgatcctctttgacgtgctgcggcgctacctggagtaccggggcaacaaggtgacctttgtgcagaatttcaccgatgtggacgacaagatcatcaagcgggccaatgaggaggggaccacctcccaggccatttcggaaaagtacatcgacgagtacttcaaagacgcccatggcctgggggtgcgggacgccaccattcaccccaaggccacggagaacatccagcagatcattgacctggtgcagaccctgattgacaaggggtatgcctacgcggtgaacggagatgtgtactaccgcaccaaaaagtttgccgattacgggaaactctcccaccagcccattgaggagctccaggcgggggcccgcattgatgtgaacgatgtgaaggaggacccgctggacttcgccctctggaaggcggcgaaacccggggagccctattgggactctccctggggacagggccggcctggctggcatatcgagtgttccgccatgtccaaccgctacctgggcaagaccatcgacatccactgcggtggggaggacttgcagtttccccaccatgaaaacgagattgcccagtcggaggccgccaacggctgcaaatttgtcaactactggctgcataacggcttcctgaacattgacaatcagaagatgtccaagtctctgggcaatttctttaccgtgcgggaggctgcggaggcctacgggtacgaggcggtccgcttctttatgctctcggcccagtatcggtctcctctgaactattcccgagactcccttatcatggcccagaattccctggaccggctgtacaccgcagagagcaacctggaatttttggtcaagaacggcgccgatggggagatgaccccccaggagagggcctttaccgagacctttgacagctaccggcaaaagtttgacgacgccatggacgacgatctgaacaccgccgacgcggtcagcgtgatctttgagctggtccgggccatcaacatcgcggtggaaaagacccccaccaaggcgctggcccaggcctgcctggagatgctccacgaatttacccaggtcctggggctgctctatcagaaaaaagagggggaggagaacctggatgcaaaggtggaagccatgatccaggcccgccaggcggcccggaaagaaaaaaactttgccgaggcggaccgcatccgggatgagctcaaggccatggggattaccttgatggacaccccccagggggtgaaatggtccaaggcatgaactttgccaggatagaaaaagcgcaccgggagccaggcggtcagcctggctcccggttgttgtgcagggaaactcattttgaggaaactggaaaaggagaggagaaaacgatgcgtgtgaaaggaacatggcttgcccttttgctggtcctatggagcctgctgctggcaggctgtaccggggggacacagcctgcggtggacttggggcaggtggagattggacagttccggacggagcagccctgggtggagctcaacggcaaccagccggactttgcccaggaggagtacaccaccgaagcctttgagacctatgctccgttggatgccctggggcgctgcgggacggcctatgccaacctctgccccgcgctcatgcccacccagccccggggagagatcggccaggtgaagcccgccggctggcacacggtgaagtatgactgggtggacgggaagtatctctacaaccgctgccacctcatcggctaccagttggccggggagaacgccaacgagcgcaacctcatcaccggcacccgctttctgaacacccagggaatgctcccctttgagaatcaggtggctgactatatagaggaaaccggcaaccacgtcctctaccgggtgacccctgtctacgacggggccgacctgctggcctggggggttcaaatggaggcgtacagtgtggaggaccagggggcgggggtgtgcttcaatgtcctgtgttttaatgccgagcccggcgtggccatagattacgccaccggagcgtcctgggcggacgaaggtgtggggaaggggacttccccggcggcggagggagaggcgcccgagatgccctacgttctcaacaccagctcaatgaagtttcatctgccggactgcgccggcgcggcgcggatcgcgccccagaaccgacgggagaccacggcctcccgtcaggcccttctggaccaggggtatacgccgtgcggcagttgcggcccgtaaagggcggaaagcacgtcccacagtcaggggagaaaaggcattctggcggctctgtctgttcccactgatcgcttcacgccctctgccggtggataccagcagagggcgcaaaaggttatcggtgttttcggcgcggtcccctgcccgggcgggtgggggatttgccctttttatgggcgggagcggtggattggccgcgtttgccggcggcgggtttggccggggcggcagctttgctgggccggagcaggcactggggaccatagccgatgaggtcttcccgccccgctttgtgcagggcctccatcaccaaccggcgtttctccggccgcttccactggagcagggcccgctggagctccttctcgtggggggatttgggaatgtaaaccggctgcatggtccgggggtccaggccggtataatacatgcaggtggacagggtgcccggcgtggggtaaaaatcctggacctgctcgggctgacggccggtcttgttgatccattgggccatggcgatggcgtcgtccagggtgcagccggggtgggaggacatcagatagggcaccaggtactggtttttcccatatttctggttcagccgctggtatttctcccggaatttttcgtaggtgccgatgtggggtttccccatggcgtccagcacgtggcccacacagtgctcaggggccaccttcagctgaccgctgatgtggtgcttgaccaggtcggcgaagaattcaccatttttgtcctggagaagatagtcaaagcgaatccccgagcgaatgaaaatctttttgatgccagggatctcccgcagttttcgcagcaggagaagataatcggtgtgatccgcgtccaggttgggacatggggtgggggccaggcagtcccggtgcttgcacaggccgtgtttgcgctgcttttgacaggagggccggcggaaattggcggtggggccgcccacgtcatggatatagcctttgaaccccgggtgttgggtgagggcggtgacctcccggagaatgctctcgtggctgcgggaggttaccatccgcccctggtggaaggccagggaacagaatttgcaggccccaaagcacccccggttgtgggtgacggaaaagcgtacctcttcaatggcgggcacgccgcccatggtgtcatagacgggatggggctcccgaaggtagggcagctccgccacttcgtccagctcctgggtgtccaggggcatggcggggggattggcgatgaggtatcggtccccgtggggctggatcaccgcccggccccggatggggtcgtgctcgtcatactccaccaggttggccgccgcataggcccgcttgtcccgggtgaccgtttcgtaggaggccaccgtcacagcgggaaaggcgcagacgctggggtctttggtgagaaagcaggtccctttcaccgcagtgatctctgctgccggtgtgccggcggccaggagagcggccagctgccgggtggcccgctcccccatgccataggtgagcaggtcggcctgggcgtccaggaggatggagcgccggaccttgtcctcccagtaatcgtagtgggcgaaccggcgcaaggaggcctccagccctccgatgacaatggggatgtccccaaaggcctcccggaccttgttggcgtagacaatggtggcccggtccggccgcaggcccgcccggttgccaggggagtaggcatcgtcgtggcgccgcttccgggcggcggtataatgggccaccatggagtcgatgtttcccccgttgatgaagaccccgtaccgggggcggcccatatcggtgaaggaggagagctcccgccagttgggctgggccaggatggccacccggtacccctccgcctccagcacccggctgatgatggcggtgccgaaggaggggtggtccacataggcgtccccggtgatcaccagaaaatcatagtagtaccatccccgctgcagcatgtccgcccgggagatgggcaaaaaatcacgatgcttgttcaatccaacgctccttggtcgtcataaccgatgtatttttccatctcatacagcctcccgtaggccccggcggtggcgccggtgcggcggaagccatatttttcgtagaaggacagggcgggctggttggcctctgagcaagacagctggagcctctcccggcccagagggcggtagaggctgacagctttgccgatgagctgaacacccaccccattgtgccgctgttccggggtcagatagaggaaggagacatacccctttttctcctgggcgccccggttggggtccagctggagcaggcccgcccggcggttgcccgccatggccatggacaggctgcgggggtcttcttgccaactggcataggcatcgtccagaaacccggtgccgttgtagcggtccaagcggccgtagaggttctgccaggcctcctcccggcaggtttgatagaagactcggtctgcttcctgggtcaggtcgaagggggcgaaccataggttgacatcggcccgctgatccccctttttccaccagtgctgctgggccagggtggaaatttccggggtcagatgggagttgtcgtccatatagaccactttgactttgccgtcggtgatctccagcagggtgactgcggtattgtcactgtgtcccattttcttcatcccctcgggaccgatgcccaggaactccgccacagtgttgcggatgaaagtgccgtgggcgaaaaccgccaccgattgattggggtgcttggaagctatgtccaaaatggcggccacgcctcgccggcggacttctgggaagctctcgccgccgggggcccggaagtcgggggaggcggcggagaagagccccatcatggtgtggtccgtccggtcaattcccgcccaggaacggtcctcccattctcccatgcccagctcccgcaggtcggcgcgggtctggagcggcagacccttgggaacatagatggcccgggcggtggtcatggtccggaacaggtcgctggaatacaccgcgtcaatggggacatcggcaaagcgtttttgcagggcctggatctgccggtagccgttgtcggtgatgagactgttatattggccgtggatgcggcggtacaagtttccctccgcctcggcgtgtcgaatgaggtacagtgttgtcatgccttctcctccggttctgtaaaaaattgcattgttgaaatgataacacttcattatatagtaactcacatattttagcaacaagttttccggcaaagagggacacactaaatttgtctgcctcagacaaatttatggaaaggaggcgagcctatgtgctgcaacaacttctgcacagggatggtggtgggcattgccgccggcacctgcctggggattcgcttaaaagccaaggagaagaagatccgccggggcattaaccgcgccgcccgcaacgtggaacacgcctttgacaacatgacacgttgaatatttggatttttccaaaaaaatttccaaaactcccttgacaaaagccctcccatctgataatataactcttgcctcaagcgagaggcgaaacgaatcgggggtatagctcagctgggagagcgcttgaatggcattcaagaggtcagcggttcgatcccgcttatctccaccaaagggtacgcaaaaaggcttgttttcgtaagaaagcaagccttttcccttttctgcgatgaaatcggcatatccgtgccatctcagccactccctaagggggcattccgtgtggacgcacccctttttgtgtcccaagttgggacggattttgccgatcccctttcttaagtcaataaaaaattattttatttgagatgtgcttgaactaaatccaaaaattcgccaatatcggcaaagtaatttggataagcggcctttaattcactaaacgacgcagcgcgaacaagaacagcatctatttcatcttctgcatgattgctttcaatctgagtatatagagtattggcttcatcaatttggctgggagaaaaataacgaatacggagttttcgtgtgatatagttcaaaatcagaacataatacccctttttgtctaatttgaccccattttcatggtcaagggcgactctaatagcgcttagaatttcaagcaaatgatactggtcgttgatctgttcaatttctgaaactaactcattttcatctttaaaagtaccgggaatgattggacaattttcccgcatcgcaaatagtgaagaaactaatacaaaaaagcgctttacataccctgccccttgccctgctttcaatgcctgctttgtaaacaatcccatggtttccaatgcagttgcccaaacgtgctgtaagcggctgcgaaattggatttcaactaacatattttggttgtaagcatcctttttttcgctatggtacttgtatacaaggtgaagagagcgatagcctgatggttttggattatgaatgtaatcatatgtacgtttatattcatgtcgaacacgggattttttgtattcttctgcaaagtgaaacacttcatcaacagagggagtgataaatctgcatccacccaagtcttgcattcgccacagatccattcttgtttctcttctgagttttccaatgattgaatctaatcgctttagacgctcgacaacaaggatatcgttgcgaggcgcagccatcctccgcaagtgtatgtagataacgtgcattggataggcatgagctgctctccagttatcaatcacttgggttgcaaaagctaattcttctgctgttgtgttatctttgcgaataatattaccggcatcattgatttgacgttttgaatattcaacaattttccatcgctgctgctttatttctggcacttttatgtttctcccttacagatgaaaatactttgtttttattatatcaatcatcaatggcaaagacaacctcctactaacattcttggaaaacgtgacgccggaagcacataggggtgcttccggcgttttgtgtctgaaattcggggccaatttagggcatgggaaaaattttgcccggattcaaaatcattttggggtcgaacaccgccttgatgccctgcatcagggcaatgttggtatcccctgcggcctgggccaggtatttgattttcccccggccgatgccgtgttcgccggagatttgaccgcccagctccatggtcttggcgtagagcttggtcataaaatcgtccacttggcgcagaaattcttcccgctccatgtcgttggagcaggtgtaaatgtgcaggttgccgtccccagcgtggccaaaggattgcaggcggaagtcatattccttggccagctgatccgcgaaaaccacatagtctggaatcttggtcacgggcaccaccacgtcgcactcgtccaggagcttggtctgttcctcgatcccctccaggaaggaggagcgggcggcccaggcctcttttaacttttggggggtgtccgccaccagaacatccagggcactctcttccagcagtagggtggccgcccgttcaatggtgggctccagggcctccatggaatctccgtcaaaggtgatgaggaggtaggcgcccacgtcggtcccctcaatgacccgggggaagacttgtttttccaaataggtctcggaggtaattagaatctccttttcaaaaaactcaatggcctggggattcagatggctgtggcgcagtttgggcacggtggaaatgcaggtgggcaggtccgcgaaaggcaccaccaagctgatggtggcccccggcgcggggatcagctttaaggtcagctcggtgatgatgcccagggtgccctccgaaccgatcatcaggtggagcaggttgtagcccgagctggttttggagacggcggagccaaactgagtgacctctccggtgggcagcaccacggtcatggccttgacgtagtcccgggtggccccgtacttcacccctcgcatcccgctggcattggtggagacattgcctcccagtgtggccagcttttctccgggatcggggggataaagacatccgtgggacagagcgtcctccgccagttgctggagcaaaaccccgggctggactgtgaccgtgaaattttccaggtcatatcccagaatccggttcatgcgggcggtgctgaggaccacgcctccaaaaacagggacgcagccgcccaccagccctgtgccagcgccccgggtggtgacggggatgttgtgtgcatagcagagtttcaccaccgccgcagcctcttccgtggagagaatttccacggcagcctcggggggatggaccccgtagatgggcatttcatcccgaccgtagtcgggattgacctcactgccggcagtgacccggccggggacaatggattccagttgtgccaggaactcttgggtgacaggttgataggaagccataacggccaacctccttttgcgtgtatgggcggaccggtgcccgacccgatgaaaatctaatgcccacagcccgcctggaggctgtggggggaagaactgtattctcccgtttgaacagcatagtattttggcacagaacgggaatgatgtcaagataagacgaaatgccctgccggacaaactgttccatcgcccgccatgcagtggatgaagatggcgtcaatcaggcggctgtgtcggttgaaatggttggagatcgcttgatgtagcttataaggggccttttgtgcattccctccgcatccctttcaaatcggggaaaaagcctctggccagttcccttgacaaaccagagcgggactgctatcataaaaacagaaagggcgctgcaacaagcggtttagccctgtgaagtgaatctaataaaagcattagaaaccgtcacttggccgagtggcggtttctacctttgatgcgaatcgttacggtgtatccgaagatatgtaacgtaatcgtaatgggcatgggcctcacctcctttcggagggtgtggctaaaccgcctgccgttttgtgcagcgcctctttctgtcccctttcggggcacgtttatcatagcatgctgtgttgaagattgtcaatgagaggggattgttgcacatttcctctgcattccttttggatcggataaaaggtccccggtctgttcccttgacaaaccggggaagggtgatataataaaaacagaaagggcgttgccactgcggttagccccacatatctaacttagtttctaagctgaccgtttgggtgccaccaagcggtcagcacgcttttatggagagtatgtaggccgcaaagaccaagcatacaaaaaacttccagaggaagtttcccatccagcctcacctcccttcgcagggaagtggctaaccgccgtctatgtaacagcgcctctttctggccccgctttggggcacattcatcatagcatgctgtgtcgcagattgtcaatttttgcggtcactttgacgggggcagttttttgtttataaggggatcagaacagttccgttcaggaggtactccgtgtaccacttttttgacccttacagcaaatctttataaaaatttataaaaagacgctgcttaaaagcagcgtcttaaaatttggtgttatttctgttgcagccgttcaaacaggcgctgcattaactgcatatcgtgggattccagtgcttccgtagaagtcaacgcgttggaatgtcgctgtgaatggagtgccccctggtcgaaaaactgcataggggttattccgaagtattcgcatatattaagaaactgcgccatggagggcaatgcctttcctgatgtgatcccctgaatatagtttcggttttggcccaggtctaagctcatgcgatattccgaaacgtccttttgtatgcggagttccgtaatgcggttacggatatagcttgcatagtccaccacgaggcatcaccctgtacaagcatacaacttttttcgacagcagtagacagaatgaataccttaaattatgcgaaaatcggcatttctgcaagattgaatctggaatctgctggtgagaggtggaatgcggttgtactttgccgtatactcccgaaaggaatagaatcgcttcgtgaaaagggttgtcaaaaagtgctgcgcctctgtttgatgtgtggaaagaataccgaggatggtaccagggaaggctctcaatcatgtgagtggcatcttctgttgtggaggaaagatttctccgtgtgtttaggttgggggcggttgtggggtgtttccatcgccgttggaacggcagggaaccttggcttgcccagccggagccccatttcttgggaagaaatgggggaaagaacccccgggggaggaggttcctcccccgggacccccttctctggtgggtgcgtgggggaaaggctgtacttcttacaggatacctggcctgcggccctctcgttgtcacgctggtaacggcccgcccaccggctgggcgggctggggatgtgagtgggtaccctttgggagaaggcggagagtagcctttcgattttccatgctttcctaccgtcaacaaaccacttctcccgcccgcccgagctggtgggcgggccatgaggcgttggtcttagaggccgcaggccaggtaggccaacagaaaacccacgctgcttctacaacagtccagagaaaaagggttcggggaaaagaaactcttttccccggcggggtctcggggcagcgccccgagtgttctttcccctatttcttccaagaaatagggccccgcccgggagggcaccgttcccgtccgttccaacggcgagggaagccccccactccccccctgccgccgcaaaacacagcaacaaaccaccaggattggagaataggatggacagagaaaataccgccgcagagtaccccgaactgcccttccgccttggcgacgagctggacggcctgggccgggtgattagaattgaacaggaggggccgggggtatattacgtggccgccaaggacccggcgggggcgttccgcctgccgggggagtattacgtggtccggcgggattctccggccatcccccgggaggcaaagacttatggggttccccttccccagtatcccatgctcctgtcctacgccctggatgaggcggacaatggacatagaatcgtgcgctatgagctgtataaataccggcttcagcacggcctgcccctgccggagcagagcgccctccgtgacaccgcggtatacgggatggagcttcacccggagtattttggaccctacccggtgcccctccacacgccccgggggaatactgtgcgccacaagaggctgctcaacggggtgtactggatcgagaccgatcagtgccgggaattgctggcggtctgctatcccatcggacagggggacctgccggtaatggtgcaggagtgggccctgcaaaccgactatgaccggacccacggcatccatcataccctgggctatctgtttttcgcgggacgccacctctgcgtggctctgtttgagctgatgcagctccaccgggaactggagaccaacggcatggtggaccctgcggcgctgatgaacgccatctggcgggacaatcccgcctatgccgtcgtctataacctggaggaggcgctggggctccacgacacctttggccttttgatgcagcaggtgggggtggagcaggaattggtggggagcacagagcagatgatcgtctattctcccgaggcgggggtgacgttccttcgctttcaggggtgagaacagaaaaaggcgggggctctgggtttatcccagagcccccgccttctgaaacggggtcagaggccaacctgatacaggggaatcacgttgatgaccggctcctcgtaggggtgtacggcccggatggcggccacagtggcttccacccgctctgtttgacaggtgacttccaccttcagttcttgctcccggctgagagccccttgggttcccagatatggggtggttcccgccagggggcgccaacagctggtgaccggggaataggacagacagctgtcataggccccgatgtgtccggcgtccacctgccgcagagcggtttccaagggggagagatgggaggcggggagaaagatctccagcttacaataggaaaacgggcgcatgtggggtctcctttcccggcgaggggggtgagacgcccacgccgtctgggtaataggtgttgagggttaggatgcgggagtcggggtcccagtccccctgccagggatgccaatgtcccttgcccttggcgcggaaatcatagaccgggaccatcagctccccaaacagcagccgggccggggccaacagggtggaggcatcaggatgggtttccaggtccccggggcgggttccctggagacagcggtcccatcccgcccggtaggcgtagaccatgtttttctccaggtccacctgctgccggcggggagaccagcgggcgggatagcccactgcagggggcagggaactcagcccccgctgaaagcgcagctgggcctctgcctgaaacaggtcccgtacacaggcgtaaacccgtccctccaccatccgcaggcgaagggcggggtccagcatctggaccatggtgtcctcgtcatagtggcggaggcggcagcggaaggtggggatgccctctccggccatgatcctctggacctgaagggccattgcctccgcctccgtctgggagaggggggcacggggatggaagcggccgccggtgtggcctgggagaatccccgtctgaacagctgtcagggcgtaccccgccgtgccggcgggaaactgtgcctgatctgaaaagcccggagaacaggtcgccgcctgggcagcgggaa

SEQ ID NO: 2224 - DNA, 119748 bp, KLE1738
gcctgtcgcaaatcgtgcaggaggggcggttccgtggcgggattgtcccatatggataccgcctggaaaagcaggggcgcttcaataaaaagaatcatgaagtcaacgaaattctgattgacccggatgaagccgctgtggtgcgcatcatctttgaaaaatatgtccatgagggcttcggcgcacagcggttgtcccggtggctatatcacaacggctatctcaatcgaaagggaaccaacttcgccaataccaccatcatcaaaatgctgaagaacatcatgtatgtaggcatcctgcgcagtggggaaacacgctcagaaatctttccagagctgcaaatcgttcctctggatctgtatgagcgggcacaggagctgatggaggccaggacaatgcaccacaatgaggtgccctttaactccaaggggaaggcgctactctccggaatggtctactgtgcccactgcggttccaagctgatgctgaccaccagcagcggcagacgtgccaagggtgagcccaagcgggaaacccgcatccgctacgcctgccactacaagatccgccatcctcaggactgtgatggtcagaccggatactccggcgagaaactggacggcatcgttgataagattgttattcggctttttgaacggatgaagactgcccccaggagccagctcattcaaaagcaacgggagaaggaacttcaactggcaaacagttcggtggccaatctggagaagctccatgccgccacggagcgggagctggaaagctacaaaaaagagatcatcaagaccatcaacgggactggcagtttcggagcagatattctcggtgagatgatagaggaaacccggaacaaactgttggatctggcacaggaattggaacaggccaaagcaaaagcggctgatctggagagttctgccgttgctattcaaaaggagtatgataagatcatgacctgggccgacctgtatgcgggaagcagcatcgagggtaagaagatgatcctgcggcagctcattgatcgagtaaatatcggcaagaactttgaaatcgaagtagagctcaacatcagtgtgatacagttcttcgacttcctgcatccagaaggggacaggagtgtgtactatcgcgcttcctgagtgtataaaaaactcgggagatctcaaaacgagatctcccgaatgtggcaaatgaccctaattgtgatacaaatgaacccctttttgcgtcagggggttcactttgtgtaaagggggttcactccgaaccgagaggggttcactctgtccacctcaaaagcaaagaacaactcaactgccgagcgaactaaccctgcggaggtagcagctcttttattgctacccgcagttctgtcccaacttcatatccttcattctgataatgagactcaagcgttttatggtagaaaattaaagaaacgccgcagtgtgaggattcctccaatgctgacataagacgtttccctatgccagccttccggtttttctctttcacaaacataaactgcgggtacaaggtatcgcagagaactccgccatatataaaaccgacaagctctgttccctcatatgcgacaaagcaattatcccggtactctttatagcgtagcaaagcccctgttgtcgctttaacttgtggagaataccattctgaatcatcacacagatcaccgaattgcggtatatcagagaactcaaactttttaatttgaacggaatcctccatacgttttgcactcctcaactccgcaccctaccttaaatagaagggcactacctacagtgcttattttagcacagatagtcgcacatttccagtaaaaaaacagccaagcccacaggccactacacctgtgggcttggcgctattctgcggtcaaaccgtaatctcatgccctgtctggaacttaaaggtcagccgcccgtcccggtggacggtcacggtgtcgatgaccgtgagccagagtcgatcatcgaactcggtgatggaatcgccgtactccgccagctcgaacataaaaccgccgatatcctcggatttggcttcccgctgagcctttgtcgcctggagcttctccagcttggccttggcggtttcgtaccgctctgccaggccgttgtagcgttccaggtaagcggcctggtcctgcgccgtggtggaattctcctcgatgcaccgcttggttagctcggccaccacctccatttcggaaaggagcgccgctatctcgctgtccagggagccggtatcggtgagcgccgcctgcatggtgcggcactcgtccagcagccgctctttgtccgctaccagcgcattgaaggcgtccaggaaccgagccttgatctcctcctcggtcaggtgcggtgtctggcacttttcttctccggtgaacttgctgttgcaccgccagatagtgcgccggtatttgtcggtggaatgccagaccttggagccgaagtaaccgccgcagtctccgcagaccaggcgggaggaaaagatgctgttaccgctgtagctgcgcccgatggctttcctgcgctccagctcccgctgcaccagtttccactcggcggggtcgatgatggccggatggctgttctccacatagtactgcggcacctcgccttcgtttttcttctgctttttggtgaggaaatccaccgtgaacgctttttgcaggagggcatcgcccttgtacttctcgtttttgagaatgctctccaccgtgcttgccgcccactttttcttgccggcgggggtgggtatcccttccctggtaagaaggctggcaatagaacctgtggtctttccgctgagaaacaggctgtaaatccagcggacggtttccgcttcctccggcacaatctccggcagaccgttgtcgcccttccgatagcccaggaagtggctgtacggcaggctgacctttccatcggcgaaacgctttctctgtccccaggtgacgttctccgaaatggagcggctctcctcctgcgccagggaggacatgatggtaatcaacagttcgcccttgctgtccagggtgtagatgttttctttctcgaagtagacctccacacccttctctttcagcttacggacggtcaccaggctgtctacggtgttccgggcaaaccggctgacggatttcgtcacgatgaggtcgattttcccatcgagcgcatcccgcaccatttggttgaagccctcgcgctttttggtgttcaccgccgaaatgccttcatcggtgtagacccttacgaactcccattctggcttggactgaatgaagcgggtgtagtagtccacctgggcttcgtagctggtgagctgctcctcgctggaggtggagacacgggcataggccgctacccgccggcgcaccacagcgtttcgcgccaggtgcgtgatgggctgaatggtgggcgggatgaccgttacggctcttgccatttctcacccctcctttgcgccagcgcccgctgccgggcgatttccttcatttccggcgtccagctcttggccctggatatgtgttcccaatgccgctctgccgtggagccgtctttgaaatggaacaccagggtcttgtccgggggggcatcgatgcccttgactctttacaggaagacgccctcatcaaactgtgaaaggccgagtacctgggcggcaaggtcgtagagcaccttctccgggatctgggatgtgccgcaggaaggcagatctgtctgcaccgcagttgggcagttccagaaatgtcgctttccgccggtacatcgcttgtagttgcgaccgcacaccgtgcaggtaatcatgctggtaaaggccgaccgccggcggggccgcttgaccgggctattctccgtaattccggtaagaagctcctgggcggcatcgaaagtggcctggtcaatgatagcttcatgggtgccctccgcatagtattggggcagctcaccccggttcggaatttccttcttctccagatggttgttccggtactgcttttgcaggagcgcgttgcccaggtacttctcattggacagcatctcccggattcgcatggagttccactttccgcccagaacaccagtgaaccctctccggtttaggtcgatggccaggctggtaagggattctccctccaaagccctgcggaatacctcttgcactaccgctgccttttccgggtcaacggccacgcggcccttctcgattttgtacccgaacaggaagcgaaggttgaccagctcaccgcgctcgaagccccggcgaatccgccacttctgattctcgctggcggagcggctctcttcctgtgcgtaggaagccaggatggtcatcatcagctctccgtccgaactcatggtgtggatgttctgttcctcgaaataaacgtcaacccccagagctttcagctcccggacggtttccagcagggtcaccgtgttccgtgcaaagcgggagatggatttcgtgatgaccatatcgatgtttccggcgcggcactcagccagcaggctttgaaacccatcccggccgtccttggtgccggtgaacgcttcatcggcgtagaccccgcagtaaagccagccagtgtgcttctggatcagcgcgctgtagtagctcacctgcgatgacaaagaatgcagcatggcatccttcccggaagaaactctggcataggctgcgacccgcttcaggctgggccgcatgggtgcggggaatgaaatttgttgaatggttcttgccattccgtcacctccttgtccagtgcatattacctctcaaagggcctgttatccagcgatttcggcgattcaaagcggaatatactacacgaagatacctcgtgctttttggcgataattgtatcaattttgcagtagtcatcctcgctgatgatgccctggcggagcatattcctggcaaggctcatggcggtctgataggcggtcagccgctggtacagctcatccatcggcgctcaccgccttttttccgagctgcggcatagcaggtgcgggagcagtaacgccggactttcgcaccgctttgaaacgagcgcccacaataggcgcagttaaaggtgtagagggtgcgctttccacccttgtcgggatggtcgttccaccaggagatgcggcatgagtccgagcaaaaccgctttcgctttcggtggggtgtctggatgatgggcttcccgcacctctcacagatgtctggaacggcagcggcattctcgccagcgggatggcggcggaggtaggttttcacactgttgaccggcagggccagggcggcggcgattttcttataccccagcccttcctgactgagtttatggattctgagcttttcggcttctgtcataacaagcccctttccgagaggcataaggcacttctcaccttacagccacggaaaagggcaaatatgaggatgacaaaaaaataaaggggtgcagccacgaaaaacatgactgcaccccttcggctgggcggatattcagttggggatcttcagcttctgaccgctgtagatggtgtcgccgtcaaggccgttgagtgccttgatctccttgtagcgaacgccgctgcccagatacttctcggcaatgccccagaggatgtcgcccttgactacggtgtggacgcggtaggtcaccgccgcgctccccgccagcgccaggtcggagacccgcaccggagacatgatggcgttggcgccgctctcgtttttgttgatgaccgcacggtcgccggaaacctcgtaaacataccacttctgcttccgcacccaggcggggatggtctggccgccgtagtacttcgtcccggtgatggtcaccagatcgccggccttaattttaccgccgggctgctccggctccacaggcgtgtccggcacagagccgcccagcttgtccttgaccgccgcacggaaagtgtccatattcttcccgtgcttcggccaccagtgcagcacgtccccgtggttggacgcgatgcccaggtcatggccttcgcagtggcagatgatgtcctgctctgtcagaccatagagctcgcagagatacacgcagagatacaccgcctcgttgtagaccttgtccagataggcggcgtccgtgagataatcctcgcagatctcgaaagagatgtgggtgtcgttgccggaaccggcgcagtgccagccccggtagtcccacggcagggtctggtaggttgccacagtcccatcagccagcttgccaatgaaggcgtggacgcacacctcccggtccatggactggttccagtggttgttgtactggttcttgccaagcagtccgtcatccggtcccacgtagcgtttgagccaagggttgttggcgccggtggagtgtaccatgatgcccttgggggtgattcggcgccccgccttgtagcaggcgttgttggtgaaaatcagtttatgcagattcattgtcgtttcctcctttgtcatgcagttgttccagcacgtctttcagcttctccgggatgggcaggcccaggtgtccggcgttctccaggaaagagatgccctcattggacaggtagaagaagatcaccgccgtgcgcagagcgccgccctctcccagcacatacacgtccaccaggttgccgatgcccaccagcacaaagatgagtaccttccggcagatgcccttaaagcccacggcgctggacagcttcttgtccgcgatggcgcacatcacaccggtgatgtagtccaccagcacgaaggcgatcagcgcgtagagaaaaccgtccacgcctcccaggtaccagcccaggaagccgcccagggcggaaaaggcaagctggatgctgacccagattgatttcattgtctcgtcctcctttgatttgaatatggaaaagacgcccccccggcgggagcgcctttgtcctcatgtcagccattccggtttctccgggatggtttgtgtgttggtaccgtccagccatgcgcggtaccaggtcttcagctccgagagctgctccccggtgagagcgtcataccacagccgcccccggttgatgacggggaagcactccgtctgccgccgctgacggtatgcggttttcgccgcctctgcctgttccgcagcggcctgtgcgtcatcgaagaccaggacgccgtcctgcacccggtaggcggtaaagtgctcctcaaaatgagagaggtcagccggttccgccgcttccacagcgtccagcagatccccctcaagggcgtagctcaccacatagccctgttcgttcagcaatactttcataggcgtcacctcagttgaccccgaatacacggttgatctgtccgttgccgttgcccatggagagcgtcaccagggagccggaataggacaggttgaaggatttgtagttggactcgtccgcgatctggaaggagacagcggaggtagtcagcatgatcttcggcaccaccagggacgcacgggacgccgagctgttaggccggcctatgaacacatagaagttgtagttcccgtaattgaaggtgatgctcccgctggtcagcgtcccgttgtagagggatgtggcgctgatgcccaggtttgtccgagccgccgctgcggtcttcgcaccggtgccgccgtaggcaatcgccaaggcgttggtcagcgagatggacgtccaggaattccggtcatacgccattttgaccgcatagggcgtcgccgccagcgaaccactggtagagttcaggctgttggacagcatggtgatgccgtaccgggcggtggtagccgggagacagttcagtgcgatccaccacgtcccgttatacacaaaatgcaccatctggttggctgtccacatatttgcgttgacgtagtatccgttcgttccgcagatggctatagccccggtcccgttcacattcatggacggagaggttgccgtgttggcgtaggtgaactgcaccgccagcagcgcccccttctccagcctgaactcatcgcaggtgaccacctttgtctgtgtggcggcggcggtttcgcagacgccgaagtagggtttgtcaaaggtgtagtcgatgtcatccgggatcaacgtcccctcaatgcgtgtgtctcccaccacatgaagcgccgcctccgggcttggggtattgatacccaccatcttcttgcgaagcgccaccaggggcgtgccctgggagacaacgaaatacagatccagcgaggtcagcgaattgagctggtcgcggatctgcaggtggaagtcataggacgattcggaatcaaggttgcacagctccagattggaaaaggagaagctggaactggtggcggtcaccgagctaaggatgctggtgtagctgttgtacgaggacgcactggtgagcttatagcggtaccgagcatagagcaggctgttcttctgcgccccatccaccgtgatgggcgaaatgctgccattgaacacgagctgcatctcggtctcgatgtcgttggtgcgccgcagggacacgtagtttaccctgggtttcgagtacggcgccacagtgacgctctgggtaacggatgcggtgtatccccgcgagtccgtcaccgttagggtgatgtcccgtgtgccggatgtgccgatggtccccagggagagggccgcgcctgtggtgttggatttcgtcacgccgctgcacaccgccgaataggacacgatggaagcgccgttcctcgccgtagcggttccgggggtgactgtcagccgggagtagtcctggatgagcacctggtcgttgtccgtaatggcggtggtggtcgagtagctgtcagcgaaggtgaatccggagatgctcggccccgaatttgcctgtgaagttcggatggtgcaagtacaggtggatgcgctgccgatctgggtacttccgctcttggttaccagttcgatggtggcggtgaaggacttgacgctggccatggcgttcagcagcgttgtccgctccgaagaggtcagggtaatggtgcggttagctgttcccgccgaccagatgcgccccgccagggacaggtaggtcgtggaaccgtttttgatggtgatatagttggtgtaagcggcattgtacactgtcacccgcagggaaaggctgatggaagcagtgtccgccgcaaaactgccgcagcttaaaagcaccgcgcctcccagggtcttggcggatattgtggaagaggtgccatacacctggttggcgcgctttcttgcccgtacccgcaccgagtaggtggtgttgggcgaaagcgtggaaagggtgacgctggcgctggtccccgccgtggtggagaactgcgtccaggaagtacccccattcaagctgtactgccagaggtcggcggtggccgaggaggatgcggagatcttaaacccattggcagtgatgctggaaaccgagcaggacaccgtgggagcggagcggtcaatgctattcagggttacggtggtggaagctgtaatagttccaatagacacaccggaataagtgccggaaaaccgccacgaagcggaaagtgccacgccggatttcgttccatccgcattgtggctgaccctcacggtcttggtcttcagcagcttctttttccagccgctggagtaatcctcgatggcgggtacggtgtaggtttcgctgacgccgttgatagagatggtggagtcgcttctcgccccaacatcaagggtatagtaggacagatacactttcagggtgacatcggtatagttggcggtcacgctctgtgcgccgctccactcgcagtacaggccgaagctggaaacgggatagttctgaaatgtgccgctgagagccattgctccacctccttagtccagaatcacgatgttcagcccctcggacgctgtggccatggggacgaacttcgtcttgcccaccgtgagttcgccgtccacggtggttttctttgtgatggtctcatccttgttcagggagaaaatcttttcctcgttgtagtagccggagaattccgtattgttgatgaccgtccgctgggctgagtccgcgttggacacctcgatgccccggcggtcgatctttacctcggaggtgtaaatctcattgggcgccggcgtccatttgtgaagagacgccccctccgtcagcatgatgtccgagacgaacaggctggcatcgcgggagtagattttgatggtgatgacgctgtcctgcacgtccgggagcagagcggtgtattccgtccactcaaaggacaccgaggtattgaacaggtcgatctccgtatcgccgttgatgacggcccggacataggcgttgtaggtggaggttttcttggccttcaccgtcagccggtaggcctgacccggcacgatgctgtccaccacctgggtcagcgtactgtaggcggcaagctggaagcaggagttggacacggtactgttcttggtttccgcaccctgctgggcggtgatcgtcccggcataggtccagtcatcggaaaggccgtttaagccggcggagttgcggacaaagttgatgccgccgctgtactgctcctgcatggtgagggacagcccgtccaccgactgctgaagctgggacatctgcccctcgatgagccggaggttttcctgctcctccgtcagctccccggtgacgtcctccaccgactcggtgaggtcggccacatagctgttcagcccatcgatggactgctggaactggctgaccctgccgctgacctcctccagggagtccgtggtggcataggcgctgaacatgacctcgccgctttccagatcccaccaggaggaaccgtcctgggactggatcaccccggccttaatgatgttggcgatgagagagccggaggtgatgaaatccgccacgatctgcccatcggcggtgatggcggtttcataggggccgttgtagccgctgccggagaagccaagcccctccacattccaccgccagacattgaccgcatcctcgatggagggctggtcaagaatcagcagctcgtaaggaaggccgctttcactgtcggtgtgcagcaccacatagccgccgggctgaccggtgatgcggtcggtggcgttctggatggcggagttcatcagtgctgggaaacgaccagccttctccgccgcttcctccgcgccggctttggcgtccgagacgttgttcagcagattggccttgccgctgcccagggtgacggacacatacttctccgccagggtgtcgtaaaccgtggtgatgacttttgccttggcggtgatgcccagagcggaatgccggatggtcacggtatcgcagagggacacccgctccagcacggcggcatactccggctgcttccacagcggctcgaaagaaacggtgagcgcgggaacctccacccccaggggattgttcgccaaatatgtctgcgccttggtgcggagagcatcctcggtgatggcttcttcctctccaaagctgtcggtaaaatcccggatgagggtcttgcgctgggacagcgtggtgtccgcaatgggaagcagcacctcggtgagggtgaccaccgtttcgctcccgtcctcggcggagatcaccgcgtaaggcagcaggtcggtgtacacctcggtgatatcactgtcgtgctccagctcggtgaggtttttgccgtactcgatcaccacttcggtatgctggccgcgcccctggtggtggatgacgtggaagttgtcccactcatactcgccgccccacagatcaagaaaggaaccggccacgccgcccagacaagcacggacgctctggggcttggccacggagaagggctttgcctcggagtagtctgtctgacaggtgaagctgtgggcggtggcggtgttctgaaacacgcgctgcatggcaagagccggtgaaatgctctcgctggaccaggtcaaggcggcgatattagagaggtcgtaggagatgtgctgggcatacaccgttaccacgctatcaatgggcgtggtgatgcggtagatgcggaaggcctggtcatcggcggtatcattgggtttggccttgatgatccgctcagaggacagctccccatagttcctccctgtgacggggtattggagcaccagctcgtaggtgccgtttcgctcctcggtcacctcacaggagatacaatcggccagcacgccgatgccgtaggtggagaaatccaccgcatttgctttgaacagaaccggaatcatagtgtcacccacctcggctgtaccaccaggctggtcaccgtccccacccaggagatggtgttgacgccgggctgcagcctgggaaatccgtccccgctgaccttgtcgttcatgggggtcgtgccggagtaaaagttcatctgctcactgtcgcagacgatgctcccgtccagcccggtaaagacccagctcttgttctgaccgccgccctgtatggtcagggtaaccgtcccttccccggtgagggtgaggataggcagagactcaaagctctccgggttggtcaccgtggagccggactgtgtgagggtgatgggctcagtccccgccacactgtaacggaagggctggcaggagaagctgacggtgaacacaccgatgcggttgagctgatcctcgatgtccaggctcccggaatacaccgcctttcgtgtgtagagggtatcatagctgtcggacagggtgtggtaggcgttctgctccccatagagccaggcctccttgaccttggtgatcttctccgccagttcggcgatggacttggcgggcaggaacacggaataggtcacctgcacattggggtagcggccattgggcaggatgaggtcgccgtttctgccggggatggactggaaggtcacatcgtactccggggcagaaaacacattcttgctctcaatgcgaagccccatgtccagggacgaaaccccgttatacacaaaatagttcatgcgaagaccacccctttccgcttggcaaactggccggcggtcaccatgatctcattggtgagctgccggatgtcctcattggtatagttgttgaaggtgccgatgttcagctgcaggacgaagccgctcttcccagcgccgccggaaacagcggaggccatggcgttttccatgctgcccttcacggagaaatctgtgggcagcgccgtggtcatatccttggcgaggtcctgcatgaccccgttgatgtccttgctcatgccctcggcggctttcaccgcctgaccgccgttgtccacaatggaaccggcaaggccctccaccagcatttcgcccacccaggccatttctttggaaggcgagttgatgccgaagaagcccaggataccgtcccagatgccggagatccagccggacactttgtcccagatccatccggccagtgactggatgccctgccacaggccgcgcaccaggttggcgcccacctcggcgatcttggaaacgccctgaccgagggccgaaacgatccccgtgatgatctgcgggattgccttcacgatctccgcaatgatggtcgggagattcgcaatcagggataccagcagctccacaccggcctggatgatttgagggatgctgttgataagagcgtttacgatgccggtgatgatctgcgggatagccgctacaatggtagtaatgatctggggcagcgcctggatgagcgacaccagcaggtcgatgcccgcctggatgatctgcggaatggagttcaaaacggctgtgataatgccttcgatgatctggggaatagccgcgactatggcggcgatgatgtccggcagagccgccaccagcgaggtcagaagctggatgcctgtctcaatgatctgggggatggcgtccagcaggaaggtcacgatgccgttgatgatctccggcagggccgcgataagcaccggcagggcgttgaggatgccctgggccagtcccgtaaccagctgcaaagccgcgtccaggatgaggggcagattggcgataagggtctggcagatctgcaccaccatctgcacaatggtgggaaccagctggggcagtgcggaagcgatgccggaagccagggttgccaccacctgcattgccgcctgtaaaagctgtggcgccagctcggtcagactggtgacgagctggagaacaatggacagggcggctgcggccagtttgggcagcgcgttcacaatgccggtgacaagggtggcgatgatattcaccccggcttccagcagtaccggaaggctggcgaggatggcttccccgatgaccggcacaatggtggagagcttctccattaacacagacaccaggccggagatgccctcggcaaaagtctcggcagctacggcggtgccgttcagcacgccctgcaacccctcgcccatgagggacacgaagggaatcatggcggtaagaacatccgccgccatggtcttcagcgtggtcatgatgggttccgcaatggcgcccagctgggcgtaggcgtctgtaaggagcgcctgggcacgctgggcttccatcacatccccattgagggttttgtagttttccgccgcttcctggtacaggccgttgagggtatcggtgatgagcgcggcgcgttcctgctcggaactgcagccatccagcgccgactggaaggcctcctcattgacccctgcccagttgagggcgtccgccagctggccggtgatggtgccggtcttggcggtctcattggcggcttcggtcaaaccttcaatgggaaggctgtccccgaaggtggcccacacgccggcggcgatatccgtccactgcgccagctcttcctcggtggagcagagcttggcgaggtggttgactgcttccacgctgcggtcctcttcgcccaggatggcataaaagccggtgtaggcttcgccggcttgttccgccgtaaacccggcggtggtgaaggctgcgtccagcttggcatgatcctcccggtatttccgtgtggattccgccaggtcgaggaaactcttggtcagcccggcgagggcggcgccggcggcggcaacagcggcacccgccgtgaccgccaggcctttgaggacggagccgaccttctccagcttgccggaagccttatcggtcttgtcagcggcgtcatcgatctcatccccgaacttgtccgtctgctgggctgcatcccgcatctcatcgcccatggaatcgatggccctctggttctggtcaagctcccgctccatgttgttcagagaggcctgggcattgttgagctggatctgccactgctgggtgcgccggtcgttctccccgaaagaggtggaagcgttctccagcgccttgcgcagggtctcgattttcttcttctgggtatcgatctccttgcccagcacctgattccgggcggtgagggcttccacggaatcatcgtttttgtcaaactgggactgtacgaccttcatttcggagccgaggaccttgaaggactggttgatgtccgccagcgccttcttgaattccttttcgccctccagcccgattttcaggccaaagttatccgccatccgtggtcacctccttcaaaatggcataaaaaaagcccggattactccaggcaaaagaaaagagccgatgactcgactctttccaaaactcgattcagtttccttgcatttttcggagctgggcgtcaatatcccgcccgccgtacatgacgcagagcaccgtgacggtttttacctggtggtttgggatgtagaacaccaggtaattgtccaccggcatgacccggaggttgcggctgctccatggctctcggtcgtagacccggaaccgctccggcatctcatccagcttgaggatgttctcctccaagcggtccagctggccattggcgttttgctccgactgaagctccaccgcgatatagcggtagatttcccgcaggtcgtgctttgcttccggggtcagcgtcacctcatagctcatacgcccagttctccacgcagctcgtcaaacgcctgctttgcagggatgacttgcccggccttcatctgggcatagcccttctccagttccgtatccatctgttctgccgtcatacggctgacgtccagcggatgctccgggagctttacctcgaagggcagtccccgctggaggatgacctgcttgtagaacatggtgatggcattggacgccgggatgcccagggcgctgaggatggcttctgcctgttccttgacctccggctcaatgcgcgcatacagatttgccgactttgccatatccaagactcctttcgggatttatggtttcttcctcgtctccattgtactctgttgtgcggacaaaagcaatacattattcaaatcccgtagggaatcacatcgtcaatggtcagctcccgcttgggcttcgccaggccgaggaactgcttgtggcactcccacagatccagcagcaggccaaagggcaggagcatggtttgctccggagtaaagcccagctgggcggtgccgtaatagaaaagccgggtaaacagctcggcgtctgttacccgacttgcgcgttttttgagtccatctcgctttcgatattccgcttggtgcccttatacatggcttccatgatggcttccttgtaccccgccagctcgaagggagaggtcagcagctccacggcgtcctgggtcagcggctcctttttgtcctccgggtgctggaggttgtggatcagcacgctctgattggccagcagggtgataagccagatgatctcatcaagcgccatctcaaagttctcggacttcatcagcctgtcgcccaggttctccaaaccgccgtagcgtccggcgatctccttggtggcacgggtggtgagtaccagctcatactccttaccgccgatggtgatggcggcgcttcgctccttgctcatgggtcagccctccttacgcggtttccaacgtgctgtagtccggctcatacacctcttcgtaccagccggagatggtggcaggcagcacgccggtatcgtcctcggacacctctgccttccaggggtgcttgccctgaccgtccaccttgttgcggcgggtcacagtgccttcgatggaaggggtggaaaattcaatgctctcacccttggtggtgaggttggtggcggggatgccgaacttcacccggtagagccagaagtaacggtacttgccgttggccttcttggcgcggaagcccacagccacaggggtgccgccgtcctcactggtggaaaccagcaccttatttccgtcaatggtggcgccggtcaagtcttgggcaacggtaacgccgatgtcatccacgcccagggtcagggtgccgctctggaactccttgaccacggcggcggcgccatcgtccgcatacagcgtggcttccgccagctccaccgaaagctcggcggtcatggcctttgccagggggtgggggtcgccgtaggtttcgttgccggaagtatcctcggtgattttggcatagtacagcttgtccaagccgatagtagccatatctcattcctccatttcaccggcgagccgccggtggcaattcgcgcaccaccaagccaggtaacgcatccttgccgcccgcgccgctgcgccgtttgtaatttaaagttggtatagtttcgccacgtcaatggcgtagtggtgaaagccggtatcatcctcatgggcgatataccggcggtcggtaatgcaaaaatccgcacccagcagggcgcggacaagcgtgtctttgatggcggtgtagctgcccttcacgaacagggacagccgcgcctcctgggtgtcgtaccctggggaatcatcggcatgaagcgcaaaggtgtccaccatgggcgtgatgaccaggtaaaggtcgggcggcacgccggaaaagacgccggtctccaccggaatggcgcaggtatccgccacggtcttcaattcagaaagcagactcacagcttctccacctcctcttccagcttgcggatcatggcgctggtacaggccttccgggacgaggtctgggcgggtttgagaaagggcttcgccggctggccattcttgccgtactcgatgatattggccagcatggcgttgctgccgccatcggaacgcggctcggcaaagccgaccttgatgttgtggtttccgtccctgtccaccaacggcggggtcaggcccagtgagcgttccagctcaccggtggagcgggagtcatattttgtcccgcttccaataacggaggagaggttgcttcgcacctttgccaaaacgacctcgccgccggcttccaggacacgaccggcgatctcatctgttttgctgcccaaaagggacagcttacggaggaactcctccggcatttctactttcactttagccacctggcttcaccacctttgccatgacctccagatacatcccccggcccttcacgtcttccacagaggtgatctcgaagcggtcgccatcgcagaggagcgcaaggtctgtggtcacggatacaccgggaatgacccggaagcggaacaggtcggtggcttcccaaaaagccgccatgtttgcccatctctcgcttccgtgccttccttcccggtatgcccggacggaggcctgggtgacctccttttcagatttgaagccctccgcatccacggagacttccttttttaccaggtcaataaaggtgttcatctttccaaaggacatactcacaccttccattcccggtcaagccggagaagtaggttcacggtgtgccacacctgctgaccggcctgcacgttatctgcgaaaaagccgcccgtgctgccatccctggactcgtagaagtgggatgacagcatgatgacggcctgttcagtagtgggcggcatggggtgctcctggtagtaccccgccgcaatgtgctggtagctctccgcataggagatggcggcggtgatgaagcgttccagcagcttgtcatcggcgtcatgctccaggatgaggttttccttgaccttctgcaaaagctcgtccatcatcaccaccgcctttctattatgcagacgccttctgcgccagcaccttgatggcctccgacaggatcagcttaccgtccacgcgctgggtggccatgaagcccacctggccggtggtggcgaacagctcgtttagacgcttgaaagagcgtccctggcggtcagcgatccagtagtagctgaaatcaccgaaggcgatggttttggcgccggcggcgatggcgggtacataggaagaggtgtagaccggacggttcaggatggtatcgggggtcccagccgtgagggagggctgccacagatactgaccctggttgtccttcagcttgcggatggccttgaacgtggagtcgttcatcacccagaccgcctttctgcggtagggggatttcagagaatagaacagatcgatcagctcatcggcggtaatggcggtggagctggcggcggtaacgccggtctgggcgccgccggtggccgcaaagatgccggtggccttgccgctgccatcgcccacgaagaaggcttcctcctccttggcgccgatgcggcgggcaaactcggtggagatatacgagggcaggtcgaacacactgtcattgagcagctcatcggacaccttcaggaaggtacccagcttgtaggcggacagagaggtctggtcgaacacctcatcgctctcggtgagtgcgtcctcctcatccagccagacagcggtgccgtgactggtcacaatggggatcttgcggtcgccgctggaggtctggatgaccttggccaggcggcggaacacgttttcctcctccagagcctgcaccagggtgcgctcatattcgtccggcaccaggtaaccgccctcgctgtcggtgccttcctgcagggcgttgcggatctcgtaggggttgccctgcagacgcatggcgttccagaagttccgcttgtactcatcggaagcgcggcccttcttctcggcctgctggtcgccggcgggcttgccggtgatgggctggctgaccggcttgttcagctcggcgtccagagcctcgcggcgctccatccgggcgatctccttgcccagatcggtgatatcctgctccatgcgggagtaggcggcgtcatcctcggcggacagggtacccttatcggtgcggtgggagtccaggaaagccttggcggcgtcccaggccttggcgcgcttctcgcgcagttccaaaatagtcatggtagttttcctcctttaatgtttcaaaagattgagccgctcgtagagatcgcctacagagcggcccttgggttccgccttgggggcgggtcggttggttttgcatttctcggcgatcttgtccatgagggaattgaccaccgccgctttggaatacagcatggtgaccgccgggggttccgtgtcctcgatttcggcagggcgcttcatcacctcatcggcgaagcccagctccaccgcctttccagcgtccatccaggtttccgcatccatgaggtgggagagcttggcgcgggacagaccggtcttgatctcgtaggcgttgatgatggagtccttgacgctggagagcatctcgatggccttctgcatctcgccggtatcgcccatagccacggtcataggattgtggatcatgagcatggacaccggggacatgaggaccctggtgcccgccatggcgatgacggatgcggcggacgccgcgatgccatcgatcttcacggtcacatcgtgggggtagtccatcagcatattgtagatttgagccgccgccacacagtcgccgccgggagaattgatccagacggtgatgttcccgtccccggccatcagctcctccttgaaaagctggggcgtgacgtcatcgtcaaaccagctttcctcggcgatggtgccgttcagatacagcgtccgttccgccggagccgtctctgtctgggcttgattcctccacttccaaaacttcttcatcggcattttcctcctttccgtcatcgatggattcggtatttgcaaaagcccccgcgtccttgagcgggagcatattgccgttgataaggtacaggtcgccgccctcttcagcgggaatacggtcgaggttttccagttcccggatgtcgttggcggacatccagccgttctgccgaccgatggcgtacccgttcatgcggctctgatagtcgccgcgaagcagaccctccagattgaacttcacgaaatactgtgatttctcatccggcagcaggagcgaccggtgaatggtctgctcccagcggatcacccaggggtccagcgtgtattttacgaactccagagactgctgctcaatattagaaaagctcgacttttccaggtcgcctaccatgtggggcggcactcggaaaattcgcgcgatctcattgacttggaattttcgcgtctccaaaaactgcgcctgctccggcgagatgccgatgggcgtgtacttcatgccctcctccagcacggcgatcttgttgctgttgccgctgccgccgaaggtggactgccagctctcccgcacccgctgggggtcttttatggtgccgggatgttccagcacaccgccgggggccgcgccattggcgaagaacttagccccgtactcctcgcaggcaatcgccataccgatggcgttcttggccatggcaatgggactgtatcccaccagcccatcaaagcccagaccggggatgtgcagcacatccgagggcggcaggttgacggtaacgcccttcatggtgggagcatcctctgtgctggtggtgtactggtagtagagccgacctttggtgtccctgtccaccaccatgcggtttggcatcagcggatagagagcaatgacctcgcccttgccgttgcggatgatctgggcgtaggcgttgccccacaggagcagatgggtcatgagcgtctcccggaatacgaaggaactcatctccgggttcggctcatcgtggagaagattatagagcggatggtccagcgccttttccttcccgccatcctccttgtagcggtagaggtgcagcggcagacccgccaccgcttccgccaggatgcggacgcaggagtacacggcggtcatctgcatggcggaacgctcattgacgttcttgccggcggtggagccgccgaagaagaagctgtacccgctaccggatgtccggttctggggcttgtcgcgggatttgaacaagccggaaaagatgcctataggcttgacctcactttctttttatttttggatatccaaatacttgacagagcgaggagaaaggtgtattctttgattacagcctttctggatatccattaaatcaaaggagatgataaaatgcttggtaggcctaaaaaggaagatagccgcgaaaagcaataccgtgtccgcctcaatgataaagaggatgaaatgctggcttttgccagcaatgcgactggcgttcccaagtctgaaatctttagaaaagctctgcaggagtactgtgaaaaggtaaaactccagcaggcagcagaagaaattggggatgacacatcatgggaagatgaccgcattagtctacagcgcgctgttgaatgtccctattgcaaagcgaaaaatcgcattgacctggaagatgaaggaactgtttctacttccgaacggcagatgggtgatgaggtaatttatgaatttgagaatgtggagtgtcagtgccatagctgcggacgatccttcacggtgtctggatatattagtgagtaccccattggggcattcaacgctgagagtctccaggtgacacctattgaacctttgccagatgaaacaactcacgctgttgtttgccgcgactgtggtgcagtgcttgagtcgggtacaaaacagaagctctgccccgattgccgtgaaaagcgcaaagccaagtggatggagcgccttaaggctggggcaaagattgtcggcattatcggtgtagcggtgggtgctgcatacttggctacaaagggaaccggcgactccgatgaatcgacagatgactttgagccggaatccctgggtgatgactctggtcgaaaattcaaactccttatgaaataccccgatggtaccgaggaggaagaagatgaactcttcgattccgaagaagaggcaaaagagtacggggactacatgatctcctgttcacgggaaggtgcggaaacactttatatgtctaacccaggcgactaccctctggaggattatgaagaccccgattatgaagttatcgaaacggagtgatcaacaatgttggtgctttgtatcaactacgcctgtgactgggtttaaataacaaacatgggatgccggtatacctgtcccatgaaggaaatcgatggtgagctgtacttccgttttaagaaccagtggcatcgagtacgggattacacctcagaactgacatcagaatttcgctaataggcaacctataaaaacagcagccctctgctgtcatagaccgactcgctggtgtcgttgccgcatcggatggcccgatcaagggccataacggtggcaacggcgccatctattttttctgtggacttttccttgtccggtttgatgttccccaccgggtcggtgcggatgtagatgttgtccatcatccagcggaggacaggatgtcccccatgggcgatgcgttcctccagcaccagtttcattagctccttggtaggcggggacatatccttgaagccctgtccaaagggaaccaccgtgaagcccatgccctccagattctgcaccatctgcacggcgccccagcggtcgaaggcgatctcccggatgttgaaccgctctcccagccgctcgatgaacttttcgatgtagccgtagtggactacatttcccttcgtggtctggaggtacccctgccgctcccagacatcgtaaggcacatggtcgcggcggacgcgcaggtcgatgttgtcttccggtatccagaagtaaggcagcacggtgtatttgtcctcctcatccagcggcgggaacaccagcacaaaagccgtgatgtccgtggtggaggaaagatccagcccgccgtagcagacgcgcccttccagatcgtcctcggaaaccgggaacgcgcaggcatcccacttgtccatcggcatccagcgcaccgcctgtttgacccactggttcagccggagctggcggaagctgttttcctcggcagggttctgcttggcggactcacaggcggctttgaccttgtctatgcccaccgtgatgccgagagaggggttggccttcttccacaccttggggtctgtccagtcatccccctcatcggcgccgtagatgaccgggtagaaggtgggatcgattttccggccttccaggatgtctttggccttttggtgtgtctcgtagcagatcgagcgggtatccgtccccgccgtggtgatcaggaagtagaggggctgcatccgggcgtccccggaaccctttgtcatgacgtcaaagagcttccggtttggctgggtgtgcagctcatcaaaaaccacaccgtggatgttgaagccatgcttggagtaggcttccgccgagagcacctggtagaagctgttggtggaatggtagacgatgcgcttctgggacgcgaggatcttgacccgcttggagagcgccggacacatcttcaccatatccgccgctacctcaaaaacgatggacgcctgctgacggtcggcggcgcagccatacacctcggcgcgttcctcaccgtccccgcaggtgaggagaagcgccaccgcagcggccagctccgacttacccattttctttgggatctcgatgtaggcggtgttgaactgccggtagccgttctctttgaccacgccgaacaggtcgcggatgatgcgctcctgccagtcgatcagctcgaagggctttcccgcccaggtgcctttggtgtggcagagacactggatgaagctgacggcatagtccgccagggctttgtcgtaatgagacctcttggccataaagggtgtgggggtgtatttcttgagctttctaatgtccgtcacctccgtaaaatgagcataaaaaaacagcccttcgcggctgtaacgaggaacagagccttccggctccatccctgtagggtgttatgtcgtggttgttttagttcgccttgctcattgcccaggccatggcgtgcccgttgtcgatgaaggtctcatccgaaacgctgaccagcttgatgtcgccttcgcaggtgtgatcctcagtggtgaaccggtacacagcgccgtagtagctgcgcccgttggaatcgtagaagtacccgacggcgaggatgcggtcgccaaaggtaaggatggtccccaggttgttcatcagcttcatttccaggttttccggggtggtggcttcgggcaggcggtaggctgcggtcttctgggcggtggttttcttcatgttcgtgtcctccaattcggcggtgtattccctttcggtgtacacatattcgctctaaaggcggataatagcaagcgatttctcaaaatatactacacaaaccttgccgggtgaaactgtgcagcttacgggaaatcatcccttgaggacatcgaccagccagcccgctgtggggtgggcttcgccggtcagcttgttgaccacctggtattcggtgtcgatgtagtggagggccttgccaaccttgacgaaaatgcaatcctcatagccgggaaggttgctgcggtagacgcgggccacccggctttcgccgttgtaggacttgccatcccagccgttgaaggtgaactcgatgcgttccttggtgtgggtgaacagttcctcaaaggtgcggcggctgattgcaatgcggtcaatcagttcaaagttctctcgaatctgccatgctttcatcattttgaattcctcctgaaaagtggtgttttccctttcggtgtgtacatattcgctctaaaagcgaataatagcaagtcaattcggaggaatataccacacaaacatggcgttcagatattgtgtgttttacagcttcattccgacctcagacagcggtggatggtctggataatggagtcctgctcctcaggcgaaacgccaatgctgtccagcgcctcccgtgtgccgcagtccgggcagatgagggtctcgttgtccagccgggaaagcgccggaggttcgtagtagggcttgccgcagcgtgggcagattgacaggcggctgatgttatcttccttcatggggcttcatcctttctctgctgtaccgacaggcttccaggagcttgtcaacggggaatccgaagaaccggtagccctggccgcagatgctcaagtagctgctggcgggaatgccgtagggtcgttcctctcgcatgatgtacacgaaagccctcctgcgccggagcttgccggtgcagatgcctttgacatccagcgtcatctcggttttgtagtagaagctggggtacccttcgtagcggtccagtgccagctcatcctggtcggtgacctcccagaccgcaacggggaccgtgcatcccttcttcggctcgaccgtgagataggagccagtcttgctgcccttgaacaggagccggtagtcctgcagttccgaggtgccgatgatccgcgccccaggacagcgccagcgcatttgctggacgttgaggttgctgccataagcgatgtagtacctcttatctgtcattgccctgctcctccttttccacctttgccagaatcctttcagcgcattcgatgtaattaccgattgcttcatcaaagagttcattccatgtcacgcgccgtccctccactctggatcgcagttttttcagttctctcaatttttccaccagttcttgcggaaatcgtatgttgagtgtttttctttgttccatttggtatccatcctttcctgaaggacttaggttacttgtccttctaccaccgaaagcccgcgtcagcgggttcgggggcctctgggcggcgtccttcaagcggcggctctgccgttgcggaaggctgcgtcaccggaaaggcggcgggtcaggatgtctcgtgcggtttcgaactcctcgccgatgaagcccaggcggaggagccaggtgcgcatggcgtatttggggttttcggtctgctgaggcttgggactggcagttcgcaccgtcttggccatctggctgagcgccaggcaaagctggatgtaactcttcagctggccagcgtgaaggccgttgcgtttaccattggagggagcatcaaattggaaaagccggaactcgaccgtgcctttggtgaaggtggcgtggaggttgagcatatggtagcggctgtcattgtaatggtggcttctgccgtagttagtgccctggcttctgtaccagatgtcggcaaggtcggccatggtggtgggcttcctgcggttgagctgttccaggaagcgagggtctactgtgcggcaataccgacttatgcggtagtggtcgagatcgagggcttcggccagcaggctctcatggcttgccatgatgttggccagattgcgcagggtctgcggggtgtggcccttggctccaatgtggatgtggactccgcagcccctggtggagtcgcttttggctcccgccttgcggagtcggcgaatcatctcctgcagggtttccatgtcggcgtaggtcaggatcggggtgaccatctcacatttttcgctgtctgggccggaaatggaaacgtccttctggaatttccattcgcgtccctggctgtcccatgcgctccaagtgctgtacccgttgcggtgggcggtgttctcatagcgcccggtgccaaagaactcggcggcgacctttgccgcccggctgcggtcgatgttgttcatctcgacctcgaccccaatggtctgcttcttcatttcctcgatttggattctcgttttctcgttcatggttctacctcctggttggtgttgttttccctttcagtagtgtcatattacctctgaaggcacactatatccaggactatttgagccataaactacacgatcttgtggtcggaaaactgtgtatcttacagcgccttattccccaaccttgcagcagacatcttcgccaaaggccacgttcaggccgctgccgttgtcccatgctaccaggatgctccccatatcgtccacacccagcaccgtgcctttcgtcccaataggcggagcctggggatcatccatgcggatgagttccacccgtgcgcccttggggtagcgggagcggaggagcgtcagcgtttctttactcggaagccgcatcgtccgccacctccttctggggtaccgccttgaaagcggagctgccggtcagattccgtaggagaatcttgcgctcctgtttgtactccgggccgatgaagcccaatcggaggaagcagcggaaggcgtatttgtcattcccggtatcccgctccttggcggtgatgcgcttctggttcctggccatctcgcacagggcgcagatgaagtggtcataggccttgacctcctccggcgtgggcgtcccggcaaaccagggaaaggagaccttcgtctcaccgacttcaatgggtagctcctccaccccaagggctttgcggatcaggctgcccttcgccgccgtgatatccttgaggttttgcagcgccgcttcagagaacaggctggctggcatggagatgcacagcccgtccacctcggcgggagacggctctacagtctcggatacctcgacctcctgcggctcggcggtgaagccctggctgtccagcgtttcgatgaggtttttgatctcctcgctgtcggcccggtcatcaaaggcgacgccgccattgcggtcgatggtgaagtagtccacctggtaggcgaagctgggcgcgcccaggtatttagcaggagcgccggtgatctcgctgatagcggtcaccagccgcttgcggtcggcaccggtcaggttgtatcgcagggtcatttctcgttcctccttgatttttggtagtcacatattcgctctgcggcccccaaatatcaagtcaaatagaaacctgggattgtagaattatgcgggagataattgtgtactgaacacaatgccggagaggacgaaccagacgcagggcagcgccacgccgttgccccacatcttgtattccgccgcatcggagtaaggggctttcagccatttgacgatctgccgctccgtcttgggcttcacggagggattcacggctcttcggtgtgtctcccagacctccgtccagaacgcgatgtcctccctggtcggctccggggtttccaagccagcgcaccaccagtccgggaaaccctgcagccgggcgcactcggtgggtgtcagccgccgcacggtgtagccgctgttcacagcggtggggtctttgtagtcccgtgccatgagtgtaggagaagtttctttttcgacctgggcatagcttccggtggtcatagcgtaaaccacggcaatcccgccttgattgcagcctgggttcccgccgctggtatccagagtacgggatgtccgcgctttgtagatcccagcgtggggattgctggagagcatggccttggactggtcggaggagatgccaaaggccacaggctcgaagagggcctggtcgttgttgcaacccagcgtagcggacttgtcctcctggatgagcggccctttcccgcctccctcgcagccggagcggatcttcatcaccaagggcacattcatcccgcctgtccccatgcgggaggtcagcgtctgaacggtaccgtcatcggcgattttgattcggctgtcgatggggtggctctccagcgcaatagcagcaggaaccacgccggcccgaagcgtaggggcgcgctccggctcaaaaccgataccccggctgtccgccgagtgttcggtgcagaagccagcggcgtccagcacacagggcagatgcccatggtgttccgcccggagcgtggcggcgacttcgctggacacgtccatgcagctcccgccctggtcgttcaggcagatgcctgccgctccagagccagccgcaggatttctggcagctctttgccacgcacggaagccctccgcagaataccctgacaggccttcggactcaaatagtacttgtccggcaccccagcctgcaaaatctgcgacaaggaagatgcggcgtcttcgctgggggactccccagtgttgcgcgtcaagagtgcggtacgcaacgctccactgctctcccatgtacaggtcggcgtagggccagaggtttttttcaggcataggcacctgggcgcccggctccttgatcccgatgaccgcttcgaggacggccttgaagtcctctccgtgattggagctgaacgcgccggggacgttctcccatacgatgtatcttggatatttgccatgggtggcatccctcatttcctgaatgatgcggatggcctggtaaaagaggacggattgcttcccgtccaggccggccctccgtccggcgatgctcatgtcggtacagggggagccgaaggtgatgatgtccaccggctcgatcttcccgccatccatctgggagatgtcgccgtagtgtttcataaagggaagccgctttgtggtcacccggatggggaacggctcgatctctgaagcccacaccggggtgatcccgcagagcagaccgcccaaaggaaaacccccggagccatcgaaaagactaccgagggtcaaagctgtattcaattccatgggcgcctcctcagaacagcgggatgtcttccgcatcgtccccagccacctcctcatagcggtaggtcaagccgtcccgctggagggatacaccgtccgcattgcccacctgctcgatgtaccgcttcacgatgacatcgcagaacttttcatccagttcgatggtgcggcagatgcggtcggtttgctcacaggcgatgagggtgctgccggaaccgccgaaggggtccagcacaatggcgttgctcatggaggagttgagaattggataggccaggagcgggatgggcttcatggtggggtggtccttgttcttcttgggcttatcgaactcccagatggtggactctttccgcccggtgtaccactggtgtctgcctttcttcttccagccgaagaggatcggctcatgctgccactggtagggcgagcggcccagtaccagggactgcttcttccagatgcacgtcccggagaggtagaagccggcgtcagagaacgcctttcggaagttcagcccctcagtgtccgcatggaacacatagatggaggcatcgtccgccatggcttcctctgtattctgaaacgtcgccagcaggaaattatagaaggcggcgttctccatgttgtcattcttgatcttcccggcgccgccctcgtagttgacattgtagggcgggtcggtgatgaccaggttggacttcaagccctccatcagcagggcgaaggtctccggcttggtgctgtccccgcagacaagccggtgccgccccaacgtccacacatccctggctttggtgatggtaggcttctgcagctcggcgtccacatcgaactcgtcatccttcaccccatctttcaagctatccttgaagaggtcatcaatttcggctgggtcaaagccggtgagggatacatcaaaatcggcgccctgcaggtcggagataaggagcatcagcttgtccttgtcccaatcgccggagattttgttgagggcgatgttgagagctttttcccgttcctcatccatctccaccaccacacactccacctcggtgacgcccatgtccatgagcaccttcagccgctgatgaccgcccaccacccgtccggtggacttgttccagatcaccggctctacatagccgaactgctccatggagcgtttcagcttgtcgtattccgggtcgccgggctttaagtctttgcggggattgtagtcggcggggatgaggtcggcggtgtgtttacgttcaatcagcatacttttccaccgcctttctcagttcctcagtcttgtcgaggttctcccagctgaacttgtagccgttgaagtgtccgtaggcggcggtgtcggcgtagatgggagcgcggagatgcagcagggacataatggcggcgggccgcagatcgaacacatccagcaccgccagccgaatcacatcctcgtccaccctggctgtgccaaaggtgtcgatctccacagcggtgggttccgccttgccgatggcataggagatggacacctggcattcctccgccagctacgcgcccaccacgttccgggcgatagctctggccatgtatgcggcgctgcggtccaccttggtggggtccttcccggagaaggctccgccgccatgggcagcaagaccgccgtaggtgtccaccatcagcttcctgccggtcagtccggtgtcggcggcgggaccgccctccacaaacctgccggaggggttgatgaggatctccacatccttggggaagtcgaaacgatccagaatgggatacagaacctccgagatgatctcccggcgaagctcctccagatccttgtccgcatcgtgctggacggacaccacgatgttcttggcgctcacgggtttcccatcctcataggccacggtcacctgggccttgccatcagggccgacgccacggatggtcccatcgtgcatggcgtcatccagtcctttgcagatttcattcgcgaagaccaccgggacgggcagacgggtccaggtctccctggtggcgtaaccgtacacggtgccctggtcgccagcgccggtggatgcgaacacatcctcgctgctaccgtcccgcacttccagcgcggaatccacaccgccggcaatgtcgggactctgccggtgaacatagacgaacacgatgaatttcatggggttgtagcccaccttgcggaggacttcccggaccaccgagcggatgttgatcttcgccgcgcaggtgatctccccgcagacgaagatttttcccttggtggccatgacctcacaggcgcagcgggaatagcggtcgtgccgcaggcactcgtccagaatgctgtcggcgatcaggtcgcacagcttgtctgggtggccgcgccgcacgctctcagccgttttgtattttgtcatatcagtttcctttccgagcggacagcagccgctccatcacatcgtcctggggcgtggccccgccatactcgctggaacagttctccttgacgatttggtagatctccatccacaggcggttggtctgggacatgaagttctgactcatcgccacataggggctttgaatggcgttccccgtggtggggtgcttggcgaggaacccgtactcggtgatggcctcctcacactgtatccagcgggccacgctcatggcgtatcgctccaatagctgcggggaaacgagagcggcgcagccccgctccgccagccaggtccaggtcttttcatagacctcggcggcgaccagcgtcttgccatccttctgggtggcggacagcatggctgacggtttcggcatgggctgaccttctaaatcggctgtgtcctgaaagtcgatgacagtcagcttccttctgccgggattgccctcggcgatcttgtctacgaggggcttcttctttgcgccggcaccagcacgggcaccgccgcagttggtaccgtctttggccacaggctacctcctttctcggcctggggtatataccccctttgaaaccgcgattttgtgcgcgagacccccagcccgttgcacggcccacaggctgtagagatttttattcccctaccgtcagttttgtgctatactatgtttgtaacattagttggttatggtgacaatcatgtccctgctcaacggagtcccagtcgacacagtttcactcttcttgacggtaattcaaacagcaattgctattggaagtttaaagggggaactcgcgatggtaaacgggtataacacggtggtatgcggcgcgcacggagtggcctcgttgtaactgtggactccgcaggggaaatgtgagaaaccttaacaagtgcccatagcaggttcgaatcctgcccgctccgccatattggagactacccttcggggtggtctccattttttctgtgccagcgatccccgcgttgggcgtggattctggcgtgacaggatttacagagggcaacgaggttgtcccgtgcgtgtgtgccaccctcggaaagaggtaccttgtgatgcacctcctcagcgggagtcagcctgccatcccgctggcacagctcgcacagcgggtgctcctggatgtaccggtcgcggatgcgcttccaggcgcggccatacctacggcgtacagccgggtcacggtcgtacttctcgtagcgtttagcttccgccttggcgtgctcctcgcagaacctgccgtccgtcagcttgggacagccggggtacgaacaggggcgctttggctttgtgggcaccattccacctccttccgggcataagaaaagccaccgcaggggtggccccacgatggcttcgcttgattcttttggcaattataatggtaccacggggcggcactctcattcaatacatcgaactctcatgtttcctggggacgggaaattcccgcagcgcccagtcgtggagacggtagatgtgctggatagagtagcccatgtccacggcgattttttcccagggcatgaagcacagataccgcttctccagaaggagctggtactcggcgttggggatggatttcacccggcgggtgatttcccgcttcaaatccaccagttcatcgatgtcgtggttgatctcgttctgcaaatccacgatcttgaccaccgcttccgccatccgggactcggagcggttggggttgcgcggcatccccgtaagggtggccgtggcatgggtggccaaatcattgagagccgcgacctgctggattttggcgttgatccgggcgtccagaagccgggcttgggataaatattctttcgctgtcattttcgcacctccagatccgctttgactgcgttgatcagagccgactgcgcccgttccttcttttgaagggcggacatgatccgctcatcaatggtgttcttcgtgataatgtgatggatgaccacagttgtgtctttctgcccctgccgccagagccgggcgttggtctgctggtaaagctccagcgaccaggtcagcccgaaccagaccagggtggaaccgccggactgcaggttcagcccatggccggcggacgccgggtggatgaccgccaccgggatcttgccctggttccaatcggcgatatcccggctggtcttgatctcccggacggtgaaccgctcccggatgcgctccaggtcgtgcttgaaccagagtaggccaccaggacgggcttgccgttagcggcttcgatgaggtcctccagggcgtccagcttgcggtcgtgtagccggagcacccgcttgtcctccccgtacaccgcgccgttggccatctgggaaagcttgttcgccagagctgccgcgttcccggcgtccacctcttcaccgttcagggagagcaccagctccgccctcatggtgtcgtaggattgccgctccttttcggagaggtcgaccttgacctcgttgaccacgcattccggcatatccaaatagtcgccggcccgcatggagatggtgatgtcggagatccgctcatagatggcgtcctcggctcccggcaggggcttgtaggagaacaccacctgggcgttgcgcttgtccggctggaagtaggcgctgcggtaccgggtgatgaaccgacccaggcgtctgcccatgtccagcacccggaactccgcccataaatccatgagtccgtttgaggagggggtgccggtcaggcccacgatgcgcttcacgccgggccgcaccttcagcagagcgcggaaccgcttagcctggtagcttttgaaggaggacagctcatcgatgaccaccatgtcatagtcgaaaggtagcccgctgtcctccaccagccactggacgttctcccggttgatgatgtacacactggccctctgcaggagcgccgccttgcgctgggcttcgctgccgaccgcgaccgagtaggtaagccctcgcaggtggtcccacttctcgatttcaccgggccaggtgtccgcagccacgcggagcggggcgatgaccagcaccttgcgaaccaggaagctgtccagacagaggtcgaagatggcggtcagggtaatgacgctcttgccaaggcccatgtccaggaacaccgccgaaacgggatgctccaggatgaagtccgtggcgtaggtctggtatttatgaggactgtatttcatccagtatccctccaatctgctctgggctgtcgatgcggtacaccggaaagcccagcgcttccaactgctgcttccgccttatctgcaaaggccggagcgccttgcccggcgatttcagctcaatgaaggcgattttccccttggggaggagcaccaggcggtctggcactccatcaaaccctggacttacaaacttgggtgcgagaccgcccatgattcggacggccttcaccagtttggcttcaatggctttctcccgcatattggcctcctgtgttccgggaaccgaaaaatccccttatgcgcgtatatgcgtgtttcgcgtgctgatgacccttatttcctttatctttcgatatataataaatgttgggaacacaggaacgctgcccctgggaacttgttcccgaaatttgtgcctgagcgtctcttcattgggaacaccccttcggaacaaagacgtactgcggcccgtagagggggatgcgcaccttgctctccgcccgtttccagcccagccgcgccaggatacccgtcagctcattgctgtcagtgcgacgcaggttggcccgttccttgccgaagcactcgcaccagatctccatgttggacacactggtgcgcttcaccgtccccttttcctgcaagttgccgaagtcggagccggcgaggaaattgcggcgttcaaagaggtccatctccgcccagcgttccggcagaagggtgtccatatattcccgcaccagcccctcgcgctcatcggactccatggcttcccgctgctcatccttggccagcgcgtccatttcgggagagaggtagagcttctcaccctgccgcacatacatgagagcttccgcccagatctggaggatctcctcgtgggtcaggttccaggactgcttctttccgctgccgggggtcttgaccggccagaagcggcggttgccggtggtgtcccgcagatacccggactcggcgttagtggtgccgaagaacacgcactggcgcagatggggcgtggcccgtttgccgaacgccgcccggtagatgtcgttctgccgggagagaaaggagcgcagggtctccacctcagccttcttcagcccggccagctcaccgatctccaagatccagtacccctggagcttctcggcggcggttttgtccttggtgtcgcccaggttcaggctgtccgaaaaccactctccggccagcttggcgatgagggtgctcttgcccacaccctggggaccgttgagcaccagcatggagtcgaacttgcagcccggacgcagcacccggctgatggcggcgcagagggtcttccgggtcaccgcccggacataggcggtgttgccggcgcccagatagtccaccagcagggtgtccacgcggggaaccttatcccattccggcagactttcgatgaactcccgaatgggatgataggcccggtcatccgccactttggtcacggcgatgtcgtagttccgtgcggagaaggtgccgtagtgggcgtccacatagctgataagctgggcgtcatcggcgtcccgccagaacttggagggatgcttccagggcacctcgcccttgatctccatcccgtccaggagctggttgaacaccacgcccttgaggttggggtcgttctccagaatgagggtcaggttgtgcagggtgttcttcacatggccggacttgtccagctccaggccgttctgccagtcctcatcggaaaactcggcgctggcctgggcgatgcgctcctcggcgaagaccgctttgaccttatcgtccgccagggcaaggtcgctcatggctttgaaggagggtagcttgcccggcggggtgtccagccccacgttttcgtccagctcccggaatttgtggagccgcaccaggtcgaaggcgtttaacagctttccgcagaccggatcggtggcgtggtggctgtaggcaaacttcccatcgtacaccactacgccggcggcggagtctgcggggatgtagtcatagcgcccattcatagcggacggttcgtagacatcggtgaggaaggcttcaatggcttcctcaatggtgtaggcgcggcagaaagcgcccacgataccggtcttttccagagggtcggcctgctgggtgatgctccggcgcaccgcttcggactggcgagaggaaaccggccaggtggaggcgtcgtgccaatcggcgtacttggcgagataggcgtccgggtccaacagcgggccttccttggttttgtagaagaactcgccgtttgcggaggtggaaggccagtacatcaggcggcaggcttcataggtggtatcgtcaaacaggtcgatgccgatctccttggctaccatccgggccacagccggatactcctcctcggtgatatcgcgggccaaggggatgatcatccgcagccggggatgctccggcgtgtgtttatgggtggagtagacgcagcactgaaagtcgtggagcaggtcgatctcgtcccagaccccaggtttgccgtagtccatatccagggtgagcatggagcggcagagtaccatgccgttcttgcgcctcccctcccggagctgaccgcccacgaagccgcccacgtccttgatgttgtcctgggcgcccttcttcagcttgcggtattcctccacggtctccgtggtgcggatggtggagccgaccctggcgcacaggtcttcccaggagatgtcccggttcttccacttcttatccatgcggctgttgcctacagcgattttcatacggacacctcctggcagttctccgtgaaatagcggatggtctggcctttgcgcctggccttctcgatctcgatgctcatgcctttggagacggtgtccccgaacacccacagctcggcgcatttggtgagcagaacgatgtccatgaacagggccagatcccgctccctggggttggcgtcatccatgaactggggaaagtacagatggggcgcgattgggatatacccggcgtccacggcgaagcggcagtagcgcaccgccttttcctggttgccctccagatccccggagagcggtgagcagatatacacgaccggacggaaggagcggagcttgcgcgcctcgttctcaatccgggtcagggcttcgtaggccgtagggtcgtagtagccctcacagttgaatttgttgattcccataagggtcacctcagtctttctgataaaagtcgcagacataaccgtctgcccggagcagcagcccttccgcccaggcgggggtctggcccatgatagcgcagatgtcatccagggatgcgtccgccggagcttcgatgaccgcttcgtcatggacgtgcatgacgattgagtaccccgccgcttccagccggcgcatggcttccaccaggatgtcgcgggcggtggcctggacgatgttctccacaaatttggggccgtagctctccagtcgcagccactttttctgttcgcccacaccctcgtaggtgacggactcgctgccatagcggttgacgcccatcttgggcttcacatacaccagctttctgccggaggggagcgcgatgaacatcatgccgctttggtagaagaagcggatgccgtgcgtctcggcgggaactctgtcccggacgcaggtagcggcggcgcggtctacatcccaccagaacttcacgatccgggggttggactgccgccatgcgtccaccaagggcttcagctcttcctcggtcaggccgtagttcagagcgcccatggctttcagcgtccccaccgagccgccgtagcccagggccagctccgcgattttgcccttctgccggagatggccgttaacgccgtgtttgaccacggggacatggaacatctggctggccgaagcgcagtagatgtcaccgccctgggcgaacacctcctgccgccactgctctccggcgatccaggcgatgacccgcgcttcgatggccgaaaagtccgccacgaagaagcggcatcccggcttggggataaaggcggtgcgaatcagttcggaaagcaccagcgggacggaatcgtagagcagctccacggcgtcaaagcgcccgtcccgcaccagtgtcctggcctgtttcagatcgggcagatggttctgcggaaggttctgcacctggatgagccgcccggcaaatctgccggttcggttggctccgtaaaactggatcagcccacgggcgcggtcatccggacagaccaccgactccatggcggtgtatttcttgacgctgcttttggccagctcctgccgcagggacagggccagctccacctcgccctccgcatggaacagaagttccagtacggatgctttggagagggactcggcttccacacccttttccgccagccacgctttgagctgggcggggctgttggggttctccagcccggtgaccgagcgggcctgttccagatgggtgcgcttgaaccgctcgtcacaacggatggcctgggtcaccagggtgcggtccagcagaatgccccggtcgttgatgcgctggtcgagatggtagttctcccactcctcctgggagaccgggaaacgggacagtctctgctggatggacatctccgtctctacatcccggaggttgtaggctttgaaggcggcccacttctccggcgcgtctgtaggaaggcggcgaaaggtggagccatccctggccttcgccggtgtgcagaaatagcgcaccaggtctttgccctccttgagtttctgcttctccaggcccagcacggcgccggccccctccagagagaggggcagacccagggtagcagaccacaccatggtgcagtaccaggagtcggggtccaggtattgtccgacagggtaccccaggtgccgggagagacacacccgctcgaactgtgcgttgaaggcccacttggacaccgcagggtctgtcagcgcagccagcacatcggcggggatgcgttcgccgatggtgagatccaccacccggacggggccgctgtccacggaatagccgaacagcagcacttcaaactccgggacctggcagtagcggtacacgccgcacttggccagcggctccggggaaaaggtttcaatatcgatggatagcgttttcataggatctcctttcccgcaacgtaagggcggcagaggtcgccctccgccaccctcgccggatggttgttaggaaaggaaatcgtcatcgaaatcggtggagaagtcatcagcggcagaggaacgaccacccagaggttcaccgtcccgcaccttctggatgttgcccaggccgcaggcgatgctgcggttgccgttggagttgaaggcgtagaagttgatggacacacgggcgtagcagccggagtagacctcggcgcggtccaggatgggctgcacggagcggtccacaatctggggtgcggtggtgctgttggcgttcacgaagtaggcgcccttgtaggcttcatcgtcccgctccagatcaccgtcccgcagggggagcttcagcgcggccttgttggggatcttcccgccgaacttggcggctccgtccttgatggcggcgtccacggcggcgttgatggcatcgatggtcttggtgtcggtcttggggatgatgagggaaacgctgtacttggggttgcttccgttgatggaagccggctcccaaacgttggcgtaggacaggcggacaacaccggtgaccaccttggtcgggttcttgtgattgacagacatatcgttatacctccgtaatttcagtaaattcttgggcggcatccatcgtgctgatggccggacgcctgtcggataccggaaccagggtcggcctgcccttgggcttttcgaccaggctaccgagcacctcggcaaaggcctttttgcccatgagcttctccatctcggtgatggggatgagggtcttcttgaagatgtcgtggtacccggcggcgttggcggcgcggatcacggcttcctcatctgtgtacttgcggttggtgcggctctccaccagcttgaatccgtgccacaccttgccgtggtggatggcggcgtcctgggcgtaggcttcgatttcgccggcccacttggtcaggccgggcagacgggagagtatgtcctcgatctccgcatcggtgaggagcggcggcatggcgaactcgtacttggcgagctggagcttggcttccgctctggcgcggcacttcaccgccgccttgcagaaggtacaccaggggccaggaacatagtccccttcaccctggtaggccatttccgctttagtcttgagggtgtgttccacccactccatgagctgctccacggagatggtccaggtggacacgttctctcggcggggctggtagatgctcatgtcaacctgggtaatgtcatagagatggtcgaactgtcggagcgcgcccagggcgtacagcatcatctggggattttcctctgcgtctaccaggacgccctgcccgtacttgaaatcgatgatgtgcaggagcttgtccgccacgatcaggcagtcgccggtgccgaagccgtccggcacatagcaggagaagtccagccgctgttcaatgaggacaagagggtcggcgcagagcgccttggcttcctccagctgttccagcacaaactccacatacccatcggtataggcgtccatttcatcgcagtcatatgggctgacgggcttccgggaacgcagcttcagtgcctttttgagcttgtgctcagccagagcgtgagcagcggtgccttcggctgcggcttccgtctcccggtcggcgaactccagctccagccgcgccgaggggttgcagtggagccatcgatgggcgccgctggcagagagaacagcgtgtttggagggcggcatcagagcacctccgcatccttcagcagagccgggtagtgcttggggtccaccgacgacaacttcggagcgccgtacttctgcagcagttcccggaccgcttcggtcttcccgtcatggcttttttcagccagcaccgcccgaacctgctccagcgtgaccgccggctccttgggaggagacggagcggccttctgtaccggctcggcttccggggcttctccctgggtcatggcgtccgccaacgactggagactgtcggcgagggagcgcatatcctccaccacatccaggaggagtttgatcttactcacaggccgcacctccctccgacagctcggtgatgtccagggattccacggtgttgccgggaatgaggatcatcacccgctctttgcggcccaggagccgggtgagcatcttctcccgcagggtcacactgcggcatctgaccaccccgccgttctgcggctccttggacacgctgatcttcagcttgtgcctcatggcgttcatcctttctggaaggctgcttttcttgctccttccgacatacggccaggagaaaggccgaatatgagggtcagcccagaagttttttcaatttctttttcacggtctgcaaacggtgggaaatggcggactgcgtcacgcccgtccgggcggcgtagtcgttgacgctcacgttttcaaaatagatggcccggaccatttcctgctggtcgggggagagctgccggattgcggcgtggagccgctcctcatcggtggggccggcaaagagagcttctaagccggaatcctctacggcgtagtccatgccctcgtagaccttgccctccagcgagtaatgccggcgggtctccttatgatcgttgttgtactcctggcggtccaagtcaatgaggatctcgccccaatcatcggggatttcgatagaaacagtttctccgtcagaaaaatggtagcggtacgcaaacatagtgaatgccctttcccgacgagaaaagggcaccacaaaaggccaaaaaactcgccgttttttttaacgggagcctttggctcattttcaaatattggttgtcaatcgacttatcacggcctcacctcaacgacttacaactttgcgaaatccaacaaatggccttgaggttttcacagggcatatctaatcgtttatagcgtcagccgccatagttggtaaggttaattaggtcgaaagcagaaacttcctgtgctcatggtcatacgagcacaggaagagattgtatttttgtatttcttgcgatataatatgaattagttgggtttgatatggacttcctaatgcaataggtttctgttatcttgaaagatgtctgagatttggaggaacaacttgtgacaacaaacgaatatcctcgcctgtgcggaggcactttcttcacgttggtgttgcaagccctccggcaacgaatgaaagcgagagaacattattctggtgatagcgatggcctatccgatccagaagtgctggtgggtctgattaaggtaatcaatccagattacacagatcccggcaaggagaatctgaaagtcacagcgaacaactacaaagcctgcaaaatatcgaacagcacatacctgccttttgatgatgaacaggtaatatcggcatttgattccaaagtgagaacggcctatcaatccgttctaaatcgaatgatcggattcgtgaatgacttccttgatataagtgaggtggtacataaggacgtcaatcttgtacgagcgctcatcgatttggtccaacaggatcaaaccatccaggctggggacgagttctttgtcgagccaaatggagagaaaaagaaaaaggccgcacttggcgaccttaaggaagtatgcctcccatcgttcctacttggcatttggcattatgttgttgtaaaccgaaaggacaacagcatcggcaagaagacctatgatgcatggtgtccatctacaggcggaggtcaaagaaaatatacagctcacatgggcgaaggaattctggaaggtctgattacctatttagtggatactgtagataagccaacgacggatgctgagccggtcgagactgtcatcattgaggatgaacaaaaacagtcggtccaacagaccgtaaacaatcccttcgtatttaatttcaaccagtatggcaacaacggtacacagataggccatgttgagaattactatggcggtaagaaggaggattgagcctatgagcgatgatacacagattgcgaagattggcaacaatcttcctcaaccgggccggccgcagcagccgattcaggcaaacctgaatcagtacggaaacgatagtacacagattgcgtatgttcaacactacgacgccactacaaatcagacggtgctcattatgcaaggcgcccagccagccggtggaactgtcgttggacaaggtgtcacattcaactatgactgtttcaatttctttgtcctcggaaccgagcaatatgacggcccaacattcattgttccaaagaatcgggctttaacagaaagcacgtcggacgagatgaaggcacggtgtgccgcacttactccagaggcgattgagattgttaagacttttccagcactgttttgtagtgagaatcataatttcacaaaaaccgatcccgatcacatggcctattacggttatgtgacggatataaaagtgcaggataatggaatcaaaatatatttcaccaaactgaatgcactgcctcagcaggtcttgatagaccttgctgcagatctatgcattggcggtgcaaaggcttataacgaactcagtcggacgcattgggcaatcaagcgaattaatctggtggaggttcttgaaaaagcaggatacagagtattcaaactttaagcttcacggttatgcaaaaatggaggtaacacgatgagccgcgaatatgaagaaatgcaagttgagaagtgggttaatctggaagatgtggctgagcatctaagcattagtcaagatacagttcgcacatggataaaagaaggaaagctgcccgtgtacagggccggtaaacgatataaatttaaaatttccgaagtggatgaatgggttcgcgaagggaaaattcaggagtgagattagatatggaaataggagggtgaaaaacggatgcaacgtaaggttccttcggcaattgcgaatattacgctcaatagagcaacctttacagatgtcttgatagacggactcacattcgtcaactttttctatggtaataacggtgcagggaaatcttctatcgcccatgctatagcagaggatgatggtgttgtctgggccgatggcaaaaccgtcgacgactttgatgtgctcgtttataatcaggatttcatcaacgacaactttgtaaattacggtgatctcaaaggcgtctttatctttggtgaagaggatatcgaggccaaaaagaaaatcgctgaactcacaaatcagaaaaagcagaaaatggatgctcgtcagaccgcgcttgatgagtacaaaaagaagtcagacggtctcgcatctgcactgacgcagttccaggacacatgcttttctaagacggccagtattcgtcgtcgctttgaaaagtgcatggacggtaagaagcagaaaaagaactttgcagaagccgttctcggtgaagtgaaaccgattgaccacgatctggcagagttggagcgtctttatgacgttgccttcgatgattcggccagagcgtatccagagttcaaaaaagcagctgctaccacctacggtagcctccccggaaaggatctgctcgacaggatgattgtcagtagcagcgatacgcctttcgcaaaattcatgaaggcccttggtgacactgcttctgactgggttcgtgatggccatacccattatgctggtgcagctggcggaaaatgcccgtactgccagcagaggctccctgcgaactttgaggcagatatagctgctacatttgacgctcagtaccagcaggacattcgtgatcttggtcagttccagactatatatgaaagagagaccagagagattgtccgggcgattcaggcaaatgccagcgacgttatgccgacgattgatctgatggcttatcaggaaaaactcgccttgctggagagcaactttgaaatcaatcgccagcgtatagctgaaaaggtcaaagagccttcgaagactatctcacttgaggacactgacacgctcctgcttgagatcggtgccatgatcgatgagatcaataagcagatcaaggcaaacaacgatgttgtttctgctaagcggtccagtaagacgaagtgcaagacggaaatcatgcagtatcttgcgttcatgcttgccgctgatgtgaaaagttaccaggacgaagtggctcgtctccagaaggaaatcgaggacgtcacagagcgtggaaagaagctcaaaaaggaaattggagatcttaccacagagatttctgccctgaacaagcataatgcaaacactgaagcggccattgatagtatcaataaaatcctgcgggactccggtttccaaggcttcggcattcgtgccaagaccggtgtagaaaatgtatatgaggttatccgcgaggatggctccgtggccgaaaacctcagtgaaggcgagcgtaacttcatcgcattcctgtacttctaccatcaggttcgtggcagcatgagcagcgaggaaatcaaagagaagatcgtcgttatcgatgatccggtatccagcatggatagcacagccttgttcctcgtcagtgcaatcgtccgtgagatggtcaacgtctgccggaacaataccgagtacctgaatccgaaagttccaggcgactacatcaagcagctgttcgtgctgacgcataacgtgtatttccaccgtgaagtcacttatcagcaggttggatattataactgtacgtctttctacatgattcggaaaaacgacaacatttccaccatcaaactctgtaagcggcagagcaaggagattccgtctgaagaggagaattataatccggttcagaactcctatgctgctttatgggacgagcttcgtgacctccagtctacaattccggcattaaacgtgatgcgacgtattctggaatattatttcctacagctttgcggctatgaaggaagcgatcttcgcgagattgtgctggatgaacatcggaataagttcattaaacaggtcgagggtgagaagccggatatgaccgactaccagctggcgtcttctttgctggcctatatcaacaatcctaacggcatcagtgacgggctgaactatgtggaggattgcgaggatgttgaggcttataagagggtcttcaagatgatcttcgatgccctcggtcaaatccagcactacaaaatgatgactggcaaaaggatcgagtcctgatcattttagacggatgagtatgtatgataaggcagcaaagctctgccgaatgaaaagcgaggtaaccagcatggctgataaaaagataatcgatgcaatgtgggacgattctccggtagacgtttctacagaggtgaattttatatggtccatcgccaataagctgcgtggtacatatcagagcgataaatacaaggatgtcatcattccgatggtcatcatccgccgctttgagtgcgctcttgcgcccacgaaggccaaggtcgtggagacctataaggcgaatccaaattatccggcgaaagcgatgtaccgtctgtccggattccagttctacaataccagtgagtttgatcttgcagagctggtcaacgactccgaccacctggcggccaactttaaggcatacatccagggcttctctgccaatattcaggatattatccgcagcctggattttgacaagcagatcgacaagatggacaagaacaatcggttgctctctgtggtaaaggcgttctctgagttggatctcgatccgcacaccatcgacaacgtgaagatgggctacatatttgaagacctaatccgcagattttctgaaaatgcggaagctggcgaccactacaccggcagggacatcatcaagctgatggtcaacatcctgctggcggaaggctgtgatgatatctttgatgacggaaaggtcatcaccgtattggatcaggcgtgtggcacgggtggtatgctctccaccagctataatttcatcaagcgctacaatccctctgccgatgtgcgtctgttcggtcaggaaatcaacccggagtcctatgccatctgcctggccgagatgatgattaaggggcagaacgccgaaaatatctgctaccaggacaccatgaaggccgaccgctttaagggcacgaaaatgcgctttgttatcgaaaatccgccgtttggaaccccgtggggcggcaaggacgctgccgagggtgtggaacaggcggttcaggacgagtacaagaaaggctttgacggacgctggggcgcaggtctgccgggctctggcgatatgcagatgctgtttctgcagtctgccgtagacaaaatggatgagcatttgggccgtgccgccatcattgaaaacggcagtccactgttttccggcggcacatcttccggcgaaagccagatccgccgctggatgctggaaaacgatttgattgaggcgatcatcgccctgccggtggatctgttttacaacacaggcattgccacctatatctgggtgctttccaagaacaagcgccccaaacgcaaaggaaaggtccagctaatcgacgcctccagctttttcaagaagctgcgcaaggccctaggtgacaagaaaaacgaaatctctcccgaagaccgcaccgccattaccaagctgtatgcggacttcgcggagaacgaatattgcaaaatttatcccaacgaggagttcatctaccgggagtatgtagtgatgcagcctctccagcgcagctatgccattacggcggagcgcatggaagcgatgttgtccaaggggtcgctgtcctccctgtatgaccaggcgaaggtcgatgagatagaaaatatggaggagccgaccggcaaggatttaaagaagttggaaaactaccagcacaatcagccggtctatgaagccattatcgctgcactgaaagaagctgtatcggatgaaatctatctctccccggcggcattcatgccggtgctgactcgtgcgcttgccaatgtgaccgcggacaagaagctgctggagaagatcgcagacgggctatctgcgatggacaagtccgccgaaattcagcgggaccgcaagggaaatattctctatgataaggagaccaaggatacggaaatcgtcaagtgggaggaggacatcaaggactacatggcccgcgaggtgctgccccatatcccggacgcccagtggttctttgaggagaatctgggagccaagaagccggtggtcaagaccggtgcggagatccccttcacccgctacttctacaaatatcagcagccagtgcccagcgaggaactggaagccaaatttatggagctggagctttcggtgtcgaagcgtgtgacgaagctgtttgagtgaggtggtggtagtatgagaaagatgaaagatagtggagttaactggatagggctgattcctgtcgattggaagattgataacccgaaatatcacttcacacagaggaaagatcgtgcaccacaaggaatggtacagcttaccgcctcgcaaaaatatggagtcattactcagtctgaatatgtggagcgaacaggtgcaaatatcgttacagttcaaaaggattttgatattttaaagctcgtatgtgccggggactttgtaatacacatgagaagctttcaaggcggactggaatatagcgagaagactggtagcattagttctgcgtatgtaatgctgattcctcacaaaacaattcgtgtgccgagatattataaatggtttttcaaatcaagtaactatgttgatgcgttaagtagcacatcaaatcttgtacgtgatggacaggcaatgcgatgggccaatttcatccaactgccgattacgttaccgccggaagaggaacaaaaccgaattgctgattacctcgatgccaaatgcgccgaaatcgacgccctcaccgccgacattcagactcaaatcgacactctggagcagtacaagcgctccgtcatcaccgaggctgtgaccaaggggctggagccggatgtggagatgaaggatagtgggattgcgtgggtggggatgataccggcacattggcctctgcatcctgtgtatacctacttcggcgagagaaagaacaagaacagattcggcgtggaagataacttgctgtctctgagttatggcagagttatccgcaaggacatcaataccagtgacggtttgcttcctgaaagcttcaacacctacaatattgttgaagctggagacatcatcatccgcccgactgacttacagaatgataagcgtagcctgcgtactggcctggttaaggaacacggtattattacatcggcgtatattgacctgtgtccaatcaaggaagtagattcgagatattttcactttctgctccatgcctatgatgttatgaaggtgttttacaacatgggcaatggtgtgcgtcagggattaaactattctgagttttcccgattgatggtatttgagccatcgtatgacgaacaggtagctattgcggaccaccttgatgcgaaatgtgctgagattgatgacactatcgcccaaaaacaagaacagctctccacattggaggcttacaagaaatctctcatctatgagtatgtgaccggaaaaaaggaggtgtcctgcggtgaataatgtgttatctgaaaaagactatcagaaattcctcctggagcggctggcagacaacggctatgtcatccgtaaggcatctcatttcgaccgtctgtttgcgatggatcgagagatgctaatgaagtttctggctgacacccagccggacacgatggattatctgcggaagatatacaaagatgacctggaggacaccatcgtcagctttatcaacgcagagacgactaaggccaggggcagtctgattgacgtgctgaagcacggcattgagatctccaaccgccaactggatctgatgtacaccaagcccgccaccacctttaacccggagctaacgaagaagtatgggcagaatatcttctccgtcatggaggaggtctgggccagcgacaaagagcggatcgatgtggtcattttcctgaacggtcttgcaatcatctcctttgagctcaaatgcaacaccgctggacagtcctatcaggacgctatttaccagtaccgcaccgagcgcaaccctaagacccgtctgtttctgtttaagtcaggctgtcttgtgaactttgcgatggatttagaagaagtctacatgaccaccaagctggcgggcgaggccactttcttcctgcctttcaacatgggcaacggtgaaggtgtgaccgccggggcgggcaatccggcttttgaggacagatacagcgtgtcatatatgtgggaggatattttgaccaaggataccgtgcttgacctcatcagcaagttcatctttgtagaggtcaaggaaaaggtggacgatgaaaccggcaaagtgaagcgttctgagaacctcatcttcccgcgctatcaccagctggatgtcatccgtaagctcctcgccgatgttcgggaaaaccgtaccgctcagaattatctgatccagcacagtgccggttccggtaagaccaattccatcgcttggttggctcaccgcctgacttcgctccacgatgccgacaataagatcatcttcgacaatgtcatcatcgttaccgaccgtgtggtagtggacaggcagctccagaaagccattatgggcatggaacataaagccgggctgatccgggtgatggacgataaatgtaattccactgatttggcgattgccctcaacggtaacacaaaaatcattgccactaccatccagaagtttccgtatatcgtggacagcgtgaaggggctgaaaaataagcggtttgccgtcatcattgacgaggcccattcctccaccgccggtaaggatatggccgctgttacgatgtctctgggctccggcgagcagtttgatggcgatgtggaggacatgatctccgacgagatcaagcgcaacggcaaacaagccaatgtgtccatgttcgcctttaccgccactccgaagcctaccaccattcagctctttggtcgcttgaacaccaaaggtcagcgggaggctttccatgtctactccatgaagcaggccatcgaggaaggtttcattttggatgtattgcagaattacaccgaatactcgaccttctaccagatcaataaggaaattgaggatgatccccgctgtaagaccaacgcagccaagcgacaaatcgcccgctttgtagagctgcatgataccaatatctcgcagcggatcgaggtcattgtagagcatttccgcaccaccgtcatgcaggaactgggtggccaggccaaggcaatggttatcaccgcctctcggcaagccgccgtgaagtatcgtcaggcgtttgaggattacatagtgaaaaaagggtatgagggcatccacgccttggtagctttttctggcaaagtgaaactcccagatgatgaaaccgaatatacagaggcttttctgaacggctttccggaggatcggctcacaaaagaatttgatactgatgcctaccaggtgctgttggttgcaaacaagtatcagactggattcgatcaaccgaaactatgcgccatgtatgtgctgaaaaagctgcgtggggtgaatgcggtccaaacgctttcacgcttgaaccgtatctgcccgccttacgataaaaagacttttgtcttggacttcgtgaacagctatgaggatatgaaagctgcatttgcaccttattacacgactacgcttctgtcaaattccgtgacgccaaacgccatttacgacctggaggccaagatcgatgcctatgcgctatttgatcctgcggatatcgacagtgcaaacgagatcctgtatgcggaaaaagtcaccggcaagcagaagcagcggctgaccttcttcctgcaaaagagcaaaaagctgctggatcactatgagtatgaggaacagcgagaagcggttgcggccatgcgcagctttgtccgctactacgagttcttgttgcaggtgtcttgctttgaggatgtcgaactgcacaagaagtataactttatcgcttacctgctggcgtacatcaatatcaagcatcctggtgccggttttaaccttgacggtaaaattaaagcatccaactttattcagaagaagggtgaagagcacgtttctccaaacctggtggcaaagccggtgatgaaactgcccacggccgagcactttggccttacggaagacaaggagcagcggctgtcagagatcattgatgagataaacagccgcaccggaaaatcctatgataacgatgtggtggtcaaggccatgcttcagatcagggatattctgatgaaatcagagagacttaagaccagcgcaaagaataatacgcagacagacttcgagttctcctactttgatgacattgacgatgctctcatcgaagggttgtcccagaaccaggatttcttttcccttctgctttccaatgaggagatgaaacggcaggttttgggtatcttctccgaagaaatctataagagtttacgagacgcatagtgaggtgattgtatgtttgagcagttccgtttgacagaggtactggtacagtacaaacagaatttcgtttcaaagttgtggggcgaagaaaaatataaatgggaagccgtgaagtggttccaggataattgggatgtgaatgctcctgactttgcagaaatgttaaaccgctccctggacaagacctataatctgctggcgtctgctaacaatttcccgaaaggcatgattgttggctttgctaaatctgcgcctgaagaagtgcgcgccatgtttttatcgctgtatgatgaaagcaaagatgtgtacgaacgaatcaatgcgttcaaaatgcagtcgactgttctgctggagaagtatggaaacggagctgcacagcactatcagtacgaaaatgccatcagcacatacctttggcttcgttttccagacaaatactacatctataaattcggcgaagtaaaaacagtcgccagcgaattggaatcggactatcgatttaagaaaggtgcttatgccgacaatattcggaattttctgaagctgtatgatgagatcagcgtggcgctgaaagaagatacggaattggtgaacctgttccaatctcagcttacggacacctgctatcctgatccgcaactgaaaacgctgacgatcgatgtcggtttttacattagcagatattattctcagaaagaggcttccgctgctgcgactacagaatggtatggttcagattatgacccaggtctttctgttgatgactggttgaaacttctgaaggatgaagctgtctttaccaccggtgcccttgaaattatgaaacgtatgaaggattacggtggggtggcttcctgcacacagcttgccgtgaaatatggagagacaaagaacttctataattcaggttctgttgcattggcaaggcgggtatgcgattccaccggcatcaccccgaatgccagagaggacggttctatacagtggtggacaatcctatacacaggccgtgacgcaggaaaggatgaggatggaagttttatttggaagttaagagacgagctttcagcagcccttgataaagtagatctaagtagcatcgaattgtatgttgcagcggctcccggagagcaggatcacggctattggtggctgaatgccaatccaaagatctggagcttttccgacattgcggttggcgaggttcaggcatacacactttataatgagaacggaaataagcgtcgtatcttccagaacttccttgatgcgaaggctggggatatgatcatcggatatgaatcgaatccggtgaagcagatcgtcgccatcggtcgcgtcagcgcagagcaggacggcgagaagctgttctttgaaaaggtcgaaggcctgacttcaccgattgattatgcgaccttgagaggatgcccggaactggagcgtatggagtattttcagaatccgcaaggtagcctgttcaagctcaccagaggcgaatttgacttcatcttcgatttgattcgtgaggaaaatccggcagcgcaggaagcctccattgatgcttacacaaagagcgatttcctcgatgaagtgtacatgaccgaaaaacgctacgagaaccttgtggctgttctccgcaataagaagaacatcattctgcagggtgctcccggtgttggtaagactttcgccgcaaaacgtctggcgtggtccatgatgggcgaaaaagatgatagccgcatcgagttcgtacagttccaccagaactattcctacgaagacttcatgatgggctataagccggtcgaggacggctttgagttgaagtacggtattttctatcgtttctgccagagggctgccaaccagccggacaaggagttcttctttatcattgacgaaatcaaccgtggcaacatgagtaaaatcttcggtgagttgctgatgctgatcgaaaaggactacagaggcacaaaagcgactctggcctataatggtctctcgttctcagtgccgaagaatctttatatcatcggcatgatgaacacggcagaccgtagccttgctatgatcgactacgcgcttcgtcgtcgtttcagcttctttgaggtggaaccgggcttcgattccgagggattcattcattatcagaacggtctgaacaacgagacgctgaatgaacttattaacaaggtgaaggacctgaaccgtgagatcactcttgacaagtcgttgggtaagggcttctgcatcggccacagctatttctgcggcagggatgtatgcaccgaggaatggctgcactccatcgttgactatgacattcttccgatgctcagcgaatactggttcgacgacgccaataaactccagcgttgggagaacattctgcaaggtgtgtttcaatgattaaagataagagcatcttcataaaaaatatatactatatgctttcgtatgccttcacgacactgaatcaaggcggctatgaggatattgccactgaagagtttgagaacatgcacaacctttttgccgcaattctggcgaagggcatcagcagacagttgaaacagggtctgtatcgggagtacctgaacaggaaagaggatgttgctgatgttcgtggcaaaatcgatataccgggaaccatacagaatcgcctcgccaggaaacgggtactgacctgcgagtatgacgagctttccgaaaacaaccttctaaatcagatactcaaaacgactgttatgcttctactccggcacacgcgggtagatcaagaatacaagagtgatttaaagaaggaaatgttgttcttctcgaatgttgacacaatcgatccaaccacgatccgctggtcggctattcggttccagaggaacaacaatacctaccgtatgctcatcagtctgtgccagctcattttggaaggaatgcttctgacgactgactctggagaatacaagctggcttccttcgtagatgaacagcgcatgaaccgcctgtacgagaagttcatcctcgaatactatgctaaagaatgtccgcaggtgacaacaacggcctcacaaatcccatgggctttggatgatggtattgggacgatgctgccagtgatgcagagcgacatcatgctgaccaaggatgatacggttctcatcattgacgccaaatactatacgcatacgacgcagacgcagtacgatgtccacacactgcactctggcaatctgtatcagattttcacttacgtcaagaacaaggatacagggtttggtgataaaccgcatacggtttctggtatgctcctttatgccgcaacggatgaggctattcagccggacaacagctaccagatgagtggcaacaagattagcgtccgaacgcttgacttgaatcaagaattctccgaaattgctactcagttaaatacgattgtggacgaacatttttctgccagttaaagctctattggaattccttttaatctgcaaagatgaaacgatagcccacaaattaaacgatacccataaatcaaacgctggccgctactgctcggcgcctttgcagactgggtaggcaacaggctatcgctttatctgatggaggctgggactgataaaagccagaaaccccttgaaatcagggcttttgggcaaaaagaaagcaccgcaaccttgatacccattgtatcaaaattgcggtgcttctttggtggacccgaaggggatcgaaccctcgaccttacggatgcgaaccgtacgctctcccagactgagctacgggcccaaatcaacagttccaaaaacagaacaggaaaacaaagcaatatgaaattataggtgtggcagaaaaccgaaccctttgcgctcccaaccgcgctacaggcccaaatgctttaagcaagactatattatatcaggagaatttaaaaagtaaagtcttttttgaagaaaaaaccggaaaaattttagaggcggggagagaaatagagaagccctgtgtgaaaaacagaaaaagaagtgaaagatttttgagagagcttcttgattcttttgggaaaatgatgtacaatacaagccaacagtctgccagataccgtatcggtgtcgggcatggccgcactagtcggggagatagcggtgccctgtacctgcaatccgctgtagcagggatgaatcccggacccccggaggcctcttgtttcgttagttgccggtaagcggtgatgataaatcggtcctgcgcaacgcagcactgtgaaccgtgtcaggcggggaaccgagcagcactaagcagaacgccgcgtgtgccgcgggtttgccggttttgagctggctgccggtgagacaggaatgagaggtccttcaaaggccggtgtgcggtcctgccggatcccgaatgtgtctggcggactgatttttgtgggcagaggaggagagcgggtgtatcaggcgctttatcgcaagtggcgcccccgcacctttgacgaggtggtggggcagccccatatcacagagacgctgaaacggcaagtggcgacgggacgtttatcccatgcctacctctttacgggaacccgggggactggaaagaccacctgtgccaagatcttggctcgggcggtgaactgtgagcatcctgtggacggcaatccctgcaatgcctgccccgcctgtctgggaattgagaacggttctatcctggacgttttagaattggacgccgcctccaacaacggggtcgatcagattcgcgcgctgcgggacgaggcggcctatacgccggcggcggtgcgtaagcgggtctatattgtggatgaggttcacatgctgtccacagcggcattcaatgcgctgctgaagattctggaggagcctccggcccatttgatgtttattttggccacgaccgaactgcataaggtgcccgccaccatcaaatcccggtgtcagcaatttgcctttaagcggatctctcctaaggcgttggcagggcgactggattatgttgcccgccaggagggaattccgttgtcaacacctgccgcggagcttctggcccgtctggccgatggtgggctgcgggatggattgtctttgctggatcagtgcagcggggcagagggagagctcaacgaaaccgttgttttggacgttttgggattggcgggaaatcgtcgaaccgccgaacttttggactgtgtggcccgggaggacaccgccggcgcgttggaggcgctggatggcctttatcgggatggtaaggacatgggggcgttgctgggagagcttgcggcattggtccgggatcttctgattcggaaaaccgcgccggagggcggccagggacttctgacaggagggtatgaggagcgcaccatccgacagctgctccagcggtttacctccggggagctggtgcagatcatgactcttttgcagagagcacaggcagaactgtaccgtagcagcagccggcgcttcgacgttgagctctgcctaattcggctttgcgaccgccgtttgtctgagaccgaggaggggattttgtcccgcctcagccgtttagaggaacagctgtctcagggaagcatcccgatacagcaggagaaaatcgtctcgccgccagaggagaacgcttcttcaaaggaaccaattcctgcggaggagacaccgccgtgggtgccggtgtctccccaggaggaagaggagacgtttgtcttttcggaggaggatgtgcccccttgggaggacgctggattttcctctggcccattcgatgtgccggctctgtctcccgacgtaaagatggacagagagaaaaaaatgctgacggcgaatgatgaacagcgggggaggcatccatcggaagaggtgccttcaggacagtggccggcctttttggctaccctgcgggatttgccgcctatggtgcattcctttttgcacaagccagagtctgtaacgggaacctttgaggagaggacccttacgctgtgggtggattcagaactgacgaaaggattcctcagcaggggagataccccttccctcctggaacgtgcggcagaggcctatctggggcagccccggcgggtggttttcaaagtgggaaaaccggaaccggcggaacggcggaatccctctgcctctcaagcattgtcccatgcggaagtccagactccgccggaaggggataaatttgatgatctgctggccttaggccggcaatttggaaattttaccgtgaaataaactggattaaaggagcgagaacacgatggcaaaaggttatggacgtcccccaatgggccggaaaggcggcaaaggaatgggcatgggaatgcccggcctgaacatggatatgattaagcaggcccaaaaaatgcaggcagatatggagcgaacccaggcggagctccaggagaaggaatacaccgccacggcgggcggcggcgtggtctccgccacagtggatggcaagcatacgctgaaggcattgaccatcgaccccgaggcagtggacccggaggatgtggaaatgctccaggatatggtgattgctgcggtcaatgaagcggttcgggcggccatggaggacatgagctccagcatgggaaaaattaccggcggaatgaatttgcccttctgagcgggagaagaggaggaaggttccatgaagattacattgctggagccccttggcattccagaagaagtgttggcacggtatcagtcctgcctggaaaagaggggacaccagttcaccgcctatggagagaagaccactgacccggctgagctcatccgccgcaccggggagagtgagattgtcattcttgccaataacccctatcctgcggaagtggtggaggctgcgccaaaccttaaaatgctggatgtggcattcacagggattgaccatgtggccctggatgcctgcaagcgaaagggcgtaatgctctgcaatgccgctggatattcaacgcagtgtgtggcggagcttgccattggcttgaccatcgcctgcctgcggaacatgccggactgtgaaacggctgtccgaaccggcggcgtaggcggggcgctccgtggccgcgaaattggagggtgtactgtgggcattgtgggaaccggcgccattggaaccatgacagcccggttgttccaggcttttggtgccaaggttattgcctattcccgcacggttcgtcccgaggtagaggagatggggatttcctatgtctccttggaaacactgatggcgcagagtgacattgtgtccctgcatttgcccagcaatcctcagaccaaggggatgatctcaagggccatgctgcaaaagatgaaacccacggccattctcatcaatgtggcccgaggcgctgttgtggacaataccgctttggcggaagcactgaaccaggaaaagattgctggggctggtattgatgtatttgatatggaaccgccccttccggaaacgtatcctcttttgagggcaaaacacaccgttctaacccctcatgtggcctttgccacagaggaaagtatgcttcggcgtgcggagattgtgttccggaatgtggaggcctacctggacgggtgtcctgaaaatgtgtgccccctttgatggaagaagagaagaagaaactccctttgtactctgagaaacggagacaaagggagtttttatatgctgcattattccgggcgaggggagaaactatccgggcagagttctcgtactttggcttgaatgccttttaggtctacaaaagtatccggacctttcagggggtcccgcaggaccgcagaggggtgataaatggcagtcatttgcacgccggcccggtcgaaccattgcccatgctgcttggtaatacgaaatcccttgtcaatgatccgcatggcggcgattcggcccaaacaaacgatgattttggggcggatcaaggccgtttgggcgcggagataaccaatacaggcgtcctgctctgtgttcaaggggtcccgattgcggggcgggcggcatttgacgatgttggcgatgtagaccttggagcggtccaggtcaatcagggacaacatcaaatccagaagttttccggcggggcctacgaagggctccccctgcaaatcttcctgctcaccgggaccttctccaatgaataaaatgtctgcctgccggtttcccacgccgaagacaacgttggtgcgggtctctgacagggggcagttttgacattgccggcatcgagcctctaattcttcccaggtgaccataaggcgcctcctcgtccgtgcttggcgaaacatgaagtttcccgtcgatgttgcaaacattataccagccggagggagaaaaggcaacggggatcaggtttttggcttcgacttaaagaggacagcggcaaggtagccgaagaagacagcagcggtgatcccccctgcggcagcggtcacgccgcccaataaggtccccaggaaaccgctttctgcgactgccttggacaccccgcgggccaggttatatccaaagcctgtgagagggaccgtagcacctgcaccgcaaagctctaccagatgtccgtacagtcctgtggcgcccaggatgacacccaccaccacgtaaagaacgagaattcgtgccggggtgagcttggttttgtcaatcaagatctgtccgatgagacagagaatgccgccgcagaggaaggcggccaaataggtgctggcgtcactcatgacgcacctcctttctccgtggtgatggccacggcatgacagattccagggatgctctccccctgcatggtcgcggtgggagagtggagggcgcctgtcccgcagaagagcaggttgcggtaggttccccgccgcatttctcggagaaggtgccctgtaagcactacggcactgcatccgcagccggacccaccggcatggacatcctgggtggtgggatcgaagagaaggacaccgcagtcgtcatagcggcctctcaggtcaatgccatcccgttggaaaaagtctgtgacaatttcctttcccaggctgcccaagtcgccggtgacgatgaggtcataaaagtcgggggagcgtccggtttcctcaaaatgggcgtggagtgtggcgtaggcggcgggggccatggcggcccccatgttgttggcgtcggtaatccccttgtccacaactttgcctgtggtgacatgggtaataaagggaccggttcctttgcgggacagaatgaccgcgccggaccctgtggtggtccattgtgcagtgggcggcttttgcccaccgtactccagggggttgcggtactggcgctccgccgagcaaaaatgggaggaggtcagagccgctgcgtaggaagcaaagccgccgtccaccagcatggccgccagagacatcccttccgccatggtggagcaggcgccgtataggccgaaaaaaggggcgttctgtgcccggagggagtaggaggtggcaatgcactgattcagcaggtctccggcaaagacatagtccaattgatcggatgaaatccccgctttgtccagggcataggaaagggcctgcttctgcattgccgtctctgctttctcccagcttttttcagcgaagctgtcatcctggctggcgaagtcaaagcagcggcccaggggaccttgtccctctttcttccctacggcactgccaaagccggcaatggagggaggggaagtgaggcggacggtctgccgcccaagttttttcgtgtccaaagcattctctcccttgatttggattgtgcctttattgtgtgttttcctggcagaattattcaagagaggcaaaaagatgtttggcttctacaacagcccgccgccaaaaagaaaggcctggactttccggcccttgctgtactataataaagccatcaccgattgacaacggaagaaaggatctggagttatggcaaacgcaacattagtcacacaaaaagtgcaggagatccacctgagcaataaattagagaaatcgggccaaattcagctggacagttcattttccctcaacgtgagtttttcctccgacggcagccgctgcgtgggaaagcttcagcaaaccctccgggataaggaatttgtgggaggcaagtttaccatgacagtggaactggtgggtattttcaactgttccaatgcgacgacagacgaggtgaagcgccaagtgcatggggaggtctatgaccagctttttccgtacatgcagtcccagtgtgccagcctggctgctgcctcgggggttcccggattgatgctgcggaaggtccccattgatccgaacaacattgccatcaataagaagggcggcccagacaacgaccggaatcccgacggggggcccaaactgacgctgttggaatgaaaaagaccctttatcaggacctgtgggaaggggcggccggtatggagccggcagttgccctgcggtgcggggaccaaagtcttaccttcgccgccttctttctggagattcttcgggcggaagcagggctgcgggcgcttggcgtgcagtcaggggatttggtgaccattttatccctgaacacccctgaggcggtgattgcattttatgccattgaccgaatcggcgcggtggccaactgggttgatatgaagctgagcccagccgaagtagagttctatctgacacgggcaaagtctaaggtcgttctggttttagaactaattttccaaaaagtatacgccaaccgtgggcatgcgccggcggaacattttgtggtgcttcctctggctccctatctcacgccggagctggggcggaaactccgggtgggcgtctgggaaggggagaagggaccgggatgtgtctcctggaaagaatttctccaagatacaggggaatctgttccggaatctgcccgctgggaggagccggtggccatcacatataccggtggaacaacaggcccggccaagggtgtgatgctctcccgccgggcgtttcgggcctccctggagcagtatacccaggtggggacgatgtacgggagggggggagccacgttggtgcttcttccgctcttttcagcattcggcctgtgccagtgtgttcatgtgccgctgtgcctgggtatgacgattatcctgtaccccatgtttcgccccgagcagttgggagagatgctgcggcgctatcgtccggaacaggtcagcggaaccacctcctactggcagctgcttctccaggacccgtgggcggaccaagccgacctgtctttcctgcaggtcccacgctgcggcggcgatgccatgacggcggcgatggagcgacggatcaatgattttttggcccagagaggctgccccgcccggctgatcaaggaatatggaatgtctgaggtggccgggattgtctgtgtcagctatggggactgggaggcgggggatgtaggacgtcccctgccgggctgtcggatcatagcagtggaccctgagaccggagcggcctgcccaccggaggggcagggggagctgatcattcaaagcaatacagtgatgaatggatactacggcgtgccggaggcggacgctgaggttctccgtcctggccccgatgggaccttatgggtatggaccaaggatttgggccatcaaaccgccgacggcagaattgtggtcacggggcgaaaaaagcgcatgatttcccgcaatggctttaagatatttccttctgtcattgaggagtgccttttgcaggaggatcaagtggaggcctgcgcagtggtgggaggcaggaattccagaggagagaccgttcctgtggcccatattgtcccccaaccagggaccgatcaggaaaccttggagcgggcacttcggctgcgcgccaagcaggcgcttaatacgtatctgattcccggtatgtactgtttctggtcacggcttccttatacggagcgaggaaagctggattatcgaaagctggaagaaagccagaacaccaagccgtaagaaaaagctgcgttggtcccgcacgcatgaaaaagtgtggcgtatggtcttatggcttcgtttctatattgtgctggggagattgtgttccatcctctgcaagatcggaagacagtgcctgccgttgggcggcatttaagtttcgcgtggcgtccagtgcacgctgggcggccaagaaccccagggtggttccgagctgggtgatgacggaagctgccgccgccagttgttcttcgtcgagacgttccgacaggagattggcaagaagggtgacgatggcgtttcttccgctggcatccatagtttcatcacctcagaaatattgtatgcggcagagctgacatctgcctttcctggaaacacgggttcccgccggaacccgtgtttttgcatgaacgcatctctgtgggcatagggtagtgcaggaaagccggcagggagggattctatgatttatgtggtgcagagcggagattctttgaccagtatcgcgaagcggtatggggtctctttggaacgcctgcgcagcgacaacggccttttgccggaacagcccctggtgccagggcaggcattggttgttttcattccgaaggagacctaccaggttaggtcaggagacacgatctatggcattgcccggcaggcgggaatctcggcacgggagctgatccagagaaatccgtcccttgcccaaggggcgcctcttacggtgggggagcatcttacccttcgcccgaaggaagaaccggagggttctctgatggtcaatggctatgcctatccccatatagaacaacgggttctccggcaggctatgccatatctgacggacctgtctctcttttcctatggatttcgggaggatggagcactggttcccttggcggacagccgcctgcttgcggaggcctccctgtttggggcaggggcagttctggttttgacttccatagatgagagcgggaccttttcctcccagcgggcatcccatctgtttcaagatcagaggctgcaggaggttgtgctggaccaattgctccaagtgatgctggagaagggatacctcgggctggatgtggattttgaatatgtggaggagagagacaaagaggcgttctttcactttttgggtagggcccgggagaggcttcatcaggatggctttttccttcacgtcgatctggcgcccaaaacccacgcccagcagtctggaccgctgtatgccgcccatgattacagtgtcatcggtgccattgcggactctgtgctgctgatgacgtatgagtggggatatgcctatggcccaccgatggcggtggcccctctgccccaagtggaagaggtattacagtatggtgtgacagagattgctccgggaaagattcagctgggaatcccgaactatggctatgattggacccttccctatgagcccagccgccgggctgccaccatagggaatcaggaggcggttcggctggcaggacaggtgggggcagaaattcaatttgatacggtatctcaggccccctatttccgatatacacgggagggaattgcccatcaggtctggttcgaggatgcccggagcattcaggcaaagctccaactggcgctgcaatatgggattggcggtgtggcttattggaatttgctgcggcctttttcccaaaactgggcgctgctgagccagaaaatccggattctcaatcggcgtgaaggtccgtaaatagagaacaggcgcgctctctgtattcagagaaacacgcctgtttggggggagatcattcaaattccatcagcatctgcgcggagggattgttgttgcccgccagacgtaccatgtcatatcgcgtcatatctcccatgttcattttgatgcggaccagattggactcctgggcttcggggacgatgtctggaacaatggcgacaccgtggcgggcccggaccatcagcatttgtgcattggtactgttggtttgggcgaaccgttccggcacaacaccaaattcccggagaagcatttggcggagcatgtccatggaatttggcccggtatcttcacagtttgtaatgagacattccccccgcagcatggaaaccgcatctccctggggatacttggcggcaatggcgcgatcagcgaccaggtagttgtaagcctcaaacatgggtcgggagagaatgtcctccttggcaaaagcgtgctcacagagaacgttggccaaaatcacgtccaattccccggattttagtttttctgtcagcgcaccgtaggggtattgaaaaatatccactttaatttctggatgagcaattaagaaacgggagaagaaatcctccgtatgtcgggattcgtacatgccgattcccactttaacgtggccgcgatactgctctgcaatggcgatgaggcgctttttggtgtctttgtcatagcgcagcataaaattaacccgttcataaaaaaattggcccgcatctgtcagcgagacggaatgggcattgcggttaaacagacggacctgcagttttccttccagagaggcaatatactggctgatggcggtttgggatacagagtgtactgcggcagcttgcgtgaaactcagacactcggccaatgtaacaaagtattcgatttttttgttgagcatagcataggctccttttcagacgcagtatcgtgttttctccttctgattgtgcaataattatgtgaaaaagtcaaatcattcttttcctcggcgagaagatgggaatatgacagtttggctctcgccataattcgtcaggctgggaaaggaaatgtgatagaaagaaatattatttcattaagaattgacagaacgtctggtatctggtaacatactacaaacgccaagtgctacttttcaagacgggaggaaacaagtgcatgaagattctcctgaatcaggtgacggtgtttcgaaagggaactgcggagaagctgtctgttctcgtggaggacggtcgtattgtttctctttccaaggaggctcccaccctttctgacgcccgtgtgattgaattaaagaatggttctttgtttcccggtttcgtagatgtccatgttcatctccgtgagccgggtttttcgtacaaagaaaccattgccacagggacgcgggctgcggcccatgggggatttaccgccgtgtgccccatgcccaatttgaagccggtgccggacagcttggcacatctgcgtcctcagttagaggctattgcccgggacagcgtgattcatacctatccctatggcgccattaccgtgggagagcagggggaaacgctggccgcattggaggagatggccccccatgtggtggctttctctgatgatggaaaaggggtgcaggacccggaaaaaatgaagcaggccatgcggcgggcgaaggcactgggcaaactgattgtggcccactgtgaggacgagagcctcattcaaggcggttatatccacgatggtgcctatgcaaaggcacacggacatagaggcaatccctccgccagcgagtggaagcaggtggaacgggatttggcgctggtacaggagacaggctgtgcctaccacgtctgccatgtgtccaccaaggaatcggtggagctgatccgcagtgccaagcgggaagggctggatgtgacctgtgagaccgcgccgcactatctggtattccatgatggaatgcttcaggaggacgggcgattcaaaatgaatcctcccattcgtggggaggaggaccggcaggcactcattgccggaattttggatgggacagtggatatgattgccacggatcacgcgccgcattccgccgaagaaaaagcggggggactggaaaaaagcctcaacggcatcgtgggcctggaaacggcctttcctgtgctctatacggagttggtgagaccgggggttctcacccttgcacagctgattgacctgatgcacaccaatccggccaagcgatttggcatcggtgcgcccctggaggaaggggcaacggctgattttacggtatttgatttagatgcggaagagaccattcagccggagcactttctttccatgggaaaaagctctccttttgcaggccggagcgtatttggaacgtgcttattgactatctgcggcggaaagatcgcctggcaggcggaggggggagcgtcccgatgaagcgaggaaagtttacggttcttcagaataaggaactggcgccggccacgttccgaatggttttagcgggagacacagaggccatcaccgcgccgggacagtttgtgaacatcgcgctgacagggaagtttctccgccgccccatttccgtctgtgactggaatgaggcgcagttgactttgatttataaggtagtggggcaggggacggcacagatgagtcaaatggtgccggggacggagttagacctcctgactggcttgggtaatggctatgacttggagaaatccggggacaagcccctgctgattggaggcggggttgggattccgccgctgtatgccttggccaaaaagctcattgcacagggcaaatcgcctcgggctattttggggttcaaccggaaagaggaacaatttttgactgcggagttccgggcattggggattgcagtctctttgaccacggtggatggttccctggggatcaaaggctttgtcacagatgccatgccccagacaggatatacctatctgtatacctgtgggcctgcgcccatgcttcgggccatcgacgaaaaggctgtgacctcgggacaattcagctttgaggaacggatgggctgtgggtttggagcctgtatgggatgtacctgtcagaccaaatatggcagcaagcgaatttgccgggagggccccgtgctggagagggaggaaattctatggtgaagaccgcagtgacattgagcggcgttttactggacaatcccgtgattcctgccagtggtacgtttggattcggatatgaatttgctcagtggtatgacatcaactgtctgggtgccatcagcatcaagggaaccacccgggagcctcgattcggcaacccggccccccggatcgcggagacggcagggggaatgctcaatgcggtgggactgcagaatcctgggattgaccgggtggtggctgaggagctccccaagctgcgggaggtctatcaaaagccgattttggccaacatcagtgggttttctttggatgagtacgtgacatgctgcgccaaggcggatgcctcaccctacacggacctcattgaggtcaatgtgagttgtcccaacgtgcaccacgggggcatgagcttcggaacggacccgcacatggtttatgatgtaacccgggcggtgaaggaagtgtgccgaaaaccagtatatatgaaactctctcccaatgtgacagatattgtatccattgcccaggcctgtgagaagggcggggccgacggattgagtctcatcaacactctcatgggcatgcggatcgacctgaaaaaacgggcgcctgttttggccaacaccacaggcggtctttccggaccagcggtttttcccgtggcgttgcggatggtttggcaggtctacgaggcggtccatctgcccatcattgggatgggcggcatccaaagcgcggaagatgtcctggaaatgatgctggccggagcgaccgctgtgcaggtgggggcggctaacttagtcaatccgtttgcctgtcaagagatcatcgacagcctgcccgggctcatggagcgcctgggcattcaagagatcaacgaaatcattggaggtgcccacagatgggaaaagatgtgatcgtagcctgcgatttcagcagcaaagcagaaaccttggcatttttggaccagttttctgggagaaagccctatgtcaaaatcggcatggagttgttctatgccgaaggcccgtccattgtgcgggagattaaggcaagggggcatcaaatctttttggacctgaaactccatgatattcccaacacagtaaaaaaggccatggcggttctgtcccgactggacgtggatatgataaaccttcacgcggcgggcacccgggcgatgatggagggtgcgctggaaggggtaacccgaccggacggctctcgtcccttggtgattgcggtgacccagctgacgtccaccagccaaacgagaatgcaggaggaactgctgatccccagaacgatggaggagaccgtcatggcttatgctgccaacgcggcccaagccggattggatggtgtggtctgctctcccatggaggcgggaaaggtccatgaggcctgcggcagaaactttgtgaccgtaacccctggtattcggtttgcggagggagacaagggggaccaggtccgtgtgacaacaccggcccaggcaaaggaccttggttccgattatattgtggtgggccgtcccattaccgctgcggcagacccggtggccgcctatgagcgttgcgtgagagaatttacagattgaggaggcgattgccatgaagacaaagattgcgaaagatttgctgaagattcaggcggtgtttctccgtccggatgaaccctttacttgggccagcgggatcaaaagtcccatttattgtgacaaccgcctgaccctctcggatcatcaggtccgtttggatgtggagaacggcctggcggaattggttaaaacccattatcccgaggcggaagtcctcatggggaccagcactgcggggattgcccacgctgccattaccgcccacctgctggcgctccccatgggatatgttcgctctggcgcgaaggatcatggacggaaaaaccaaattgagggcaagctggttcccggacaaaaggtggtggtgattgaggacctgatctccaccggcggcagtgtgctggaggtggtggaggttctgcgccaggcgggggcagaggttttgggcattgccagtatttttacctatggaatgcgaaagagcgtggaacgcctggccgaagctcaggtgaaaaacgtaagcctgaccgatctggacacggtggcccaagtggcggcggaagaggggtatatccgggcagaagaccaggcgcggctgctggctttccgggacgatccctctgatacccgttggattcagaagtaaccggctgacacggccttgtttgtgtcttaccgtgaacagaaaggaaggggcagtgtatgaagcgagatttgattgacatcacggatctgacggtggaagagattgacgagctgattgccaaagcggaggatatcatcgagcaccccgaggtttaccgggagaagtgccggtataaaaagctggcaacccttttctatgaaccttcgacccgaacccgtttaagctttgagtcagccatgtatgaattggggggacaggtgctggggttccatgaggcccagagctcttccgccaccaagggagaaagtgtggcggataccgcgcggacggtaagctgctttgcggatatcatagccatgcgccatcccaaggagggtgcgccgctggtggcgtccatgaaggctacggttccggtgatcaatgccggtgacgggggacatcaccaccccacgcagaccctgacggatctgctgaccatcaaacgggagaagggaagactggattcgctggtggttggctgctgcggtgacctgaaatttggccggacggtccattccctgattggtgcgatgtcccggtatccgaatgttcgttttgtgctcatttcccctgaggagctccgtgtgcctgagagtgtgcgtaccgacctgctggagaaaaacggcattgactatgaggagaccacttctctggaggaggctatgccccaactggacatcctctacatgacccgggtgcagcgggagcggtttttcaatgaggatgactatgtccgcttgaaggacagctatatcctcaccccagacaagcttcggacagccaagtgggatttggccattttgcacccgctgcctcgtgtcaatgagatttccattgccattgacgatgatccccgggcctgctatttccgacaagttctctgtgggaagttcatccgaatggcgctgattctgaaattgttggaggtggagtgagatgatcatagggaccattgtagatggcattgtcattgaccatatccccgcagggcggggcatggacctctaccgggatctgggcctggataagctggaatgtgaggtggcggtcatcaaaaacgcctccagcggcaagtatgggaaaaaagatattttgaaaatcaatgaggtcattgacctgaactacgacatgttgggttatattgatcctcacattaccgtcaatattatccgcggcggagagcggatggagaaaattcatccccacctcccagagacgattacgggtgtcatccgctgtaaaaaccctcgctgtatcacatccattgagcaagagcttcctcatattttccggttgaccgaccgggaacatggtgtttaccgctgcttatattgtgacacgaagggcggaaaacgataaacgagtagaaaagacttgccaaaggcaagccttttcttttctaaaggagaatttgccttagcctggacagggagagagggcttgtggtccttcgtggaatatggtagaatgataaaaattgtggaggggaaggaggcggtattttcatgccgcaaatcgtaagcaatctgccttggcttgtgatctgggtggttgtctttttggtacagagctacttctttcggaagaaaaattccttcgggtccttgatccttttgtggctgaccttattggtggggattttttgggaccaggccctccgtgcgttggtaccggggattcctgagatgtggctttttggaacccaaatttggattctctttctcattgtggcggtgcggcactacctgaactatcgaaaaggaggccgtggccgggatgcttccggggacaaagcgccagagcatcctatggaaccaggcgaggagggggagacttcgggttcgtccacgaaaacagaagaataaaacaagccgtgagggattgctgtgtcgaagcccctcacggcttgtttctgtatgggttggaagcaatcaacagaagctttgcttttctgctgagttgtttgatctcccactctcgccgcattgcttccgttttgctgtcaaagacctcgcagtagaccagatgtactgggcggcggggacgagtatatttcgctccagtgccggcattgtgggatgccaaacgcctctttaggttggtggtccagcctgtgtacagagtgttgtcagcgcaaagaagaatgtaagtatagttttgttccatggcttttcccttgcttcctgcgaaaaaatgttgtaaactattcaattaaggaagtaaaatcattggtttcccgggaaatccgggtgaaaatcgttgtcttttttctggactggatgggaaggaacggaggatggcggctcccaataggggaaaagaggggtatccctggaaaaccaacatagattataccgaaagggaagggacgacgcaaccgtttttgtggtcgattctttccggtgggacagcaacccgatagaagataggagaacaattttgaaaaatcactatgaaaaagaagtgaatctcacctccacttactctgaccgccggtgtgaactggggatctttcaggccgctttgcttttgcaggatgcgatgacagagctgtttcatcagtaccgctgtgatgccattcgactgtctcggacgcatcaggtggtttgggctgtggcgcggacgaaaatctgctacgacaaagaaatgctctggatggatcatatccggttaaaagtctttcctgtaaaagtatctcccatttccattcatttgaatgtcctattggagacattggacggagaaccccttctccgggcacggcaggagatgtgtgccattgacgtgcgggaccacagccttcgacgggtagacagtacgccatttcctatggacatggatttgcttcggcccgtagtcacggcgccctgccggagaatgaagctgaagctgggggaggaatgcttggtctattcttatcaggtccgtaccatggacacggatttgaaccaccatatgaataataccaattatattcgactgattctggacgcccagccatcctcgttttgggataggtatcgggtacaggaatttgatgtgcactatgtcaatgaatcggtggaaggagaggagattcaggtttactgccagacggaagcccaggaaatggctgtgcagattaagcgaggtgaaacgacactggtgaaggcgtttttgcagttagcgcagcgggaaaaatcagaatgaaacgctctattgtcctgcatggccagcaggtttcctatgaactgacgagaaaacccgtgaagtatgttaacattcgggtacgggcagacggttccgtgagcgtctcggcgggagagtgggtttccgagggacagatagaggcgattttacaggcgcgtgcattgtttctcctgcgtgctttggagaaattttcagcacaggcagaccgccgcccggcgccgttgagctatcggactggggagctgctgtatttactgggaaaacgatatgtcttagtgctggagcaaggggagaaaaatacggtctgtcaaaaggaaacacagattgtcttgacggtgaaggaaccggagaatgccgccctgcggaaaagggttatggaggctttcttgaaagccctgtgtctctcggtgacgtcttccctctgcggtgccattcagccatctatggcgcatttgggaattcctatgccggaaatccgagttcgttccatgacatcccgttgggggagctgtacgccgggcgcccggcgggttacctttgcccggcagttggtggaggcgccgctgacctgtattgaatatgtggttttccatgagctggttcattttctccatccaaaccactccagacagttttacgcctgtctggaggcctttgtgccggactggagagagcggcgacaggccctcaatgactatacgtaccgataatattttctgtctcatttcacagcacagcgtcaaacgctgtgctgttttgtttggaaaagaaaaaggaaaatttcccaggccagttgcattctgccggagaatccgctacactgaacccataggttttacaggttgcacagcggccgtgtgaagtcatatgaaattacccagagttgggaggaaccagaaatgaagcaaccctttcgagctatcattcccttgcttttcagtgtggcgctccttctgagtttgaccaccacggccagtgctgcgttttctgactttacagatgtcaaaggacactgggcagagggcaccttgcaccaggcctatgatgacggtatcctgaaaggatatgacgccaagaccatggcgcccaaccgcagtgtgaccatggtgcaggcggtgaccattctgtgccgagttctccatgtgacggggctgggggatatttcacagtttgagattccgcaggatgcttggtatgcccaagatgtggcgaaaggggtttacgctggattgctggaggaacaggatgcccaggtcctaaacgaccccattccccggggacaggcttttatcttgtttggccaggcgtttcaagtggttggcgcacagccggatttgtctgtactggaccagttccccgatactgcgtttctgacaggagaacaggcccgtgccgcagcggctttggtggaagcgggaatcgtctccggcagtgggggggcgcttcagttggaccgccctctgactcgggcggagtttgccacgattctgtatcgtttggccgatcaatatatcccagcggcagagtatgaagggcatattggaaccggatcggttctttccggagatgcggagatcgtagggagaacagtcggcgatttgtggtttgatcagtcctcttcgaatattcacttgacggatgttaccgcgtcttccgttaccattcgcgcagaccggctggaatccctgaggctggacggcacagggaaaattggacggttggtgttggccgcagggactggagacgtggcgctgacgctgccagatacctattctttggaaaccctggctgtgggcgagggaacgggcgcggtatctcttgccggaacggtctcccggctggaggtcacaggggaggcccggaccatttccattgacagttctttggacgcgctggtggtttcaggcagtggaaacaccatttctgtgaagcgtgggtgtgccattggacagattgtcattctgggcacagacaatgttctgacgctggatgggacctcggataccctcttgctggcgggacgagacaatactgtgcggggcaacggacgtgtcacagaggtccagttaaatacgcgttactacacccttaccgtgtccaaaaagcagctgattccctggacaggatatgatattaaaaacgtcgaagtggaagtggaagcccctgcgaagcttcctgccggggagtcgttgaaagcaacggcccatctgacggtacccgaagaagacctgggaaagctgtgcactggctcctggtatctcaatggggaactgatgtcccaggcgcctgtacgcctgggacagggagacccggtttccgactttctccccaactatacccatgatctcaagttagacggaacagtaaaatttgttttaagctatgaaaacaatgatggggacacctttaccaaagcggcctctgcacctgttgcactggagaccttcccggatttgggtctggctgacgcggagatcgaggtggtgctgccggaggttttggaagcaggacaggcgctgattgccacagcagaggttaatacaccggaggtgggacagtcctgcatgggctactggtatgtggacggagaggaggtggcttctggccccctgacccttggaagcggtccggcaacgctggtgtatcgctatgattattactacggtatgccggagaccagtaccgtctcttatcgtctgacatacacaacccaggatggcagagcgcaggaagtaaccggggcctctcagctgaccctggaaaatttcccggataacggcatcgcccgggcgacagccacactccaagcccctgccaagctggaggcgggaaagacactggaggtgacagcttccattcagtatccggaggcggggaaggcttgtacggggacttggtatgtggacggtgcgcaggttgctgttcagccggttttgctgggtacggataccccgaagctgtctcacaaatacaaatatactgaggatatgaagctgacctcggagatcaagtttgtcctctcctataccacagccgatggccgggcacagaaagttactgcgacaaaaaccatccagctggaaaattatgattatctgtactaccatggtctgaccgctgaagatgtgctgaagactgtcaccagtggttatgccggcaactatacattggcatgggcgcagtctcacgattataaaccagagatcaaaactgcttgggtcaatctcaagggatataagagtgatacaaaatatcttgtttgggtcaatttgacctaccagcgtgtgaatatttttgagggatcgcaagggaagtggaagctcattcgaacctgcctgtgcggctcgggcaccaatgccacgcctactatccgcggggtctttaccacctcctataagcagtcggcctgggattatggatcgtactactgtggccctattgtccggttctatggctcctctggctatgccttccactcccggctgcaatactggccgatgaattctgaccggtactacgatgcccgaattggattcccgatcagccatggatgcctgcggatgtataatgaggatatctggtggatgtacaataacattcccaatggaaccacggtggtggtctattgatggggaacgggaaccaaggaaagtcggagaaacaacgagtaaagtaagatggcggctttctatatacaaaggagaaaatggtccccccggcttacagccggggggaccattttataggtgtgttttttggttgttatctattttttgcactggtttttgtgagacaaaggtttcaaacagacgaaccagcatttcccaggtgttttgatccagaacgccggtttgcggaaggccggagtgtccctggagccagcgaaggttagctgtggtgtcctcatccaggacacctgtggagggggtagatgcgattccctccagaatttcagccaatgcacggaacatatcttggagaggacggagtaggggagaactttggccggggtggatcagttccgcaccttgggaaaaaatggtgacagtgcggggcggtgccagatgactgtaagcctgcaaaaaggcgttcatgatagcgtcccaagttcgccggtctacgataccagtcaccgggaaaccgtttatcttttgaaacatcattaccgcttccagggtttcttcgtcaaaccggccggtgggacggagaaaggggagggaacggttcacaaaggcgatggtacgcagcatctcctgcagggtactgaccggccccagggaaaaagcagggggaagtgaggtgctcatgattcgctcctttcttggtcattgtcactggcccccagttccaagggaaagccagggaactgaccgggccgggcagaaaaataggaatgaaggagctctggctcgacttctccagaagagggactttggtaagggaaaaacttggggttgctgagaacggttcggtcgatgccaatgaaccggtctataataacgtcccaagtttcctcatccaccgttcctgtctgtggcagaccggcgtctaactgaagtgcttgcactgcggcctgggtctcatctccgaagacgccgtcaatggtaaggaatgggatggtgagatagaactgtgccagaatcgagagaagatactggagaagggtgacgctttctcccctttgtccatagacaatggcttggtggtattcgaaatccaactgaaagaaggtctgcccctcgcttaccagttcagacaagcgaagaattccggtatatagatggaccatcatgtaccaggtggattttccaatgatcccatccaccgttaaattgaaaatgtgctgcagttcccgtactgcgtcttcagtggaagaagaaaaaattccgtccacctgccaaatttttggaatggcggggtaggcaacagaaatacggttgatcatgatttgagcgacctggacctctgggctgatgtctcccaggcgaaggggggcgccaggataggaatattgaatgtcttgcatgggggcgtttgtcaccaactcaatgttgtcaccgtaatagtgacgcaaaatttgtaccgaatcatatccctgctgggccatgttttcactcccccactgtgagagtccatcacagactgtggtagtgccgttgcagaaactggcagccagcggctccacaaatccctgccgtcggatatagacggtaaagagctcatccactaaggtgctgacgctgtcaaagatgtttcttcctttgatgaacttttgatcgtaagctgtggacgctgtgatattgaaagagtatccctgactgggatagaattccgtatagacgcgatttagcgcaaaagagacttgtgccagaatgttggcgcgaagggcggagttgtgccaagttgggtagacctcgctggaagctacgtttttgatgtactctcggaaggagatagtcagattttccgcgtcgctgtctggtgtacctaaatgaacggtgatataggttggaatatacggtgtgacgataattggcatagaaccgctccttcctttataggtcctgtggagagatatccactttgctggccggccggccgcctgtttccgccaaggggatcaggggcaaatcttgaatactggcgattccagggaaaatttgaacgttttgaatgagcaaaagctggtagccagggcactcgacccagatatcgcagagggaaaacggagtttcctgcccgggggattggctgttttgggcgtctggcgtctcaatgatggtggggacggtgttgccgctgcggtcactggtctgaatgttgatcagccgctgacgtccgcccggctcatgctgaagaatggagacggcggcatcttccacaggaagttggcttcggctggtgaagacacgggtcattaaagttccggaatagggcatagcaatgacctcctttctccccagtctatgcgcagggccggtccccgttgcaggtcaagggagaagattgacatttctacgaatatcccgtaaactgggacaaaaataagcagccagtcccttctgccagcgatttggtatggggcggccgacgttttggggggagacacatgttgaaggttacctttctctaccacagtgcgtttttggtggagctgtcccactgcagccttctgtttgactggtatgggggagcaatccctgcatttgaccgccataaaccactctatgtttttgccagtcatcatcatggggaccattattccccggagattttttcccttctgggaatggacaatgtctggtatgtactggccaattgcattcgcctgtccgccaaacggaaagcagccttgggtattgaggagacgcatgtacttcgggtgtctgcagggcggacattcccgttggaagaactgcggattacgacctttcgttccacagatgccggcgttgcgtttctcgttgagacggagggaaaaaccttattccacgcaggggatttgcaatggtggcattgggaagaggaaccgaaacactggaatgatgagatggaacgggagttcaaaaaggaaggcgcaaagctgatggggcggaaaatagatgtggctttcctggttttggatccccgtcaggagtcgtacttttggtggggatttgactggtggatgcgcaccatgcaggtgcagttggcctttcccatgcacagttgggagtctttttccttgacacagaagttgaaggcgcttccatgcagcgaaccgtatcgggatcgcgtgatggagattttttacaatgggcagtcgtttcttctggaggaatgaatggggaatgcttgcctttttcttgcgttgaccgtctctatatcgtataattaacctaacagtatgaaacgaaaaagagagatttttttcgtgggaggaaagaaagatgagaaagtatatcttcctggctggcacgttggcacttctgctggcaggctgcgggacctctgcgccggagcaaacagaagcgttgacttccattgcggcttatccggagaccatgcatttgacggtgggaagccatgaggggattcaagtggtactgaccccctccgatgcctcggagcaggagctggtctgggccagcagcaataaagctgtggccacggtggatgaggcaggaatggtctccgctctgtcccagggaacctgcacggtgacggttgcatccaaagcatacagcacggtctcctgccatgtggaagtcattgtgggggaggatggcacctctgatgccgctgataactctggcgatgcttcagaagaggcggaggtctcctacgtggaggagaccaatgccgctgcggtgtaccccacctattacctgtcagagcgtgaagtggcggccatggatggagagcagattcaatttattatcaaccagatctatgccaaaaacggctatgtcttccagacggggagtattcagagctactttagtcggatgccctggtatgtggcagtgtccaatgacgcatcccgcctgcagatgtcatccctggaccgcagtaatttgaatctcttggttcgttaccgggacagcggcgcgcaggaaacctcctccctgggatggatttggacccggcacgcagtggatcaggctttgacagaggattacattcggaatctgtcccgctatgatattcaactgctcatcaataccatttatgccaagaacggttatatttttgagacagacaccctccagatgatgttccagggacagccttggtaccacggttggaccagagagacggatcagttggagttctcctcgttggatcagcagaatcttcgtttactgactgcctaccgttaaagattctgaaaggagaagaaaagaatggagtatcgtattatccccatggagacctacccgcggcgggcgcactttgcctatttcagcacaatggcacagccgtatgccggtgtgaccgtttccgttgaaattacccactttttagagagcgtacaggaaaagggcagccctttcttcctctctttcctctactgcgtctcccgggcggccaatcaagttccagagcttcggcagcgaatttggaagggtgagattatagaatatcaaaactgcccaacctcccacacggtggccttgccggatgggacctactgctactgcatgttgcgcagtgaaaaaccatttcaagaatatttgccggaggcggtacaggcccaggaggcagcgaagcgccggcagagcttggaggatggaacagaggaggagtctctgcctcttttgtttgtctcctccctgccttggatcacctatgatggcattgtgcagcccacgccttctcccgccgactccaatccccggattacttgggggcgttaccgccgggagggaacacgggcctttctcccggtttcccttctctgccaccacgcattggtagacggtctgcatatggcccgcttttatcagaatttagaggcggagctggaacggtggagcggataagaaagctcccttcccaaaattacatgggaagggagctttttctgttaggagggatagggctctttgaatctccgctcgtaggcttccttgagctgatcccggaaggaagggtgggcaatggcaatgagtgcttgggccctctgacgaagggtttttccacgaagctgtgcgatgccgtattccgtgaccacatagtgggtctcaaagcgggagagggtcactgggcgtcccgcctcaaattgatcgacaattcgggaggctttcccgcccattgcggtagagggcatggcgataatggatttccctcccttggagaaggaggcaccccggacgaaatccacaaacccgcccgcaccgctgaaaattttatcggcagagatggcatctgctgcaacctgcccgatcaggtctacgctgagggcggaattgacagagaccacattgtcattttggccgatgatacggggatcgttgacatagttgacagggaaaatttgaagtttggggtttaggtgcgcatactcgtataattcatcgcggccatagaggtaggtgaccacggacacccctttgttgatctgcttccggctattgttgatgttgcctgccttgagcaggcccagtgccccgtcacagagcatttccgaatgaactcccaggtcgtttttctcccccaggaaatgaagaatggcgtcgggaatggtgccaatgcccagctgaatggcagcaccgtcctcaatcaggctggcacagtgctgtccaatgcgctcttcaatctctcccacagggagaatgggacggtggaagaggggctcatcacattctacggccaggtcaatgtcatcgatatggaccagagtgtcaccgtatgtccggggcatgtaacgattgatctgtgcgatgaccagtttggcacattcggtgatgcacttcgtatagtccaccgtcacgccataggaacagtacccccgttcatcgggaggggagagggtaattaaggctacgtcaatgggaagaaacccttcgtaaaaaaggcggggagattccccgaagagattgggtgtgtagtcagctcttccctcgttgacagcatcccggctgcccggcccggcaaagagcgagttatgccagaagtgtcccgccatctccggtcgggtgtatttgcaggggcccaaggccagcatgtgacagatttccacctgctgataggcctgatagttgtccagcatggcgttgaccagggcctggggttcccccacactgtgggccagggcaacccggtctccggagtgaatatactgcactgcctcttgggctgtgacgaattttgccataaccattctccttcctgttgtccggcggaggccccgccgcatcctcatttgcagtataacggcctgaaaggagaatgtaaaacgcggaatcttgaaaccaggtatcaagaaaattgagggcatgggctcagagaggcgcagcctgcttgatgtgatgaagaaactgccgggccgcaggtggaagggcctgcgggtttttgcaagccacaccaatctgccgggtggcaggtggagacagttcccgtttggccagacgatagggtgtgcgtttgagaaggagttccggcagaatgctgatccccagaccgcgctctaccatagccataacggcgtagtcatccttcgcggaataggtgattctgggattgcaaagggttttgcgaaagatttctcgggtctcattgtccagggagtccggacggaggatgtatggcgcctgcttcagtgcttccacagggaaggtatcttcttccggggcctggtcctcggggaaaattgccaagatacgttcctccagcaaaagggtacattcaaagtgactgttggttggcaaacggagaaaaccaaggtcgatgcggccctcgctgagccatcgctcaatatcctcgtaactgccctgaagaagctcaaacgtaatgttgggatgccgctgggaaaaggtgtgaagcaggtcaggaagaatatgcacggaaacactgaggaaggtgccgatgcgcacctgtccaatctctaagccatggaactgggcggcctgacgggtgacctcttgattttgctggcagacagcgcggatggcgggaagaagggcctctccctccggtgtaagccgcacgccgaaccggtcgcgggtcaaaagtttcagacccagctcgtcctccaatccggtaacaatgtgactgatggcggactgtgtgtaaccgaggacctcggaagccttggtaaagctgcccagatctgctgtctgcaataagacttcgtactttttaatgctcatggtgggtgcctccctgtttttttcaatcgtatccctcacgtgttgtagtatatcataaatcttgtatcctgtcctgattgggggtatgaagggttttgaaatcaagtttcaaaaaacgtagttttacaaatcctacggagcaaggatatactgactttagagattcccggcgggaaagccggaagaaaaccaaccgaacaggaggactgaccatgcagaagcaagcgatgccgcgcacatccaaggaatgggtggatgagatgctgcgggaccattaccgggatgcccggcaggccaaagaggacgggcgtctggtgtgctggagcacctccattgcgccccaggaattgctgactaccatggacattgtgaccatgtatccggaaaaccatgctgcggccattggcgcgcgccgggatacagagccctttattgcctatacggagcgcaaggggtattcttcggatttatgttcctatgctcgggtcaacctggcgtatgcggagttgcagcacagtgaggcggagaatatgcccatgccggatttcctcctgtgcaccagcaatatctgccacacggtgatcaagtggtatgaaaacttgtccaaagagcttaatattccgctgattatgtttgacacgccgtttaaccacaccgaccaggtgcaggatcacaacgccaaatatatgaagggacagttgtatcacatcattgaccagctggaggagattaccggccgaaagttcgactatgagcggctgcgtgaagtcatggagatctccaatgagacgtgttactggtggaaaaaagccacggagctggcagctgcccacccctcaccgctggatgggtttgacatctttaactacatggccatcattgttttcgcccgggggaccacccaggcgagggatctgttccatctctggcacgatgaactgcaggaaaaaatccgccttcaccagggaccttggaaggatcaggaggaaaaataccgggttctgtgggatgggattgcttgctggccctacctgcgttacacttacaaaaccttaaaaaaattgggcatcaatatggtgacctcaacttatcccaagtcctggacggtgagctatgaaaccggggatattgaaggaatggcacgggcctattccggcaatgtctatcccaaccggaatttgaactacgacgtggataatatggtgggcctggcgcggaagtttgacctggatgggatcatttttcactccaaccgcagctgtaaactgatggatttccggcagtatgaggtgcagcgccgggttttggaggcgtgcggggttccctctgtgatttttgatggagaccagacggacccgcggctgttctcggaggcccagtatgaaacccgggtgcaggcactggcagagatgatggagaccaaccgggcgaagaaaggacgtgcggcacaatgaaaactttggagatgatgattcagacactctgtcaggcaggtcgctgtccggaagaaaccattcggtccagtgtgaaagagacgggcaagcctgccgtgggctgtttccctctcttcgttccagaggagctggtctatgctgccgggttcctgccggtggggctatgggggggcatttcctctttccagaagtccaatcagtacattcagagctttgcctgctctatcatgcgggccaacctggaactggggctctctggaaaatatgatatgttgaaggctgcgctcattccgtcccagtgtgatacgctgaaatgcgtttgtgaaaactttaaggtggcggtgcccaaggtccccgtcatcggcgtcaccattcccaataaccggaccattcaggcagcccatgggcagttgctggatgagtttgactatctgtcccaggcgctggagcaggtgcagacagcggactgccgccccatgcctctggaagaggcatttgcggtctatgaggaataccgggccgttatgatggaattcattaacactgtcccagattacttaacaaccatctctcctaaagttcgtcacctgattctgaaggcagcttggttcatggataaaaaatactataccgcccagatgcgggaactgttggacgcgctgaaagcgcggcctaaggaggattttactggcaagaaatttttggtcactggtatcatgctggacgcggaaccggttctggagcttctggaggagctgggggtggcggtagtggatgaccttctctgccatgaatccatgcagttccgtacgccaacccgcgctggcggaaccgtagagtccaaactggcctatcgtttcctggacctgaagggagcctctcctctctatgagccgagaaagccccgtggagacctgctcgcgcagctggccagggagcgaggagcagatggcgtgttattctgcctgatgaagttctgcgacccggaagcttttgaccatcccttggtcaagaaagacttggcagcccagggaatccctctgctgagcatagagcacgaccaactcgtcgaatccacagagcagcttcgcaccagaatacagggatttttggaaattaatctgtcttaaagaagataaaaggagagattgcggtgtatttgggattggatattggttcctcttcgtcaaaggcagttctgctgggagaaaatcaggaatccttggcggcccaggtggtgaatttgggcacgggcaccaagggtgtggggcaggtgctggaggcagtctatcgccaggcggggattgggccagaagaggttcgttatacggtggtaacaggctatggacgtatgacttaccagggggcggatcggcaaattacggagatcagctgccacgccaaaggagtttttcacctctcctcctctgcccgaaccattgtggatgtgggcgggcaagacaccaaggtcattcgtctggggcaggatggaagcgtggagaacttcgtcatgaacgacaaatgcgccgccgggacgggccgttttttggaagtaatggcccgggtgctggactgccccattgcctccctctcccagctggcccaacagggagaggaagtggttcccatcagcaatctctgcacggtattcgctgaatcagaggtcatctcccacctctccgccggtgtgtcccaggccaatgtggcggcgggtgccatcgcatccattgccacacggatcaccgggatggctgggcgtgtcggggtggagccgcaggtggttatgacgggcggcggcgcactgaatggcgctttggtggaggccttaagcaaaagtttggggcatcccgtttgcattttggacaatcctcaggtgatgggggccttgggtgcggcagtttttgcctgggaaagcgcccaaaaacagcataattgagtagccgccgacggaagaatgctccgtcggcggccttttcattgactttgtataggcaggccggtatactgggctgtagaaacaccagagaaagggggcaatttgtgtgccacttacgattgtaaaacaggacattaccacgatgcatgtggatgtcattgtcaatgcggccaattccgctctggcccctggaggaggggtctgcggtgcgatttttgccgcagcagggtatgcggagatggcgcgtgcctgccggaagttgggaggctgtcccacaggacaggcagtgatgacagaagggtttgcactgccagcgcaggcggtgatccacacggtgggccccatttggcgcgggggagaggcgggagaggccgtgcttctgggcagctgctatcgtacctcccttactttggcggcagaggcgggctttcattccattgcctttcctctgatttccgccggtatttatggctatcccctgaagcaggcgttggagattgccgtgtcttcgatgcaggcatttctcaccgaacatgagatgcaaatctatttgacggtgctggaggagaaactgatcccactggcggagtcgtttttgcggagaaaaggggaggaagtatagcatgacagaagtggttgcggccttgatttgggaaggagaccgcttcttggcctgtcagcgcccacctgacaaggctcgaggcctgctgtgggaatttgtgggtggcaaggtggagccgggggaaaccaaagaggctgccttggtgcgggaatgtcaggaggagctgggcgtcgttgtgtcagtgggggatctgtttatggaagtcacccattcgtatcccgaccttactgtgcatctgaccttgttccatgcggtgatcgtgcagggagagccccaaaagttggagcaccaggacattcgctggatcacccgagaagagatttctcaataccccttttgtccggctgatgatgtgattttggcccgtttgcaggcaggggagaggggagcgcagaaatgattctttatttttcaggaacaggaaacagccggtacgcggcagagtttttggcccaggcattgggagaccaggcggaggatgtaggactctggatcaaggagaggcgaaagggtgaatttcgcgctgaccgtccctgggtggttgtggcccctacctacggatggcagctgccccatgtgctgatggagttcctccaaacggcggagttttccggcagtcagatggtatactttgtcatgacctgtgggggagatattggaaacgcagcccaaagcatccagtccctttgcaggagaaagggacttgcctatcagggggtgctggaggtgattatgccggagaactatattgctctcttctccgcgccggaaaaagcggaagcccaggccattttgaggaaagcactgccgaccctgaaccagggagcggtttggattgcagagggaaagccctttccggagaagcgggtaacctgtctggaccgcctgaagagcgggctggtcaatcgagtattctaccagtttgtgattcgggcgaagcctttttacagcacagaggcctgcactggctgtggccgctgtgtagagctctgccccctgaataatattcacttggcagagcggcatccccattgggggaatcgatgtacccattgtatggcttgtatctgtggatgtcccgcagaggccgtcgagtatggacgccggagccggggaaaggtgcgctattggtgtccagaagaccacagggcatgaatcagagatatatgccctatgaaaggaggaaagcagatgcggctgattatttcaccggccaagaaaatgaaggtggacaccgacagctttccttgtcacaggcttccggcgtttttgccccaaacccaggaaattttggcgcgtctgcagacgatgtcgggacaggaactgaaatccctttggaagtgcagtgacaaaattgctttgctgaaccagcagcggctggcctgcatggacctgcatcgtatgttgacaccggcgatccttgcttacgagggaattcaatatcagtacatggcacctggtgtgtttaaccaggaagaactggcctatgtggaagagcatctgcggattctgtcagggttttacggccttctgcgcccctttgatggggtgacgccttaccgtttggaaatgcaggccaaactcgccgtgtccggtgccaaggatctttacgcctattggggggataccttggccaaggccctttctcgggagacgcgggtgattgtcaacctggcatcaaaggagtacagtcgttgtatcgcggcatacttgcccccggaagtcacgatgattacttgcattttcggggaggagaaggatggaaccgtggtggagaagggaaccctctgcaaaatggcgcgcggagagatggttcgctatctggcccaggtccaagggaaaacgccggagcaaatgaaggcatttgaccgcttaggctaccaatttcgtcccgaccgatccgatgagataacctatgtattttgtaaggaggataaagccaatgttggaagttggaacgaaagcgcctgattttatactgccggaccagcacggcaatccggttcgattgtctgattttttgggacagaaggtggtcctgtacttctatcctcgggataacaccccaggttgtaccaggcaggcctgtgcgtttggggttgcctatgggcagttgcaggcgaagggcgtggttgtaattggtatcagtaaagatactgtcacctcccatgaaaaattcgcggcgaagcatgcgcttcccttcctgatcctgtctgatccagagcatcgggtgattgaggcgtatgatgtctggaaagagaagaagctctacggaaaggtcagcatgggaaccgtgcgtgccacctatatcatggatgagaacggcgttattgaagcggctatgcccaaagtaaaaccagataccaatgcatcggaaatcctggcctacctggaaaagaagaacgccgcagacattcaataaagtgtcttcttcccgtaagagggaaagacagttttatcatgatactctggtctaaaacatgaaataaccggtgagggaattctttcctcaccggttatttcatgttttcctcttgttccctgggagtaaaagcgtatttcccgcgacacagttcattgagatattcttttttgagccagattgccaaagcttctcgctgggttggtgttaggtcctctgtggaggtttgaatgccctgaacccataggtagctttcgcaccggatgtctttgtccatgctggatcacctctctgcaagtacattatgcatggagagggggattctttcctgtgttttcacataggttttgaagcagagagggggagcagtatggaaacatggcaggaagccgcatgttatatccgcgtgtccacggaggatcagacggaatattctccagaggcgcagcaccgggcgctggaacactatgccaggcagcaccagctgacgatttctccggagcatgtgtacattgacgctggcatctctggccgcagggcggaaacgcgtcccgcctttatggccatgattgcagcggcgaagaaacgtccgcctccgttttctgtgatcttggttcataagttcgaccgttttgcccggaaccgggaggacagtatcgtctataaatctatgctgcggcggcagtgcggagtgcaagttgtcagtatcacagaacacctggaagacgacaaaatgagcctgattttagaagccatgctggaggctatggcggaatattactcgattaatttaggggatgaggtgcgaaaggggatgcgggagaaagcccgccggggcgaactacagacggccccaccttttggttatggggtgaaggacaacatactccagccagttccccgggaggcttttgtggtacaggagatttaccggcgctttttagcgggggaggctatggtatccattgcccgatggacccagcagatggggatgctgacccaccgcgggaatcccctggacagccgaagcattcggtacattctttccaacccggtttacgtgggaaagctgcgttggcatggggagggagaacaagaaggcgggtcgatgctggtacagggaaagcatacgccgctgattgaggagtcggtctttcaggctgccgggattcgtttggatgcacaggtggcacgttcttcaaagcatgcccgaccttggggggagaggaaacactggctggccggtttggcccgctgtggagcctgtgggagcggtcttgttttttcgaaacctcactatctcacatgtggacgatatacgaaagggaaatgtagtgtttcacagcatattgtggcggagacgttagaggctgcggtcttatcccgtatgcgtttggatgcggcggggaaaacacggttttctgtgcaaccagtggtatctgacacccagcgccagcaggaggctctgagaatggagttagcggctctggaaaaaaagttacagcggttacgggatgcgtttctgtgcggtgcggaaggaatccaggagtataagcgggaaaaggaacgtttgacagcgcaggcaaatcatctccgacaagaattgctctcttccagccgggaggtatgtgcggcctcggagcaacatgacgagatacagaaaattgtaaccacattggaggaccctacctctggcacggaggagaaataccgggctgcccaccatgtattggaatcctgtatctggaacaaggaggagggggtggttcggctggtctatcgtcttcggctgtaatccggagaaaagtttcttgtacgcaatcgtagcctattgcactcaggtggtcctgacggggagctgggcgcctccctgcggtatctctcccagcgctacgccatgccctatccacagattcaaggcttgctgacggacatcggcacagaggagttggggcatctggaaatggtggcatccatcgtacaccagctgacccgaaatctgacggatgagcagattcaaagtgatccggcctttgcctcctattttgtggaccacaccacagggatctatcccacggcagcttctgggttcccctggacggcggcctccatcggtgtaaaaggagatcctatctgcgatttgaccgaagatatggcagcagaacagaaagccagagtaacctatgacaacattctgcggttagccaaagatgatcccgatgtcaccgatgtgattcgctttctgcgggaacgggaaattgtgcatttccagcgttttggcagcgcggtgcaaatggtgcgggaacacttggatcagaaaaacgtgtattacaccaaccctgcttttgaccaataaagagatggtggcccagcggaagaatccgctgggccaccattaaccttaggaattagtttggctcaaagaacagcgctatttttattttgtagctggtacatttcataataaatcttcccttgatgaagaagttctgtgtgagtaccactttccgccaaacgcccattctctatcactaaaatgttgttgacttggttaatcagattattaaatttatgtgcaatgataatacccatcttatcctggaataacttttggtagagctgagaaatctcataatcagaaattgcatcaagggcagaattgggttcatccaagaaaataacatctgcatctttagaaaatgttcttgcaattgcaagtttttgccactcgccaaaagaaatctgttttccttcatcgaaccaataccctaactgggtatccaaattttgtttgctgtgatcaatgatatgaccgattctaaattcattgcttaggtctcgcagttctgcatctttatccattaaatcgaggtttccatacgcgatattttcgcggaaagtcgcgtcgtacttaataaaatcttgaaacaaagacgctattcttttgctgtaatgctctttttgaatggacctcaattcgattccattgacatagatattgccctcataattatcgtataaccccataagtaattttgccaaggttgtttttccacttccgttttttcctacaattgcataactatttccttccttgaattcaaaattcacattttttaacacatagcctcctgtgtcatacttgaaagaaaggttttctaatttcagactgtgaattttatctatgatgatttttccttcatctaaagtttttgcattttccagatcaataaaactataatattgaccaatataaaggtttgactttttaatcgaagatatattttgtaaaatagattgaatatttgtctggtttgagattgcagctcttgtgtaagccaccacatctcccaataaaatcccgccgacgaaaccacagtaaataatatacgcgaagatcgctcctgtaataatttgctcaatgatactaagacttgtcattttgaccattgtttcttttgcaatggcagcatcttgttgattaaattttttatataaatcgtcatattttttgataaaataatttaataaattataagtctttagctctttgaaatgtgttccgtttgtgacaataaaactataataccatgctttccgttcttgattggttcttgccttgataatgcagaattgctttttattgattagatttgtaataagaaattttataattggcataattacaatgataagaatgatgatataattaaaatgaagaagaattacaatataagatagagatgtgatagcttgaccaatcaatgttgtaaaggatgtaaactgtgacatcagcgtcccaccgtttgcaccttcggctaatttgattttgtcataagtattactattttcataatgccacaaactcaattgactcgctttttgcatgatacaatctttgatgtgtaaattgaacttaagagaaaattttgtagtgtaataattcatgaggccacttataatggttgaggccagatcgatgcaaacatagagcacaaccagctggagaataaacgtaatgctctgaatcccttgctgaattaaattgataatttgctgcataatcaaaagagaaattgctggggccaagctttgtatgatcgttacggcagaagaaacgaagagatatcgcttgtctacctcaaacatactttttataattctgggaaaaagaatgaaaaaacgatattgatctcctgtatttttcatttctttaccgctcccttctaccgcgatatcatgcgtaaacgcatcaatcaatcataagcaatttccctgtctttgttgttctcttcagtgacagcagggtaatcgcgattccgactgagccagtcaaaatcgatagatcgttcaagtgcccctcaattagaattgatttattacgaatgtctgtaagattcaactcattctcattattttttcgataccctgcaatcattttttgtatatggcgttccaaatttgtaagtagcttgggatttctgtaagaagaataggcacacatttgaattgctaccaaactggaaaaaccgtgacacaaggatggactatataaatcatatgtctttatgttctgggagaaaaaacgtatcattgtttcaacatgtgcctgttccttctctttccaccccatatagccggcaactttttgcaaccctcgcattacgcctgcgttcccatagcaccatgaggagctaatgtgcaaattctctggtttacacgtgccgttccagtattcttcaacggtcataggtcccggccaacaaggtattttttcctcattgactacttgaaacacttcatacaaatgatagactttctcgattccatcttttagcccttctatgttgaaaccttttgcatgggcttttgccagcgcaattagtggtcccagcataccatgcgcgagcccaaagttgatatttccacgtttaaatttttcctgattaaaattagggttttgattgggctgtaaaacatgaaacttgattattgatttgccctcaaactttgtgtctcttgtaagggccactaagtactcaatacatgctttcaaaatgtgcttctcttctttggtatagtcgcagtctaagagataatatacagcccccgatatgccactaatcatgtcatggttggaatcgcaaactggagcttttttcaattgtaataattttttgtcgattgccaaaaacaagagttgattcatgctctttgcaaatttctgcaataggttgctctcctgacaaaaagcattcacagcaaagcattgagaacctaacccgccaaacatggctgttcggtgttggtatccgtagttttctatagattcctttatattctgacaaatcaagtatcctaaatctgtccacctctctttttcttttacataaggcaggatatcagcaatgaacaacagtatgctgtcataataattggggtttaaggttccattgtctctctgggaatctacataatgcaagatttcctgaacaatttctgagatatctgtctctatagatttattccaaaaaatttgttttccagtcatgatatggttccaacctttctctgtttggcgctttccaatcgctggacggatgtactgtctaacccatacaatatttttagatatttgccacttgaaaacataccatagacttaacccttggacaaatagttttatctatggtgtctctcatgctcaaaggacatcgttagaaattgcgaggcatcttaatataaacgcaattttacagacttgcagatatgtttctgaatataaaagatatgttatctgcagtgtccactacaactggtttgtaaccctccacaggtattatagcaggtatctccgcaagagcaggagtccccgcaggtataaatacttgtaaaacgcaaattttcatcctctttttgcgtctgaatgtttttaatattcagatcaaaatcattatagtttcccattttatttcctccttttctatttgtccaagagctaaatctatgatatgtaatctttaataacatatttttggctaaaaaccttctaacattgtacggcttttcaacttatattttgcttcgaaatactttggagaataaaagcggtgtgaagaaaaccatcagaattaagacgtagacaaaaatgatatgccaatattctacacccccatttggagcctccatgcttgcaaaattcatcaaactaaacattacaatagtgttatgtaaaaaatgtattattacaggcagccatacattattggtccgcatgtaagcgtatgctataaaaattccgagtgtagtagtagaaatcaaccgtcccaaaatgacttgcaccagctcgataggggatgtcatggatacccaaggtgcaaagaaaaaaatgaccattggcaggtgccaaagttcccataacacaccaaagaggagcacccccttgacgatgccaaactttttctgcaacagtggttgaaaataggaacgccagccatattcttccccaaagtggtaatggaaattatacaaaaacagaaataatatagctggttgaaacaactgtgagaagcaggttcgtaacgcgtccatcacatttcctgtcgccgtcaaaaggatcaccagcagaagggaaacacagtgcaagactacaaacaaaatcaatagacaaacagaaagtttccaatttttacttttcagtccgtaagcactgcgcgcgtcattgctttcagataaatacacgctaataaataccaaagcagtaatgatagatagaaccattccaccagtcgaaacttgctgaaacggcaagaagaaagtggtaaaacaccacaaaagagtgatccctgtcagcactaaataaccaatgaagaaattttttggcatacaacgcttgtctttatcacagagaagtttggcgaccagcagaccggctgcggggcaaaacatctgagcggatacaaaaaagtctactttctttcccatatcggtaagaatcgccatgggaattatcatgagatatggaatgccataggttaccaagaggaatattagaggttctctacattctttttgggcggaatgtgtctctgactttttcatagcaagcgctcccttttttcacaactgctaaaacattatgctgatgaaccatggaatttacagtaaaatcacataacatagaatcaactcttggacaaaaattttatctatgctttcgtctacctatgaagtgtggacttttctacgtaaggaagagaaaaatatctctttatctgcagtgtccactgcaactcgcacctactcccccacaggtgataccgcaggtatcgctgccagaacagcctccatcgcaagataacgcttcagtacaagtctttatactaagtattatagttgttgtaatagatgcggggccaatatcattttcgccttgcacttttttaatgtcaagatcaaaatcattatagtttcccattatgtatctcctttcatataatgattgtccaagagctgagtctatgatatgtaactactgtaatattccatttagctaatgttcgttaatgggattacgcttgcctttttcaataatattagataatccttctcgcataatgttgagatatttttgctctaagcttctatctcctgttaagcgattgcaaaacatgtgaatgacagaagagatgatttcttcttgatgcgctgttaattgttctgcacataatatcttatttcgataatttttgattgcatcatttctctctgtaaggagtgcaactgtctgctcacttaaatttgaatcattacaagagagtaaccattctatctttttaatataagattgctttttttcccgaaagagttttttattttctgcaagcaacggcgtcaaattcacttgcagtagcattttctcccaatgatcaaaaaaagcagttaatattgtgctgatgcccaatagataggcattttccaacccttctgtttcctcgatattaaattcatccaaaagaccaatcacaaaacggctgtcagcaaaaaacacctcctctgccgatgcaatgagttgactgcctccgtaccggttgttttctctaaaataaatatcaaattgaactttgttgataagcttccatgttcggaaatttatcaacattttctgtattgcaagcaaatgcttttgtgctgtccattcgttttcgtatttgaatctcactcttaaatgccgcccgatttcatcagagtagcggagatagaaaaatttcgggttgccaatagaacctaagcaggagacaatgtaattaagggtttcattctcccgatcgtccagctgataaagctttgcatagatccatccatcctgtaaaagcatcaaggatctgttttcattctgcagcacattccacggttcggtctctcttgtaggatatttggaaacgctgggacgaaataaggaacaactaatctctgtaatataggattttccctttatgtctacacaaatgctttcgttgaaaatatttttttctatttcagataaacgtagactgttgtttttctgaatatgtttatataaaatttccatagaatgtgctttatctaagtttaaagctaatctcctgtctccttctgataagtagacaatatcatcaatcgtgtacttgcgacgaagtttttgaaaggattcttcaaaagattcctgagaatgaagcgcaaagaaatgtaatggtaagttccacctttttggaaaaactacaacatcttccaacgaaatcctcgggagaaaaacgtaatcattttgaaatagttgaaacgctctggctatgatactggtctcttcatctgaggaaatttgcattagtagttgggatacttccgacaaggaagatggattgaccatgcagttttggcgaaccttgcaacgttttccgagccgtttggattttatataaagttgattatattgcatgcctatcagcaggtcatccaaaggaagttcttctgcgttggaattgtcatcatttgtagcaagcgcaatataatactggctttcatttctgtgattattgacattgctcatccgcccctttacacttccttctctgatctctactgtaaccagagctttatctgaacaaacaagggagcgattgttttctttgtattgatggaaaaggtctgcatccaatacacagttaaatcgattgaacatatccccggcagctccacttccaccgattggcgcaagccacaaacgatagtgttctttttctttggagacaaagaagttgatgtcaaaagattctggatacctatcttctcgacttatttccagggatgaaaaattatctatagataaattaatctcctccttctgcgcctgcagacaatccaaaatcttttcatccacaatttgtttgattttttgatctttttcatcctgagatggttgatacttttctaagtaggaaagcccgttaaagtcattttggtcgatgatagtacaaaacggtacttctacattggatccatattcttcctgaaactgccgcttaaacttttctaaccttgagggcacatcgacttgtagatatgtcaatgcttcaacaaattgttctacaatttctttcacttgataaggcaacttgttttgctgaagaaccatacccttattcacggccagaaggtctttctcatttttctggttaagcaaaccatccatcaaggtatagacagactcaatggtttttgcattcacctgatcaatctccaattcaccattcatttggttaattagtgtattaattttttgtagcgtttccttctgccgattaattccttctatgggcgccagaattttcaagacatattccaatccattttcgcagtttgctggagccctcaaattgctaagtaaaacttcattttccatgagtgcattgatcgttgaaataattttttcctctggaacaccaggatatttactttgaatgcgagattttaataaatcgtagcgaatgaacgtctgtgcctgttgtttcacataggtgatcaaaggcgtatttcgcatgtgagttctttcggtgacggtttcttctggcataagaaaaccatgatttgagtgatgcgggttctttaatcggtctccagaaacatagcaattgttgttaaatcgtaactgaagttgtggatatacggatggattattctccatctcataaataaaatgagagagccaagaataatctgctcgacattcgagaatggcttttctttcgtcgataaccagaggttctatatttggattctcacaaaactctcccaacgcagccccagcaaaaaggccgtacggcgttggtcttgtacatgctcgaattaggaatttaatgcgtgctaaatttcttgctttgctttttttggtgctactctgcaaatttcgctttttagcattgtacaattcacgactagacaacagaatacttttatccataaaatcacggaagggggtttgctgaagaaaattctccacatcattgccttcaaactgtacaaaatcagaaaacacacttgctggtaaactcggagtcctaaccataaaaatgtcattgcaagaatatctcattttataaaccaccgttctatattacactgaattttattgatatcttacaattatatactataatatataatgtattgtcaaacattattttaaaaatattgagaaaattaataaattaaatggatcaatcttgcaacctaaaatcattcttattgctttatccggcagacgatggacaacagagcaggtttcaacatcgttaaacagtaaaccagtatattggaaatagcgtagcatttccaatatactggtcaatgaaatgatgatctcttattttgatatctcaaagaggttcgattcaactattatttacacggtcacagaatctgacgtgaccgtgtaaaaataacataaaatagttttttcatttcgaattttcggttgaggatggttaggtaccttgaattgctaccttaataacgccatcccgtcggtactcaaagaggtcataagccgcctcgatctcagtcaagggaaatgtatgggtaatcaggggagtggtatccagctgccctgtctgaatcagagaaagaacttctttacaatgacaaccatctaccccacctgttttgaaagtcaaattctttccatacatctctggcaaggggagaatctgcgggcggtcatacatcgccacaatggtgacgatggcattggggcgggcgcactgccaggccagttgaaacgagtccgagctaccggcaatttccagaacaacgtctgcgccgccgtgtgcgccctcttttcgcaccacagagaccacttcttccggtgtggtggtcaaaacctgaggatattgtgtctgcacaaaggctcgacgcataggatctggctcacagacaatgattttcctgggttcttttaagagagcgcataagagagtgcaaatgccagtggggcccgcccccaagaggagcacagtgtcttctggaccgatctccgaaatgcgggtggcccaaaatcccgtggccaagaggtcacctacaaagagagcttgacggtctgttaccgtatccgggatgatggtgagaccttgatccgcataaggaacccggacatattctgcctgaccgccgtcaattcgacaccccagtgcccagccgccgttgggatcggtgcagttgttgacatatccgtgttggcagaagaaacatgtgccgcagaaggtctccacgttgaccgacacccggtcaccaggttttactgtggaaacttccgcgccgacagattccacaatgccaaccatttcgtgaccgaccgtaacgccagggatggctcgtggaactgtgccgtgcttaatatgcaggtcactggtgcaaatgctggagagggttacccggacaatcgcgtctctgtcatggcgcaggacaggtttcggcttctggataaggccgaattttccaggggagaggtacgtataagataacatgatggcgcctcctgttcatggtgttgtgttttttctgcggggcgcagtcaaaaggtagctgcgccagattaagtcctggatcatggaatcctctaaagatccatccaaaataaggctgatccaatgggttttattcatgtggtaagcaggtaccgcagcggggtaggtttgccgcaaaaaatctcctgttaggggctcgaccttcacattcatccaagtttgtcccttccgctggtaaacagcagcaaacattttttggttttcttggtgtcgtattatggtccagtttgcatcgtggaatggggtgtctggataaacggaggaatcgatgagacaggcgtggatggcttcttcccgagtcgtcatcacaattactccttctcttgtttccgtttcaaggttctcagtatctctttgtgttctgggggaattcgagtgctctccagagctttttgtatggccttgttgtgagtccattgctccaagcagtgggactgcagatagggaagtgctgcctcatactgtttggccagagcggttgcaaagtaccaggcaatcatcatgttgacatagtattcctgcctgtgtagggatgcaacccaggttaaatattcaggttgaaatgcccggtcaagatagaaggacaataacataccgattccaaaacggacggtatattcatgatcggatgcaagccattccttcactttgggaagcagctccggcaagtgtttttgaaagatctttggacgcgtgagatcgcaggtggcccaattatcgacgaagggcaggaaacggtccagttgagcgatgacccaagaaatgtcttttccgttggaaatcaagagaccatggagggtattctcatcatagtacgtatgaggcagactggccaggaaatcctcggcctctggtgtaccggacaactctttggccagactgcgaagctgaggtgttcgaaccccgatgagccgctctgggtccacggttggaagaagtttcttatgaaaatctcgataagttgggtcctgccgttgaagcagacggcccaagatgatagattcctttggatgtgacattgtgcgcctccgatagaaatgacatgatttctttgggttctgttcaattttagcggaagaaatcggaaaaagcaatacagaggtttctcggcagaaaacaaagaaacaccgtcctggtataccaggacggtgaaaggcatctggtggttaggcaatgcatgtgactcggacggcgcggagccgattgacgtttctgggatctgcctctgtgtcatacgttacctgctgacctggctggagagagcggaatcctgtgccctgtatggcggaaaaatggacaaacacatctccgcttccgtcttcgttggaaataaatccaaatcctttttcctcgttaaaccactttactgtaccatgattcatgttgagaacctcctaaaaagttttgatccgaaattcagaaaagaaaaaccaccggcagcaagtcaaaatggaagttgacttacaaccggtggtaatcaatcatacatttagaaatcttttatattatacaacagagtaaaggagaaggcaagagaatattttgaaaaagagaaaaattttcaggaaaggagcaacggtgacttttctgagtccacaaaaagaaaaaagccttgatccattgaagatcaaggcttttcttttggcggagaaggagggatttgaaccctcgcgacgctcaacacgccctactcccttagcaggggagccccttcggccacttgggtacttctccagatccgaattaattggtccatcataagaaaatggcggagagagtgggattcgaacccacggccctttcgggtcactggttttcaagaccagctccttaaaccgctcggacatctctccgtttgaaacagggcgccggttagatgcgttaattatattatcacacgaaattgggattgtcaatcctaaaaaaggaaaagtttgagagaaattttttgtttcgaaaagagccgctattcaaatttttggaggattttagaaaaaaacaacatttatggaattgaataacagagaataacagaaaatgagatggaaaatgatggaactccagtcggaaaacggatatcgatggaatagaacgtcggttacttttcgacatttctgcgtgtgcagacgccgtgaaatggtcattttccgggagaaatcagtccatttggtagaatgctgtcgaaataaggcgaacgaaagttctttgcaagagaagtttttgacattacaatataactacaaaaggttacaaaatgaaataaatttaggaggaagagtgatgagagagcttttcattggccaggtcgatctcagtaaccagatcggccggccagcgacctgtgcgtattggattttgattcggaccatccctccccctgtttgctgtgagagctacggaatccgtattctgatgatccaaacaggagagcgggaggaagtgctggacattacagtccggccggatcgaattgagtccttggctcaaattctggtcggcgggggcgtgaccccttgcacattgagggaggtggtggaagactggctataaaaaagcggtgaagaagagtgacagaagagacggtaaagacgtaaactggattagaccaattttcatgctgggaggacaggatatgtcagactttgcacgtggaatccagttttttttgggcgcaaattccgcaagtggattttcatctttatatgaccaatgggtggatcaagcgaagatgcaggccttttacaccatcaaagggggcgccggctgtggaaaatccacattgatgcgccgggtggccgatgatatggagaaagcaggctattcggtggagtacatctgttgctctggagacccagattctttggacggtgtttatttcccggagaagggggccgcattgatggacggaacatcccctcatgtgatggacccggcttatacaggagcaacaggacactatgtcgatttgggggcaggctatgaccggaccgctctgtttgccatgcgggaggaaatcgttgcggcaacacaggcatatcgagcctgctatccagaggcataccgctgtatccgtggagcggtggaaagccgacgccgcggaagcaccccccttcatacagaggagacgctggcaaaagcagagaaacgggcgtctggaatcctggcaagagagctgaaaaccacccggacacagccaggaaaacgcattccccgttttttgggcggccccacttgtctgggacgtgtgctgctggaggatacggtttctgctctgtgtgagcgagggtatgaaattcgggatgattgcgctctgtccggctttcttttacacgctttggaacggaaatttctggcgggtgggtatgatgtgatcgcctgtctctgtccagaacagcccgaccgcttagaacatttgttgattccagagaagtctctggcttttgtgaccggcccaatgaaaaagaaacaaggcttccggaccattcggacggaaagccttgtagagcaatctgcttggcaagagggcagaagcttcctgcgcctatccaaccgggtggcggaggaactcatggcagaagggatgagccatttggcccgggccaaggcctgtcacgatgtgctggaggagctctatcatccccatgttgatttttcgtatggggaagagcagacggaaaagattctggaagaggtccggtctctgccggatcagaagcgctgagtttcccttgcttccgcgtctctcttgtgctacaatgatgcaatcatttagactggaaggagggcggtggcatgaatccgctgtctatggcggagcttggaattttggactggatcgcggcccactgtcacaatagtttttgggatgcggtgatgccctttattaccggtttaggggatcaaggaatcctctggattctgttgggcgttctcattcttttcttccaaaaaggagagcgggcaaccggggcgcaagttctggtgtccctgctgtttagtctcattctctgcaacctcatgttgaaaaatgcagtggaccggattcggccctgtgacctcaacaccgcggtggagcttttggtggcccggccaggggacccgtctttcccctcgggacatacatccgcctcctttgcagcggccacagttcttctgatgaaccgctggaaaggaagatggatcactctggttgtggctgccctcatcgcgttttcccggctgtatctttacgttcattttcccactgacgtattgggcggcctgattttgggggtgttctgcggatggctggcagtcatcctctggcgaagatgggtctccccccgttggccggaatcccccacaaaaccaaaagaaaccgcaccgtaatacacggtgcggtttcttcttattttcccaaagctgcgtttttctcgcaggccgcaatgaccgcgtccatcactgcggcgcgaacagcgcgctgttctagtgtgcggaccccttggatggtactgccgccaggactgcaaacgtcgttttttaattgatcgggatgttttccagtttccaataccatttgggcggcgcctaaaagtgtttgggcggcgaagcgaaccgcatcaggccggggaaggccacaagccacaccgccgtcggccatggcatccagaatgagataggcgtaggcagggccgcagccagaaactgccgcgccaacgtccatgagagattcctccaggtggaagagctttccggcctgggacatcatgttcaaaaaaccatccatcatatccgcagtgacattggcactggtctcgtaaagaacgaccccttctctcactgccacaggtgtgtttggcatgatgcggatgacgggatacttctgtccagccatctgctggatctgggcgatggtaagccctgccgccatggagaccaggatgggggaggtttcccgagaagccagcgtggggcggattccctccagcataccgcccattaggtggggcttgacccccagaaaaagatattgactctcccgagccgcgtcttcattggtgcctgaggaaaaccccaattcagcggccaattcctgcgcccgctggggactgtggtcagctaaaataccatctttcaaggtcaggctgaccgcacgggcaattgcaccgcccatatttccgctgccgatcagtccaaatgtataccgcatgggaatcactcctattctatttttgcttttaggtgttcttttgaaaaggaaaattcgttttccgcaaagaaagaaaaaaggaaaacttttcttttattgtagcacagggcatgcgggcaaacaagagaaaggaggagggaagcgcgggaaattttctcgtcagaatgaaaaaaggtggtaagaaaaggaagggaggttttgtcttcctctccaaggttttctatggaagcgcaatggcgcttgcgcccggaagaaaggtggggtaaaatttaatcaaaacaaacaggggagggaacttagttgtgcaaacagatctacgggaaatcgcgctcctggaccgcaggggcaccaatagcgccaagtgggattcccttctggcgacctttgggcaggaggacttgctgcccctctgggtggctgacatggatttcaaggcgccaaagtgtgtgcgggatgcgctgcaccaggccgtagagcagggcgcatttggatattatcgtgtcccagacgcctattatgaaagcatcctgggttgggagaaaacccaacacggtacatgcttgcagcgggagtggattcggacaacatcgggcgttgtttccggcctttttcagctgattcaggccatcacagcgccgggtgacggtattttggtccagatcccggtatactatcccttctatcgagtgattcggaatacaggacggagggcggtgtaccatccgttgacagagcggaatgggatttacacggtagacttggaacaatttgagcagaccattgtggcacagagaccaaagctctttttgctctgttctcctcacaaccctgttggacgggtttggagggaagaggagctcagaggcatgctggcgtgctgccagcgtcatcaggtccaggtggtgtcagatgaaatccaccatgacattctcatgccgggccatcgccattgttccgccacccgtttgtggcagggggaaggaaaacccattacctttttctccgccagcaaaacctttaatttggccggtatgaaaaattctatcttagtcctcccagaggaagcacagcgggaacagtttgatgccttccaacgtaaactggggatcagtgagggaagcacactggattatgtagcggtgacagcggcatttttggggggaaaggaatggctggagatggttctccacgcgatatttcaaaatgcctgcatgctgcgggagacgctgtcacaattcccagaggtggttgtgtctcctctggagggaacttatctgatgtggattgatttggcaggtgtcgtttctcgggagacgctccacgacttcgttcagaacgcctgtcatctggctccggactacgggcactggttcttcccggaaggagagaaatcagatacccatatccggctgaatttggcagccccacagcagaccatccagcgtgcggctgaacaattggaaaccgtgctcaaacgggttctgcgcgcctgaaggcagatagaatccgaaaaaatatgatggaactcccaaagaaaggaagcgtattgtatggaaatcctgcacaccgacaaagcaccagcggcaatcgggccgtattcccaggccattgagacaggcggtctgatctttgcctccggccagctgggtttgatcccggatacgggtgccttggcacacagcatggctgcccaaaccgttcaggccctggagaatgtgatctctgtgctgaaggcggctggtctgaccctgaatcatgtggtaaagaccacctgttatctgaagagcatggaggatttctccctgttcaacgaaatttacgcacagtattttaaggaccataagccggctcgctcctgctttgccgtggcgcagcttcccaaggacgccttggtggaaattgaggtcattgcagcgcggtaaccgcacgctcaaaacggtatggcacaaagtgccataccgtttttttcataaagggagaaaggagatggtatgtgtgaagctgctccatctatctgacctgcacatcggaaagcgggtcaatgaatgctctatgctggaggatcagcgatatattttagagcagattgcacagctcgccatagagagaaaagtggacggggtattgctggcgggggatctctatgacaaaccggttccaccggcagaggctgtgatactgttagatactttttttacggcgctctctcaggcaggaatccccgtctttgccatcagcgggaatcacgactctccagagcggttgagttttggcgcgcgtcttttgaccggaaccggcatctatttgtctgcggtctatcaggggcctcaggaacctgttcttttgcgggatgcctatggagaagtggccatttatctgctgccctatttgaagccggctctcgtgcgccattctgcgccggaagcggagattgccacctaccaggatgccgtttcctacgcgctccagcaatggacagtgcccccatcgcggcgcaatgttctggtggcgcatcagtttgtcaccggggggaccaccagcgaatcagaggaacattcggtcggcgggttggaccaggtgagtggagaactgtttgatccattcgactatgttgccttgggacatctccacagagcccagagcgtaggacggccaacccttcgctactgtggtacgccgctgaagtactccttttcagagagcggacaggagaaatcggtgaccttggtaacactggaggaaaaaggacgtgtaaaaattgaggcgatccccctgtgtcccatgcgggatctgcgggaggtgcgggggacctatgaaacggttacatcccggaaattttatcagggcatgcaggtagaggattatctccatgtcatcctgaccgatgaggaagatgtaccagaggccatgggaaaactgcggactatttatcccaacctgctcaagctcagctatgacaatctccgcacccagtcaacgggagaaattttgggggcagagcggcctgaggagaagacccccctggcccttttccaggacctttatcagctgcagaacaatcagccgatgcaccaagttcaggaggaatttctaaaagcagagatggaaaaaatctgggaggaatcgttatgcggccccttgtcttgaccttgtctgcctttggtccctatgcagaggaagtcacagtggacttttcccagttgggaacccgaggcatctacttaattacaggagaaactggcgcgggaaagactacattgtttgatggcattacctttgcgctgtatggagaagccagcgggacacatcgagaaccggttatgctccgaagcagctacgcgaagggtacagtaccaacttttgtggaactgacctttcaatgcggagaaaagcagtacaccgttcgccgcaatccagaatatctccggcccgcgaaacggggagataaactggtggtggaaaaggcagatgctcagctcttgttccccgatggacaccctcctgtgacagggacgcgggaggttacaaaggcggtgaaggcgctgattgggctggaccgggcgcagtttaatcgggtggcgatgattgcccaaggggagtttctccagctcttgctggcgaaaaccgaggaacgaagcaagatttttcgggaaattttccacacggagccctatcaaaagctccaggaagcgctgcggacagaagcagcccagtggaaaagcacctatgagagcttgagtcaaaaaatacaacagcatgttgagcaggtgcagccgggaccggaatgggaggaagcctggagggaagctgtttgtttggaagacggtgagatgctttcccttttggagaaaattttgcagaaagaaaccgcggatctggaggcacttcgaaaacaagagcagacactgcaggctgaaggggaaaccctatcccgtcgtattggaaaagaggaggccgccgcccgggttcggcaggagctttcggcagcccaggcgcagttaaaatcctggatgcccacctgggagaaactgcaaagggaatgggatacggcccccgggcaggaggccgccctccagcggctgacggaggagatcgcggttcgaacagagcaactttccgcctatgtattattggaagacctggaaaaagagaggaataccgtattcgatcagatgcaaaaaggggcagcggggaaggcaaaggctgtgcaggacgccggcaatcgacagactgagcaggctgcactccggcaggaactgtctcaactggagggtttggaacagcgggaagcacttttgaaggcgcgaagacagaagctggcttcccgggaaaaagagctgggtacgctgcgtgagctgcttcaagaagagagaaggtgctcccattcccatcaagcggcactggagcaataccgcgctgcagcggagaattccacccaccttcggtgggcatatacccagctggaacgggagtttctggatggacaagctggttatttggccggtttcctgcaggagggagaacgatgccctgtttgtggctccctccatcatccttttcccgcacagcgctctgagtcggtgccaacacgtgagcaccttcaagagaagcggacggcaatggaagaagcggaaaccgcaacccagacggccagtttatcggctgggaaggcccaagcccgttgggcttccgcccggcaggaggcagagcgccaggggaaggccctgtttggtgaagtgtcgtttccaacgatttcccagcaaatgaacgctgcggcagcagaatgccaggacgaagcggcgcagctggatcagctggagatgcagctgcgccagcataggaggcgccgtgaggaaattcaaattcgcatgccaaggctggaggaagagattgccagggcccaggcgagtattctctccattgagaaggcacagtcggggctggagagcaagctggcagcgctgaatcatcagattcagaggcagaaagcgtctttggaattttccgcccggcaggaagcggaagcggcgctcacatcctgtcaacagagaaaagaggcgggggaacgcgccctgcacaggctccaggctgactacgaggcatgccgccaaacaagagaagcggcggatactcggatcaaagcattgcaagaacagcttgaagaggcccagtacgatgttctccctgatctcttagcgcaggccggggaacaccagaaaaccctgcaggaaatgcagaggcgacgggaagctctgttgacgcagcaggagagaaatcagcatgcctggaaagcgttgcgagaggctgtacggcagcgtggggaagtccaggagaaatggacctggatccgcgccctttccaacaccgccaatggcacagtgccgggaaaagacaaaatcatgctggagacctatgttcaaatgacttggtttgaccggattttggcgcgggccaaccttcggctcatggctatgaccagtgggcgatatgagcttctgcgccgacaaggggcggaaaatcagcgcagccgcagcggattggagctcaatgttctggatcactatgagggagggcagcggagtgtaaagacgctgtcaggaggagagtccttccaggcttctctggcattggcgctggggttggcggatgaaatgcaggccgcggccggtggattgcggctggatgtgctgtttgtagacgaaggctttggctccctggacgaggaagcgttggagctggccattcggactttgtccggtttggcagagaggaacaaactggtggggattatttcccatgtttccggtctgaaggcgcggattgaccgccaaattgtgattcaaaagacccgcggtggcagcagcaccgtccgcgtggaaagttaaagacgcagaacaaacgctgcggaatgcttagaaacgaaaaaaaagttgcaaaatgatacgatttatagtaaactataaaaacaatgtcagaaatgtacatacgtccactgtgggcggacatgctgacaaatttaaggaggtaaaaaaatgaagaagattcttgcacttctgctggccggctgcatggcgctggcactgtgtgcctgcggcacgccggcagagcctgccgacgaaaccggcagcggcggcgacgccaatgcgtctgccaacggtgataccgtggtgatcggcgtcttcgagcccctctccggcgacaacggtgccggcggtaagcaggaggttctgggtatgcagtatgcaaatgcagaaacccccacagtagacattggcgggaagacttacaatgtcaagctggaagtggtggataacgagtcctccaacgacaaggccgtgtccgcagccagcaatctgatctccaagaacgtgtccatcattttgggctcttacggttccggcgtttccatcgcggcttccgacaccttcgcacaggcaaagattcccgctgtgggtgtgacctgcaccaacccccagatcacggagggcaatgaccactacttccggatctgcttcctggaccccttccagggtactgtcctggccaactttgccaaggacgagctgaaggcggagaaggtgtactgcctgggccagctgggtaacgactacgaccagggcctgatgaactacttcaagcaggcagcagagaagctgggtatggagtgtgttgtggagtctttccccaaaaacaactccgacttcacctcctatctgaccaccgcgaagaatgagggtgcggacgtgatcttcgctcccacctccatcagctatgcacagctgattgtggagcaggctgccgcgcagggaattgacatgccgctgctggcctccgacacttgggactccaacgtgatcctgggcgctgcaaagggcaaggacgtgaaggtctatgtgaccacgttctacgccgagggcggcaatgcggagtttgagaagggattcaaagagtggatcaagtctgacagcaccaacctgtccaacaacggcggcaacgacattatctccgctgtctccgtgatggggtatgacgcctactacaccgcgttggaggcactgaaggccgcaggtactaccaatcctcaggatgttatggcggcactgcccggcgtgaagtacactggtatcaccggcgagatctccttcaacgaggaaggcgacgccaaccgtgacagcgcattcgtcaagacggccaatacggaaagcggtctgtgggacttcgtaaccgttcagggcattgacggcgcgcagtgattcccgtgctgtaccatttccgatacagccccaatcaatgacgtgatccaattgtggcgggggcacacggcgt

SEQ ID NO: 2225 - DNA, 104171 bp, KLE1738
tgcctgcctgcctgcctgcctgcctgcctgcctgcctgcctgcctgcctgcctgccgtgagtatattgctcgcgctcataggctgtcaaccccttttttccaattcattttaccctatttttcttcccttggcaagtccttcgtttcggcctcttccttctccacatcaatccgaaacacgttgatcacatccacatccgggcagcagaactgaaaagacccgtcaggccgggcgggcagggtgccgccgtagcgcaggatatccacatagggaaaggccacgtgcatggccatggggcagagtctgccccgctctgtgtcaaagtcaaaggtgtccccgatccggtgccctctgtggcaccccatggtccccttctggtccaccaaggtcagtcgaattttgggctttttcatggcccatcgcctcccatcctccccttgcgggggtgttctctccccatagtatattggaatccccggaaaagagatgctgccgctgcaacaaaagaggaaaaaaggcgatctcctcccggttaccctgcaaagggccgcacccggaacgtcgcgcccagctcctccgccaggcgccggcaggcttccatctcctggggggatttgtcatagtccacgatggagaccatcaccttgggcacgtactggaccgcctggcggacaaaatccagcatggcctgccagcccttctccccggcgccgggacgggtgaggcggagatactcctcccggttcgacccgttgagggagacggaaaccgcgtccaggcggcctttcagttccggggtgatgtcccggtggttgatgaggctgccgtggccgttggtgttcaggcggatgggaggcaggtcggcccgtccggcggcccggagctggtcgcagagccaaaacagatcgtccgcccggcaggtgggctccccatagccgcagaagacgatctcggtatattggcccaggtcctgggccagaatctcggccaagacagcctccttggccggttcctcctggagccacaggccccccagggcggaggcctcctggtcccggatgcagaacacgcagtgacagtcacagcggttggtcatgttaatatagagtccgccgaagtagtcataggtcacaatatccccttgcacgaaaaacacctccccaaaaatcctccggaccgctcggtccgcctgttatggaatggcaaagagcgccttgccattctccgtggtggcctgctccacttccgccggggtgagccccttgatctccgcaatggtctccgccattcggtagacatagcgggagtcgcaccgcttgccccgaaagggagtgggggccatgtagggggcgtcggtctccaccatgatccgctccaaaggcaccgccgcgatgacctccggggccttccgggcgtttttgaaggtgatggtcccggtgaaggacaggtgccagcccagcttcaccagggttttggcgtcctcggcgctgccggagtagcagtgaaagaccccacggaccccggggaattcccgcactatggccaggcagtcggcgtgggcctcccggtcgtggacgatgacgggcaggtccaggaccttggccagctggagctgggcccggaagacctccttttgcaggtcccgggggacctccttccaatagtagtccaggccgatctccccaatggccttcaccttggggtggcgggtcatctccgccacctggtccagccagtccaccggcagccccagggcgtcctccgggtggaccccggcggcggcgtagacatgggggtaggcctccgccagctggatggactggcgggaggtgtccaggtcgcaccccgggcacaggaccagccccaccccggccgcggggagggcggagagaaccgcgtcccggtccgggtcaaaggcctcggcgtagtaatgggcatgggtatcaaagagcatggctcattcctccttttccggcagctgtcccagggggtggcggccccgtccgtcgctgattttctccaattccagcacccgctccgggtcggcgtcctggaggtggaggagcttttctgccatgatccgggagaaccccgactggagaatgctctggatgatgacgttctccaccaccccctcgtcggtcacctgggggtccaggatatcctgcaccgccgcccgggtctgggccgtgtaaaagttgcccacctcctggagccgctccacatagctggtatagaagttcttgatctcctcctcgtcggcggtggaggggagcagctgctgcagcccgttgatgctgatgccctgcttgagggtaaagatcataatgagaaaggcgatgtgtacccggtaatacttccgtttttccggtgcgggcatcaccttcagccggacatagttgttgatggtggtgggggtcaccggcttgtccttggagtcctccatggggatgaaatccaggtactggcccagcagggcgatcacctggtccatgtacagaccaatgtccggcagctccttccaggcggggagcttgtagttgttcagataatgctcccaccggatgagcttgtgggcaatcagctctttgtcataaggcatggtttctctcttctttccggaccaagggcaggtccttccgttggtgtatattaagaatgtacgcggtcttggcttcttttgtaatattataacacaaaattgcaggaagaacaaccgcggtggaaagaagattgtttttgttccttgcgttgtatattatctaaacgttttctctgccaggcacactgcaccgggctatcgcttcgcttccaagccggtcaccgcttgggccagggaaagattttcccgggaaacatagatcacgtattgcctgtccaggctggcgttctggaagaaaacaccggtccgctcccgtccgccccacaggctgaaccacggggaggagcgatccttcaccttgactttataggggatgccgtgggcatccagacgccgccggaattcctcgcaccgcgccaggtcaagcaccgtggtcagttccgtctgatgaaaccaggaaaccatacttcgccctccttttccattcgatcggcataggggatcaaaccaagaaccacagcattggtgcgcagtccaaggaacccgtgggccatatcatcccctctgtgttattctcgtccttctttctttaatttatcaaatcgttccgttaaaatcaacaatttatatcataatatacacaaatattttgacgttttctatgtgcttctcccgaaaggcgccgcctctgcaccaaacaaaagcacctgccgccgcaggtgcttttgtcatgtgatgtcattccgttggttccagtttggcttcctcatctttgttctgggcatacagagccgccttactttgcagaacacaggcagcgtatctgcagaccgccacgccgctccagaggaagaaagcagcaaggagcaaatcatccatctcatccatgaggaagatcagcgccgtccccacggagcccaccatgcttacccgcgcaacggccatcagcacagccaccgtgcaggggatcgcagcgatcagaagcaggatggacaataaccttgcaccgccgccggccatagactgttttatccccaattaggtgtaaaactctgctcgatggcgggcggcggcgtacaaaaaatctatatggtgtttttaagagaaccgtcccggcaggacaggtcaggcagtgacctgttccacctccgggatgggtttaagattaaaatgaatttcgatagaaatgtgtcttgttttatcttcgtcaatgcgctcatgcacgacgatttctttgattaagcggttaagggtggctgcgtccagctctgtgatgttggcgtattcctgaatggcttccacccattgttttgcgtcattggcaagctggacttcatcggacagccgctttctgccctctgacactctggttttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcccgctgctctgcttcacaggtattggtcaggcggtcggcaaccgcttccccgtccatcagggcagctctggcacattcccggattttccgcagcacatggctgtaaagggtgtcatagtcaatccgatgctgggtgcagtggttctttccaaaggcattgtaggtcttgcaggagtaaatctgctgaggatgttttgcgtttgtgtagcgtatcgtcagcgacttcccacactcgccgcattttatcagtccggcaaacaggctgatttcattggtctgccccggacgctggcgggatttcagcttattctgcacaatatcaaagctcatgcgatcaatcagcggttcatgctgtccctccactacaatccagtcctccggcttcttttccccaatcgtgccgattttgaaacggtagtcttttttctgggaagcaatcgccccggtgtagacgggattcatcaaaaggtctttgataacggagaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgttcagggcatatccgaaaatcagtcgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcaatatcgttgttatcccgcagggtgtcgataccgtcattcatggcgatatagcggacaccgtttcttgggaaaaagtcctcaatcaaatgcccggtttgcagatagttacgccccagtcggctgaggtctttcgtgatgacaaggttgatttgcctgcgctcaatggctctcaacattctctgtaaatcaggacgctccatattaagacctgtgaaaccatcgtcctgatagactgccacaacctcccatccctgcttttcgcagtatttttccagcatatcacgctggtttgcgatactggcactttcgccttgcaggtcatcgtcctttgacagcctgcaatagaccgctgcacgatagcccccggcaagtgcctttccgattgttctgtattccatttcgttcatcatagccatttacccacacaatccagacggtatctggctcttttgaacctcatcttcattatacttcaaatctttctttttggcaagatattctttcgtatttgtctttccgtatttctgggaaatcaggctgacgaacacatcagtggcgtccagctccccgtcaaatacagtggtcacatgaatctctgttttgttttttgccataggcagttatcctccatacatgaaaatagccagacagagggtatcggcaacgaagtccggcaacgggcttcaaaagaccttgcaaacaatctcaatctggcgatggttactatttatacttttcttttatttttctgttgttttggttgttataagggagaaaagcccggaaataagggtttttccccggcaaccggctcggcaacgggatagcaacagggggtgcaacgggctgtcattttcagaatggaagctccatctgttctgtgacctccacaaaaccgtccatcgttttttcagacgggttgccggagtccgttgccgggttttcacgctcccagcccttttgtctgccatattctgaaaacattcttgggtttgggaagtaccgccagcggtcaatgcactggttcataatctcgttgatttcccggatttcccattgcttcggctcgtcaaaagcatggttcaaggcttccttatagagctgcttggagcagaccatgttcccggtgtacttatcaagatacgcctgtatcatcccggctttggtgtcctctggcataaaatcccgctggtgttctttgagataccgctgcatggcagggctgaaagccagcttgaacctgccacttcggtaaatctccatcgcttctgcccacatctgctcgatataggctctggaagcagcttcgtcctccaaaatgtgaacctcggcttgctccgggtacaccatgacggggataaagcggcggttgccggaacggtcaaggggcaggaagtcaagggcattggaagtgccgccaaacacgcactgacgggggcggtctgccgggtgtgtttcataaggtatcttgtaaacctctttctgccggcttaaaaacgacttgatttcctcaatgctcttggcgttggcggttgccatcatttccgacatttcgataatccagtgaccttgcagcttgcggtacacattgtcatcgtccagcttccgcaaatcatcggagaaccactcgtcccggactgccagcagacggaagaaggtggacttgccagccccctgaccgcctaccagacagagcatgatttcaaacttacaccccggctgaaaggctcgtgagattgcacccagcaggaacagcttcaacgcttcataggtgtaatcgtctgcgtcagcccccagaaagtgccgcagacagaaacggattcgttctgtcccgtcccacacaagggcacttaggtagtcccggatgggatggtacttgttttcattcgccacaatcccgatggcgttatcaatctttttctcattggtaagcccgtaggtttcttccagatagagaagcagatacttcatgtccgtatcgttcagggcggtgctttctctgtggaagccgatgggctttatgatgtccttgcggtcggtcaggatgttgtatgcgatagccccggaaagcagcgggtcacgctggaatacggtcaggcagttccgtatgctctgacggacaccgcctttctcggtggtttccagccccgccttgatttcctcaatgctctggggcggttgcatggcgttcatggtgttttttagttcttgctgcgtctgcggctgcaagctctgccattcgctgttcaagctgtatcacatcctttccgtagtccgtaatcaaagccgctttttcctctgtttccccgaacagcagcacatccagcagatattccacttgatcttgcttctgtaaggcttctataaaccggggatgaaaggcttcctccggggagtgcggggcataatcctttctccatgcccggagcaggtggcgatagtcggcaagaatacggaagcagcggttttttgcttcctgaaactgttcctccggggatttctgccggggcttgggcttttttgcctttcccggcggtttccagtcctcataggaaagcccgaagtcctgtgccagctgtacggcggcttctttctttcccagcccatacagggcggcggcaaaatcaatcacatctccatctgcaccgcagccgaagcagtggtaacgccgatccagcttcatgcttggggttttatcgttatggaacgggcagcaagccatcccgttccgacctacatggattccataatgctccgcagcctgtcttgttgtgacggactgcttcacggcttcaaatacattcaaatctatccctccttgaaaacaaaaaagcacctgacattctctgattgaaaatggcaagtgcctgttaaagttccatatcctgttgtttgtgtttcgtctgtgccgggacagttctttgtgcttttttctcgtcagccttatcctgcaagacttccttgataggctgcttcttgggcggctctttgctttcttctgtgccgggtgtagctttccgtacccagtagcggatgtcccgcaacttcttcaaatcagcctgtacctcggtcaaaggttctttcagctctgcgatttcgctgagaagtttttcctgctcctcttgcagctcattttgggtactgtccttatcgtccgggtgcttggcaaggtaggcggcggctttcgcataccgggcaacctccgggtgttcctgtttgaatttctcctttgttttcttaaaaaatatcttctggtacttctcatagacaggcttacattccttgcagtctgtccgggcagaaagcagtccgtcaatcactttgctgcgggcttcctttggcttcatctgattgcggtaatctgcggctgatttcccggaagattccagaaatgcttctaagtcctccacagtggaaagccccttttgccggagataggacagggcttcgctgactgcctttaagtcctgtgaagtcccccggttctgtccagcccttgtccagtccttccgttcttcctttcgtatctccatatacttcatcagcagattgggaagaagtgtcgcttcctccgccgctttttgtgcaagcagctctttccgtttttctcccagctcggtaatccagcctttgaggttttggataagctgccggatggacttcatcagactgttggcggctctgatttcccggttcaggtttccgatattcgtctggataccacgcttttccatctgccggacagcagccccctcatggacagtggggacaatatcaagcccctgtctggcataggaacgcaagtccacacgctccggacggtcattggcttccagatagcggttctggatgacctcccattcatgccgccagatttcgcaatacttctggtcgttccaatccaccgtatcctccttgtggcttttccatctgccggacggaagttttatccgttccccgttttcgtcaaggacataaaccttgcggctcttgggaagccattttccatgttcgtccattgccctcatagtgagcatgacatgggcgtggggattgtgtcccggcggatgggggtcatggattgcaaaatcagcaatcatgcctttggaaacaaactgctgctcacaaaactcccggacaaggacagcatactggtcgggtggtatctctcttggaatggtaagcacccaccgccttgcaagctgggagttccattgcttttccaccgcttcggcggcgttccataaggtattgcggtctgcatacgaccgtggggcgtttgccgggagcagaatttcattgtggacaataccacgcttttccgggtagtgcttcacttgctggtcgtattcacagaacagcttttcgccgctttggtaagcagcggcggcaaccgcagactgtcgctggctgcgctgaacaatcgtgatttcgttgtgtgggcagggcatttcgtgtccctcctttcggtaattggtggatggggtggcgttttaccacctcattttggcagaaaaaaagcaggagacctttttcagatttcctgctcggtgtgccgctgtgaaggcggcggatatttagctgtaaaagttcgggacaagttgacccgatgtgtgggtggcaaacttgaattttacgattttttgtttttcaaaaagtcaatagttcttttcacgataaatacgatacatatcaaacctacaatcccacaaacaatagagtcctttaagtctgcaaatcctcctgtgtactgcattgcataataataaaccgtccatatcagtatcaatacgaacacactaatacttaaccaataagactttttcttcatctaattttcctcacattgaacttccgattagtcgttgacttcattatactttattcgaccgtcaaagtatagagagcttttgtaaaacttgtcggctgggaacaacttgcaacgcaaggtgtccccagatggcaagtccacaaaagggtagctggcagcagccagcgcaggggaagcgtagcgtcccctgtatgatttggagcagaccatgactgcggaaaatcacagccctccggcgaggagccttcggagaacgcaatgcaccaacctttgggtggtgtataattgcgcccttagtaaactaagggttttccggcttctcccgttccagcagttttttcaatagttcctgcgtgtcctgcctgtgaaaaatgagtttcaacaacagcatgacatcatcatttgtcaggcgttccggctcttgcagaaaactttccagcataccgccacgggtacagagccggtgcgtccgttcctttcgggtaagctgtttcaactggtgctgcaatgccttttcatcattgatagctttccgcagtttcttttcgcttttctccagctcccggttgagcttttccagctttgaggtatcaggcaagggcagcgtcctcctttcccggtatcagcacataaatcctgtttggttctccaacgccctgacgcacccgcatgataagtccggcggtttccagttcattcagagaacgcttgaccgtcatggggctgcgggacaggactgcggcaatggctgtgacaggaaagcagacaaacaggattccgttctcgtcctcctgccctttggatagcatagcgtccaacatccggcagtacatgacctttgcggtgctgctgactggaaatcctgtcaacgctctgggaaatggcatacagggtggcaatggtgtgtctatcgtcataaattcaaaattcattcggtgtgttcctcctttttctttgctcgtttggataaataacgggggcagtcaaccacaaccgcccggaagctctgcctgcactcatgctggcatttccggcataattcgttgtaagtgacacgcccccggtcgttgaggtaaaaagaaagctcatgcttcctctttttgctcattctcggcatattgcgcttcctcccgtttttagtgtatggtttcggggcgattttcggcaaaattacggtcatagagccgcttaaaatctcccgaagtatacagcgatagggtagactatcccctatcagattgtcgtgtttcggtatcatttcggtgtcagttcgccagttctccccggtgtcgttcctcccctgaatctcacagcggcgtatcgctccctttggtacgctcgttttggtcaggattcctccacatccctgccaaaagtcatggcactacatcgccggggaagcatatcccacacaggctggtcattcgattggaataatccatcgatgaactacctgtatcatagaacatttttgtaccctgtgccgtatgtccacaaagtaggaattaagggtaaaaatcagaaatttccacgattgcggaattgatatggtataatcaattcaacggttataaatgttgtcagaagggggaactgcttcaatgaacggagctactacaatacaggaacggctaaaagatttacgattaaacaaaggattaaaactggaagaactggcagagcaaacaggtatttcaaaatcagctcttggaagttatgaaaaagatgactataaggaaatcaatcatggcaaccttatcctgctggcagatttttatggggtgtccctcgattatctcttttgccggacagagaacatggtggagatcaacacgccattaagggaactgcatttgagtgatgaaatggtggcacttctgaaaagcggaaggattaacaaccgtctgctgtgcgaacttgccacccataaggactttatcaagtttcttgcggatattgagatttatgtggacgggattgctaccatgcaaatccaaaacctcaatgcccttgttgataccgtccggcatgaaatcattgaacggtatcgccctggcgaagacgacccccatttgaaagtgctgcaagccgcccatatcagtgatgatgaatatttcagccacatggttctggatgacctcaacctcattatccgggatattcgggaagctcacaaaaaagacagcgaaagtgctccccagaccaccgttgccgatgaactgaaagaaaatctggaagcggtcgaaaatttcaagggcagccgtttggaaaaactggcaatgctttactgcaagcaactcggtatcaactacaaaaatttatcggaagaagaatttcgctggctgattcggattctccaaaaatcaaagaaaatgggaacacctatcagccagaggaaaaaacggtaacaaaaaaccgctgttgcatggttgtgttggcttccatgtagcagcggtttgtgctgtggttattcagttgaaattttgaagtggtaagttgtatattataatttcatattaccatggaaaaacaaagtaaaataccaaagcactaattaccgaagcgattagaaaaagcttcttactttttgcttttttatagaacatgaaaagaaaaattagcactcctattacatccatcaataactgaaataggaatgtatgatgccctaaaaagtaaataaaaattacaattgcttctgcggctaaagcacctactggcagagaatataatatagaattaaaaatatgttctttattccagtaatataagataaacgctgctattgcacaagggattgaacaaatagtaaatatcataaatagtgaagtacgaaaaccaccagaaaataaaggtatgaatgttcctaatattgcttgtaatccatagaaactcaatgtcattccaaacatatataaaaacgaactaatccctgcacaaatgtttgaagtacttgctaaaacaatgatggtattggtaataatccaaaatcccaatagtgtttgaattgacgaaaaactccataatgtatcagctgggcaataatctgtaagcctgcaaatacatccgactaaaataccaaccaaaaaaattgttatataggatttcatactatgggttaaggttttgttcataaatttcctctccttcagctttcagtttgtaattgtcattctgacataccgtttatgaataaaccatctcatgcaaaataatttcttctgcccggttgtgaatgttattgcaacgctgcacccattccatttgagaagtacgcttcaattcctcagtcacgccctcggcagctttcatctgctccatgatggtgtctaaccgttcctgtgcctgttcgttcaggtctgcaaggtatgtccataacttcccggtcagtgtcaatgtgttcaatctggctgggtggacttctcttaaatattcccggtgcatccgtccgtactttccgatagggcggtgttcctccggcagcttcaaatctgggatataataatccccaacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatattcgttgtcataccggcggcaagccttaaatcctctttcctcatatcacgctctaacagtgtgtgccagagtggtttatagctgatgtgcatattgttttcctgcctttctatccataccaccggggcggctgccccggcaggaacttttctcttattatagcaccaatcttgtgtaatcacaatttattcttgtagactgccgctgataccgtctggattgtgcttttcctttctttttgttccctttaattagccatgaacaggttggtggccgtgggattctcttcatacgtctgaaaccagcctcgccctttctttacaatctttatcatcatagaatagacctcttatcgcagtggatgaaatcagtcatagatggaatccacatcctgggacaggatggcaccatttacggcgttgatttcaaactcatactccaacattccaaccacgatcttcacctcatattcggcccgaccgtcatcccagtccagtttcactctgcggacattattctccgtcgcgccaggcacctgagccagggcaatgcgcttggcctctgcctcgccgatataggagccggaattttggttgccgttgccagtgccgggtctgtaatgctccgcatcatagtcaaagctgagcaccttgcccgtgtaggcgtcgatctcatagtcatactctctgtaatccttggtgtagaactctacatcatagacctggcggccattttcccagtccagatgggcgcggacgaaagagacctgactgctctggagacccgcatgggccagcgctttttgcttggcctgttcggcggtgatcatcccagtgggggtgctgggctggttgttgttaccgttattgctgccgttattaccgccgttgttgttcccgttgttgttcccgttgttgtcctcaaagctatccgcatcggtcaccagagagcctccgctcagtgtaacggtacgggttgcgttgttccagttcacctctttgtccatcagttctccaatgctccgcaccggcagatagaccgagccgctgtaaagcagggggtatacggtatcgccgttggcgtcagcgaaggtctgacggacattgtccaccagaatggtaatgtccggccggatggcagcctgaaccgtctgtgccttggctgcagaatccggggttcccgtcactgagccattgggccggtctcccgccagagaaaccgtcagcgtggactggctccagttcacatttttacccatcagctccccaatggcccggatgggcaggtaggtggtgcccccataaaggatggggtggacttcctggccaaccgcgttgtagaaggtccggtaggacccatccaccacgatggacagatcgggggagagatacgcggtgacatccttcccctgggcagcggctgtggcggacaggagcccggtggaaagcaccgcacacagggcgatggctcccattcgttttgcaagcatgtgctttttcatagttcaatcctcctaatgattctttcggtttctaccatagatttctattccggggtagggggactccccggctttaacggtggctgtcaacctcccagctgcggatggcgccgctgtacccgtcaatgctgaactcatattccacgccgttgtaatagatggtcccttcatactccagacgtccgtcgtcccggtccacctcaaactcatagatgtctttcgtcgtggcgccggggacctccgccaaggcaatttccttggcccggtccgcagagatggtctgggtcccggcatccgctgagggggcgtagccctctgcgtcatagtcgtaagagagcacctctcccgtggtggcgtcaatctcgtagtcatactctttgtagtcgctggtgtagaactccacgtcgtagacctggcggccgtcctcccagtccaggcggctccggacaaaggtgacctgatcctcggtcaggccggcgtggttcagggcaatctccttggccttcccctcccccaccgctgcggtttcggtgccggacgcatccgcaccaccgccggttccgccgttctgggtgccgctgatcaccacaccggtgaccgcgtcaatgtcgtaggcatagtttttgccgtcggcggtgaatgttacctgatagtaatctgtaccattccggttctccaggtccgcagacgcaaaggtggctgcgccctccgcgatgccggcggcgtccagggcaatcgctttggccgcgtccgccccaatataactggcctgggtacgctgctggccgcagcctgtcagcaccaggccaagcaccgcagcaacccaaagcatccataccaattttcgtttcatcttaaaacctccttcttcattctggcgttatcttaccatggaaacatgaaaggaacatgaaattttgcccgacaaaccctctttttttcggcctatctctccgctggaaggtggagggtaaaagaactcccctgaccgggcacgctctccaggctcatgtgtccgccgtgggcctgggcaatcttccagaccatagacaggcccagaccggcgccgctcttctctccccgaacggggtccacctggtaaaaccgctgccacacccgtgcctgctggtccggggcaatgccaatcccgtcgtcccgcacggtgagcagtgcctccccgccctggcggcgaagggtcacccagaccccaccccccggctttccatatttgaacccattgtcaatgagattttgcagcagccgggcaatcagcgcccggtctacctgggcaaagacaggctcccctccctccaaggtcaggcgatcctggggccaggggccctcggcacacacctcccgggccagggcggccagatccacccgttcccgccgagccagttccgtcccctggtccaggcgggtgatccggaggagctggtcgatgagctgggacatcttgtccgcttgccggtggatcatggccagggtctcccgctgctcctccagggtctccccataggtttccccatactcacaggcgctcttgatcacggatacgggggtccgcagctcatgggaggcgtcggcggtgaactgggtctcggcctcgaaggactgctccagccgggcaaacatctggttgaaggtggcagccagccggctgaactcgttgccgcctggaggcaccgccacccgggcggacagatcggaggcctggctgatggcgtcggcggtggcggtgatgtgttccaggggccggaaggcccgtcgggcgatccagtacccccccactgcggccagcagaaggaacagggggagggacaccgcggccacccacagcagggcgggcatgctctgggcccctgccggcacctccagcaggccccggacccacaggccctcctcccagccagcgggcacccagaagtccaggacatagtattgcccggtgtcggtgtctaccagtcgggtcaagccgttgtgaaagggctccgccgcggtaaaggccaccggcacctgcccggccagcagggttttgtcctggctgtacaccagggtatagactccattctcatagaactggaacccctcccccatctggggccgcccgtccacaagggtcacctgccccaggttctcccgcaccgtctggtccagctgctccatggcgctttgggtgtacacagaaccgctgatcagccggagaaagaccagcatcaggccggccatcagacccatcagcagcagataccagagggtaatcttgaccttgacgctgcgctttctcaccgggtccctcctttcggggccgcaggctcccggatggcccagcccatcccccgcacggtgtggatcagtttttcctcccgccccccgtcgatctttttccgcaggcggctgaggtagacatccacgttgttggagctgccagcgtagtcatagttccaaatctggtcctcaatctgctcccgggagaggactttttccttgttccggaccagatactccagaatggaaaactccttgggcagcaggggaatctcctctccgccccggacagcctgccgccgctcggtgtccagggtcaggtcccccacggtaaaccggttggtgcgctggcccacccgcttgcgggtcatggcccggatacgggccagcagctcggcaaagtcaaagggtttgaccagatagtcgtccccgcccaggtccagccccttgacccggtcggccacactgtcccgggcggtgagaaagagtaccggggtgtcgttcccctggtcccgcagttcccgcaccagggtgtatccgtcctttttgggcagcatcacatccagcagaatcccatcgtatgccgcgcccagcaggtgagcctgggcgtcctcgccgtccaggcacccgtccacggtgtagcccgccttggtgagcaccttgcagagcagcagattcaggtcggcctcgtcctccaccaccaagatccgcatgggccgtcgcctccttcttgttgaaaatcaggcttatcataccatatctctcccctccgcgccactcccaggctgccgccaaacacaaaaaggagagcacagagaagatctccgtgctctcctttttacgtttccgccgggggaaattttttgcagaaccaccgggcccccacccagatcaagcccaggcagaccacccacccctgaagccagaggaggaaaaaaacgaaattgtcataggtggcatcctgcaatataaacagcagctgataggggttggggaggagggcccccggcagcccatccccaatgccccagagcaacagaaaggtcgccattatggacagaatccctcctgccggaccataggttcggaacagggagaccgccagggccagcgccaccaggccgaggaaccatcccagcacccccatggagagcagccattccacgcccgaggcaaacaggtcccaggcagggtccaagacaaaccaaagggtccacaagatccaaagcacctggagccacatagattgcaaaagaggcgtcatcttttctgatttcataaagcacgtcctccctgaaaacgcagtccacaccggtcaatcacgaaacgtctgtcccatgcgttctctttcttttccaacgggccagactgcgaatgacaaagcccaggctgatccccaccacgccggagagatacagagaggccggcggaaggccaaacagccccagcaggccaaaaagccacagggcaagcaccgcaccaaacaggagaaagagaagcagccgccgttcccttcgatccgcatagactattgcgccaaagaacgcgatagaaaggcccaaccggatgatccaatgcatcctatcccctcctttcttctccgcttgcgtcgattctttcctttcatgctcatcataccttcatcgcactgaagaatcaacaaaaaagtctctttctctggggcgcttcccttcgtgtagaacgtacctttctattctcaagaacgaaaggaacccatactttgtgacaccccattgaaaaaattttttctccttgtgtcctgcggacacttatgaaatataataagtaatctcttccttgtggagttccagaagattgctcatatattcctccaccgcatccagtgcctcctgaggcgtattaagccggtcataggtgagaccatgggattgacagtattcctccgcaatcgcctctttcagtttcccctttgccaacactctgggcgcttgatcgcgcaaattttccacatattcttcgtaggttatccccgcgctggcacaataggcatcgatcccttccttcccctctggcatggcatacgccgcatagacggtctcttgaaggtactgctccacttcttcttcggttggcatcagccccctctgttccgcctcttcctgtaagatgacattctttaagatatcatccacgatctctcgatcactgctccctgtcccctctggctttccggccaaggcttcttgcgccttcctttgatattctacgacagatttcatcaccgttttttctttgtagacagccatcacaacatccgtttcagagttctcttggtctacggccttctcataatagcttccaagttcagattctaccggtttttcttctgtaccatacgcagagattccagcaatcgcaaggatgactattccgacgaacaaaacacaaaatttcttcatttttatttctcctggatataacctaaatttacgtaagtactttctcaccacctccaatcccggggaaattttcccctctactccttccatgtcgcaccgacagcaaatttttgcgccaaccgaaaacttttttcaaattttttgtctcgtcaacctctccggcccctcccccttcaaaaaaattccccgaaacctcaaaatccccgtgcgttttccggtggaatgtggtaagatgaaaagaagctatgcgcgggagtgggttccctcccgccgtttcaccgaagggagtcctttttcatgcggaaatctgtcatcctgcccggcgtggccgtggccggcggcctggtcggtctgttggttcggcgggtttatctggcccatgggtttgaggcgggcaccggcctgcccatctccggcgcccccagtctgtgggccatggtccttgtctcggcggcggtggcggccgcgctgctggttctgagccggggcaagcaccgcaagttcgaccagtgctacaccggcgctttctcgccggacaccacccctctgctctccggcgccctggccggggcggttctcctggccatcggcggctttttggccctggccgcctgggccggcagcccccgtaccctgctgggacagcggacgatgagcattgcctgggccgggctgggggttctcagcctgctggccgccgccggcatctactttgtcgcccagaaaatgcgccggggcgcccccattctcaccgcctgggccgtggtccccggctttgcctgctgcctgtggatcatggccaactactaccagagctgggcggaggagcccgtgctgggtcagtacctgatccccatgctgggggccctgctgtccatgatcgcctgtttcctggtgggtggcttcgccttcggcaaggcccgggtgaccctcaccctgacggtgtgcctggccgccggcgcctttaatatcatggccctggccgacggtttgcccctggcggacaccgccctctatctgggcatgatgttctacctgctgtccatggccgccgccctggccagaaacgacgccaagccagaggccccgccggcctgcgcccccaactgcgccggctgcccgggctgcgcccccatggggacccagggcggccagccccccgccggcacggacggccataccccggatcagccccagtgacaccaaggaaaacaacacgccctccctgggcgtatggaggttcacccaatatggaaagagatcagaagaaaaagttttatattaccacccccatctactatccctcggacaagctccacatcggccacacctactgcaccgtggccactgacgccatggcgcggtacaagcgtctccagggctacgacgtcatgttcctcacaggcacggacgagcatggccagaagattgaggacaaggccagccaggccggcgtcaccccccagcagtttgtggacaacatcgtcaccggggagaagggcgtgctggacctgtggcggctcatgaacatctccaatgaccggttcatccgcaccaccgacgactaccatgtggccgccatccagaaaattttcaaaaagatgtatgaaaaaggggacatctacaagggcaagtacgtgggcaagtactgcaagccctgcgagtccttctggaccgagagccagctggtggacgggaagtgtcccgactgcggccgggaggttcaggacgcagaggaggaggcctacttcttccgcctgtccaaatatgcccagcccgtccaggaccttctggaaaacaccgacttcctccagccccgttcccgggtccacgagatggtaaacaacttcatcaagcccggcctggaggacctgtgcgtctcccggacctccttttcctggggggtgccggtggattttgaccccggccacgtggtctatgtgtgggtggacgccctgttcaactacaccaccgccctggggctgtacaacgacaagtacgacgactacgaccgctactggcccgcggactatcactttgtgggcaaggagatcgtccgattccactccatcatctggccagctatgctcatgagcatggagatgcccctgcccaagcacgtctttggccacgggtggctcctgctggacgggggcaagatgtccaagtccaagggcaatgtggtggacccctatgtgctggcggagaagttcggggtggattccctgcggttcttcctgatgcggaccttccccttcggttccgacgggaacttctccaatgaactgctcatcaacaccatcaacgtggacctggccaacgacctgggcaacctggtcagccggaccaccgccatggtgcagaagtacttcggcggcactctgcccgccggctgcaaagcctgggacgcccccgaggcctatgacaccgagctcatcaccctggccgccggcctgcggggccgctatgaggaggccatggaggcctgtgcccctcacaaagccctggaggaggtctttaaggtcatccagcgggccaacaagtacatcgacgagtccatgccctgggccctggccaaggacatggcggccaacggcgcccgcctggcccacgtgctgtacaacctcctggaggccacccgcatctgcggcatcctcctgtcccccttcatccccgcctcctgtgaaaagctctttgcccagatcggcgcctgtgacggctgccgcacctgggactctgccgcccagtggggcagccgggcagagaccgcagcggtgaccaagggggagaacctcttcccccgggtggacatggacaaggccctggctgagctggaggccatccaggccgctgccgccgccccccagcagcccgccgtggagctggagccctgggaggacccggtggactttgacacctttgcccagtccgatttccgggtggtgaaggtgaaggcctgcgaggcggtgaagaagtccaagaaactgctgaagttcaccctggacgacggttccggcaccgaccggcagatcctctccggcatcgccatgtactacaagccggaggacctggtgggcaagaccctggtggccatcgtgaacctgcccccccggaagatgatggggcaggagagtcagggcatgctcctgtccgcggtccacaaggaaaatggggaagaggtcctgcatctgctgatgctggacgacggaatccccgccggcgcgaagctgtgctgatagttgtttctccggcggtctggttgagccagaccgccggttttttgtaaaatccaccaacttatcctctgttcttttgtaacttcctccaaatcgaaaatttttctgaaaaatttgtcacaaaacggctctctgaaacgttatttatatagaaggcaaagtgaagcctcctactttttctctctctaacccccaaacacccccgccccgccggcgtatgccggtggggcgggggtgtttggactgtttgacgtggctttgccccatggaaaaaaggacgtgttccgctgcggcacgtcctttttttcgttctctctaccattttccttttattttttctttttctgaaagaaattcccttcctcacgggatagtaacagtgaacgggtacccgaacccaaaggaggtgatctcttgcccagagaacatgaggactgggtccgtcagctgtatctgacccacgccccggacctgtaccgggcggcaaggtaccggctccaggacccggagctggcctacgacctgacccaggaggtctttttgaccctgctggacaagcaggcccaggtcaagcaccaccccaaccctgccgggtggctttggaaaacccttcagtacaagctggggcacgccttttctcgccaggcggtccgggccaaatacgaggccgggcaggccgacccggattggctgcctgccccgctccccgccaccggcggcaccctggacgagattcttccccgacagctgccggaacgggaccgccaactgctgaaaatggcctacgaggagggcctgacctacgaggaaatcagccggcgtctgggcattcccccggccacctgcggcacctggctctaccgggcccggcagcggtgcaaacattacttaaccctttcggaaggagggaaccctgttgaaaaaacatgatattcttttccaagcccaggaggaggcattcatccaagccttagaagaggaaatggcccgggagactccggacccaaacgccatccgggccattctggaccagctggaccggcaaacgggcggggcagcctttgaccccgacgcgggctggcgtgagctccagacccgccggccggccaaacggcgccggctgggccgttaccccgtggttttggccgctgttctggtgtgcctggcggtggcggggacggcgctggcggtgaatctggggctccatgagaagctggccgcctatttccatcttcagagcggggaaagcgcccttttggaaagcgccattgagaaccccgtaaccaccgtttccgaccaaggaatctccgtcacgattcgccagaccctggcaaacagttccgggctttatgtcctctatgaggtgacaacaccggagtcaatcgctttagaccccgaaaaaaattggcatatggaggggttcctggacctgtcttctctccccttgcaagcgccacttggcagcagtatctttggcaacgatattgtagaagtaacgcctcataaaataaccgccgtggcttacgcctacacgccggttggcacaatgtcttcggggacagtccaccttcgtcttacgcgccttggatattgggagttctcttcttctcctcagtttatccccatcgctgagggcacctggcacctgacttggcatctgactcatattgatccaagcattacagtaaccccgccagcccttcccctgccggatgggagcggcaacattgagagcatttccctatcccccttctcctgcgtggtcatcagcaccggtgcgccggcctctgattggccggtctccctggttcttcaaaacggaagcacgttgcccctggatgcctccaacggtcagtacaccaccggcaggctatccgccagcggccaggagaatccgcaatactactcgtactttcagttccaccctctgatctccccctctgatattacggcactggtaattggtggaacaagggtttccctgggagcgagttaagtaagcagctctatcgcacacgttttacgaaggggggtgatggttctatgaagaaaattttgcatgaaaggagaggattatcctattttccccatttccctatcaacaatgtctaaatttggaggtaatcatgcgttttctgaaaaattcatttgcagctgtcctgataatttgcacactcgcctcttgctctatcgcttttgccgccacaccatcctctgagaattccctcggcatgagtccccaagcccaagaaaactttagcaaagcgccctataaagtacaggaagaaatcctctcttctccggaattgtccgcagctgccccatatgcctatatggacctctattcagctccagaatccttacagcatgatatcttagccgccagggatcttatcatccatagtcagtcttggaccacagatcccaatgactacactgtctatccagatggttcaatcgaacatgatcctctcttctctgatctgttcccagggtgggatctccccacgcttgagaattccatccttgaaaccccctctttctccatctcccagccactggcattgacaaaggccattgcaccgtccgttgcaaaaattccaaattactacattcctaagtataacgcttcccgccccacaccggtaatgattaagcttcggtctaccacagtcgaaacattcgctgtgattgttgactctcttcccggggcaacatgcaacataggaattgccaatgcaaatggtgtcgagctaaagaacaaactacgggtccctgtccatggtgagtgccatattttccctgacaagggtcagtattattctgcccgcgttagtacctatgacaagcccgggtctggttctttccgagttctctattaaaaacttctttcaaaacaaccggatgcgctactcttgtagcgcatccggttgttttacatgataacagagcccccattccctgttcctcagcatttccccgccacaatctcccgcacctggttcaaattgcggacctcataccggatcacagggcggtccgggcggggcaggcccttggggttgtaccagcagcaggggatacccgcccggctgccgccctccatgtcgctggtcagggagtccccgatgaggagcagttcctcccggtcataggggccgatggcctccagcaccgggcggaaaaagtccaggctgggcttctccgcccccaccacctccgagataaacaccccgtcaaagaggtcccccaggccggagcgggccagcttccgctcctgggctgtgcgggtgccgttggtaaccgcgtactgcttgacccggccccgcaggtcccgcaccaggtcatagctctggtccaggaagaccaccgtgtcccccaggtgacactggtaggcggcgttgacctggtcgtagtcggtgcaggcaatgccctcccgctggaaaaactcctgaaaccggccgggaagcagctgggctttggtaatctctccccgctccagccggcgccagtagctggcgttcagggcggcgtaccgttccacccgatcctcggggcaggggcccaggcggaactgggcgaaggtctcctgcagggcccggcgctccgccgccgggaagtccagcagggtgttatccacatcccacaacaagacacgaatcataaggggcctccttctccacatctctcccgagacaccgccccggaaggttttaatggatgctatcttacacccgattcgacccaaagcgcaacccttttcccacaaaaaagcccggccgcagggaatccccgcggccgggcgcctggtttggctctattgggggagatactccgccgggcactcctccaccgtcacgccggtgtagtagtgctggagaatctccacatagcccttcccctcctcggccatggcgtcggcgccgtactggctcatccccacgccgtggccaaagccggtgacggaaaaggtaaaggtatccccggacagagacacgtcaaaggacgccgagcgcagggagaagatctgccgggcctgggccccggagacggtcaccccgccgatggtgatggcgtggacgctcccgctctgggtgcgctcgatggtccccacccagctggcggggtcgccctccaggctggccgtgggctgggctttcaggaaggcgtccttgaattcctgggtggtgagggtcacttggctctcatagttgggcacgccctccccctcgggggagtccacactctggagatagggcacgctgttgccccagacctccaccgcgtcctgggtggccgcgctggaggaggagtggaagaccgcgtcgatgagctgcccctggtagagaatgacctggttgcccgtctccgccacggcggtggtgattttattggtgtactccgccgccttgtccccccagttgccctgggccttgtcccgggcaatccaggcctggcagcaggcatagtcggtgcacagatccgcgtcgggatggttgaaggaagggcccttgttcagggcataggtacgggcggccaccgcctgggccttcagggcctcctgggagaaggaggcgggcatctccgccgccacaaccccccataagtactggtttaagtccatctccgtcacctgaccatcgctccccttcacccggagggtgtggccgctgtcggggagggcagcctcctcctgggccgtgggctgggggtcctggccggtgtcctgggcctgccgcaccacaaagggcagggcgaacagaaccaccaccaggatgagggcaaccccaatgatctttttcatctgccatctcctccttccagagcttacacggatggaatcaggtcttggggggcagactgagatagaccccgccctcctggggaacctccccccgcagggcaaacagttcctccaccgtgacaaaatagtacccctgggccatcagccggtccacacaggccagggccgctgtgacagaggtctcaaaaatatcgtgcatcaggatgatgtctccgtcctccgcctgctgggtaacggtctggacaatccgctccacattctggtccttccagtcctcggtgtccaccgaccagcagacaatgggcgtcttggcccattgcttcagggtctcatccacaaagccgtagggcggccggagcatcagctcctccgggcccaccaccgcctggatggtctgctgggttttgcccagctgggccgcaatctcctcccgggtcatcccctgcagggacacatggtgccaggtgtgcaggccaatctgatggccctcatccgccatccggcggacggtgtcctggtggtcggccacctgctctcccaccaggaaaaaggtggccttgaccccccgctgggccaggccgtccagcagggcctccgtggtcttgggccaggggccgtcgtcaaaggtcagggccagatatcccttgggcggcagagccgccgccgtctgtccggccggcagggccggcacgtccggcaaagagacaaaccacgcggacaccgccagaccaagggccagagcccaggcgccccacaaaatacgccgccgttttttccaatccacagaatccccctctttcccacggtcgcatacccaaaggataccctggcgtgggggaaactttcccggaacttcctgacaaaaaggggcgcccggcggcgggcccacgggaagtcctttcagtatagcctgtgatcccggcccccgtcaaggcaaaacataggaaagttttctccctttcccatggtttctgtccccggggccacagggcggccccgggcaaatcaaatcgccgtggttgtttccaaccacggcgattctctcttgaacagctgcttttgccgtacttgttcaggggatgcgggggaaggtgagggccgccttgaacaggtccccgtcgatggtcagggagaaggtcccgtgctgcagctgggtcaggctccgggcgatggacaggcccaggccgctgccctcggtgttccgggacgcatccccccggacaaaccgctccatcagctcgtcggcggagatattcagcggggtggcggagatgttgcggaaggtgatggtcacctggttctctcccgcctcacaggtgaggtagacccgggtccccggctgggcgtacttgtgaatgttgctcagcaggttctcaaacacccgccacagcagccgcccgtcggcggaaatggccgggttctccggggcgggggtgaggatcaggtccatccccttggccgccaatttttcctggtattccccggcgctctgggtgagcaggacattgacatcggtgcgctggaagtccaccgtcaggttccccgtggaggctttggaggcctccaccaggtcctcggtgagctttttcagccgggcggactggcggtccagaacctccaggtattcccgggcctggtcgttgggcatcgcctgctttttcagcaggtccacatagctgacgatggaggtcaggggggttttgatgtcgtgggagacgttggtgatgagctcggtcttcatccgctccgacttcatctgctcctccaccgcgtgctggatgccctggcggatgttgttcaggttttccccgtgctcccggaagggcccccgcaggtgctctgtggacactttgtagtccagatggccggcggccagctggcggccccccgcctggagggtccgcatggagaggaccacgaagagcaccagtcccccctccagcaccttcagcagcagccagagcaccacccagccgccgccgtaatagcagcccatcaggcacaggccctccaggaagcacagcaggaggaagcccagaccggcggcccagaacaggggcagctttcccagcagctcccccgtccgccgccccaaggccttgccccagcggcggaccggccggatcaggcgggggaagaacaggttctccctcccaattccccctcgccgccggcggaccagggagagggccatggccagcacaacccccatcagcaccatggtcagtaccgtgggcccaaaggccaccagggaggtgccccagccgctggagcagaccaccggcagaagcccaaacagcagaactgccgcccccgccgcgatcagcaggtccgtggggatggcccggtccatccagcggagggaaacctcctccgagccctcctggcgcagccccgccgaccagagcaggaatcccaagctgagcaggcccagcaccaggcccaggatggcccccgccaaaaattcataccggtagaagcccatattctccgcgtattggatgccctgatagacctgtccggtgggggagagctccgaccggagaaagcccgtcaaaaccaccgtctctttgcccaccgtgcgggcaacatccgcggtgaggcggtatccttcctcatcttctaccaaagacacattttgaagctcctcatatgtgctgcccaactggtccaaggcaaggtcccgggcctcataggagtcgtaatactggtcaatatgactccattggaccgtgccccccacctgcatggaccaggaggttttctcccggtagtcgcccagggtgtcgctggccagaagggtgtttccctccaggtccttgatggtaaagaagaagttctcatcctccacatatctcttgacatccaggctctggtccccgtcccgatagctccggtagccatcggccagctgattggtcaggttttccacccagacggcttcctcctcctccaccagctgccgggtgccctcccactgatagccaccgtggtatgccagccaccgcacgtttcccaagcagatcacactcacagtcatggccagcacgaacagcccgcaggcaagccccttggcccagggtttcgtacggtattttttcatagtttgcccccttccatcttgtacccctgtccccagaccaccttgatgtaccgggggtccgaggggttgatctccagtttttcccgaagatgacggatatggacggccaccgcgttctccaccccgaagggctcctccccccacacggtccggtagatccgcttgggggagaagacggtgccggggttctgcatgagcagccggaggatctcatactcccgaggggtgagggaaaccggctccccatccagggtgacctccttggtccggtcgtccagggccaccccgcccagacgcagggccgtgggccgcaccgtgccaccccccagctggagatagcggcgcagctgggacttcacccgggccagaacctccaccgggttaaaaggctttgtaacatagtcgtccgcccccacattcaggcccagaatcttgtccgtgtcctcagacttggcggtgagcaggatcaccggcacattggacttctcccgcagccgggtcatggtggcaatgccgtccagctggggcatcataatgtccagcaggaccaggtgaatgtcctccttctccagcagggccagggcttcggtgccgtcataggcggggaagacctggtagccgctggtggtgaggtagatggtcagtgcggacacaatgtccttttcgtcgtcacagactaagatgttgtacatacccgtcgcctcctgagagtatcatagagaaagaagccttaagaaacaaggaggggaatgtttaagattttcttaagctgttcccataaaaaaacctccccggagggagagtggggggatgcccgccgggcaggggggtggggggctttttccattgccgttggaacgggcggggaacttggccctcccgggcggggccctatttctttggagaaataggggaaagaacaccaaggggaaggaggttccttccccttggaaccccattctctggtgggaaaaacgggggaaggtggttggtcagattggagcctggcctgcggcctccaggaccaacgcctcatggcccgcccaccggctcgggcgggcgggagaagtggtttgttgacgggaggaaaaagtgggaaatcgaaagggttttctctcccttctcccaaagggcacctgcccacgcccccagcccgcccagccggtggacgggccgttaccagcgttccaatgagagggccgcaggccaggtaacaagtgagaagtacagcctccccctccacaaccccaccagagaagggggtcccgggggaggaacctcctcccccgggggttctttcccccatttcttcccaagaaatggggccccggctgggcaagccaaagttcctgcccgttccaacggcgtggagagaaaacccacaacgcctctcagccgcctaccccatactcccgggccagcgcccggaacttcggcagcgcccgctgaatctgctctgtgggcacacagtaggaaatccgcacatgccccgggcagccaaagctgtccccggagaccagaatcaggtcatacttccgggcccgctcacaaaaggccgccgcatcgggctccagggaccgggggaagaggtagaaggccccctccggctgggcgcaggtgtatcccatggaccgcagcgcatccaggaagaggtcccggttgcgccggtacaccgccatgtccgccgtctgaccggcacaccgggccaccaccagctggaagaggctgggggcgcagacatagcccagggcccgtcccgccccgcagatggccgcgtataccaggtccgcctcctccgcctggggggggaccagcacatagccgatccgctgccccggcagggagagggacttgctgtaagagtagcacaccaaggtgttgtcatagaaatccggcacccagggcaggggagcggtctggtagacgatctcccgatagggctcgtcggagatcagccagatgggatggccgtaggcccgggatttctcccccaacatctgggccagccgccggatggtctcttgggaatagaccacgccagtgggattgttggggctgttgatgatgacccccttcacctggggggagagggcggcctccagggcggcaaagtcaatctgaaagtcctccagccgggccggcaccgccaccagctgggccccggcgctctccacaaagaccttatactccgggaaatagggcgcaaaggtgaggaactgatcccctgggcagcccagggcggacagggcgcagcagagggcccccgccgccccggcggtgagatagaagtggtccgccgtgtagcctgtgccgtaccggcggttgaggtcgtccgccagggcctggcggacagaggcctctccctgggccggggtgtagccgtggagctttaccgggtccaccgtgtccatgagctgatgaaccagttccttgacggtatccggggcgggcacactgggatttccgatggaaaaatcatccacctgctccggccccaccgccgcggcccgggcctgggcaaaggcaaaggcctcccggatttctgacttggcggtgcccagggccaccattcgttgggataaattgatcatatcgtatggaacctcccgtcttggggtagaataatcgatgtggttgcagtatatcacaaatcccgccgggaaacaatggcgatccagccccagagggatcgagaaatggtttttccgccccccgcctccagcagagagtttccccatgaggtcccctctcaaaaattagcactctcaatacaagagtgctaacatttacaatttagacacattttcctcgaaatttattcataaaatcgcagtagtatatccagcgtagacgggaggttcccgggaacacctgggaaagcagcaagcactcccgtcaagagattgcaaattttatgaaaacccgtcggcccggtttcggccggtgtccgacccgaatagatcatctaaaaaggagcgtttcatgatgtttggtatgattccctttgaccgtcgcgacgacaacttgtttgacctgtttgacaactttgagaaaaagttcttcggcaacaccaacgccagcctgcccgccttccgcaccgacattcgggaccagggcgacaaattcctgctggaggcggagttgcccggcttccagaaggaggacatctccctggagctgaaggaaggcatcctgaccatcaaagccgagcacaaagaaaaccaggaccagaaggatgacaagggcaactacatccgccgggagcggcggtatggttccttctcccggaccttcgatgtcagcggcattgacgagaacgccattaccgctgtgtacaacaacgggattctggagctgaccctgcccaagctggcaccggtggtgccgcagagccggcagatcgccattggttaagacacagactctctcatttcctcctctctctttcgtaacctctgaggcagggcgccggtgatgtcgccggcgccctttgccatgaggaacttcttattccattctcttccaccacccctgaaaggagtgactttttatgaacgcagaaaaactaacccaaaaatccgccgaagccatccgctcggcccaggaaattgccctggaatacggcaatccccagattgagcaggtccacctgctctgggccctgctgcaggacagcgaggggcttattccccagctgctggccgggatgggggtgacggtaccctctcttcaggccgcggtgaaagacctgctggcgcgtcagccccgggtctccaattcgggccatgaggcgggaaaaatctacatctctggtgacacggaaaaggccctgaaccgggcggaaaaagtggctggagagatgaaagacgaatatacctccgtggagcacctcttcctggggctcctggacaccgccgggcgggagctggcccagctcttctcccagtaccagatcacccgggagcgggccctccaggccctgtccggggtacggggaaaccaacgggtgacctcggataaccccgaggagacctacggcgccctgaaaaagtacggctccgacctggtggagcgggcccggcagaacaagctggacccggtgatcggccgggacgacgagatccgcaacgtcatccgcatcctctcccggaaatccaaaaacaatcccgttctcatcggggagcccggcgtgggtaaaaccgccattgccgagggcctggcccagcggatcgtcaagggagatgtccccgcctccctgaaggacaagaccatcttcgccctggacatgggctcattggtggccggggccaagtaccggggagagtttgaggagcggctgaaggccgtgctcaatgaggtgaaaaaatccgaggggggcattatcctcttcatcgacgagctccacaccatcgtgggggccggcaagaccgaaggggccatggacgccggcaacctgttaaagcccatgctggcccggggagagctccactgcatcggcgccaccaccctcaacgagtaccggcagtacattgaaaaggacgccgccctggagcggcggttccagccggtgatggtgagcgaaccctctgtggaggacaccattgccatccttcgaggtttgaaagagcggtatgaggtcttccacggggtgaaaatccaggacggcgccatcatcgccgcggccaccctgtccaaccggtatatcaccgaccggttcctcccggacaaggccatcgacctcatcgacgaggcctgcgccctcatccgcacggagattgactccatgcccaccgagctggatgtgatccagcggaagatcatccagcacgagatcgaagaggccgccctgaaaaaggagaccgaccgtctgtcccaggaacatctggcggaaatccagaaggaactgtcggacatgcgggaggaattcaaggccaagaaagcccagtgggacaacgaaaaagaggccatcggcaaggtccagcagctgcgggccgacctggaaagcgccaacgccgagctggaaaaggcccagcgggagtacgacctgaacaaggccgccgagctccagtacggcaagatccccgctttgaaaaaggccctggaggccgaggagcagattgccgccgacggcaaggcccgctccctgctccgggacaaggtcaccgaggaggagatcgcccggatcatcgagcgctggaccggcatccccgtggccaagctcatggaaggggagcgggaaaagctcctccacctggaggacatcctccaccagcgggtggtgggccaggacgaggcggtacgcctggtctccgaggccatcctccgcagccgggcgggcatcgccgaccccgacaagcccatcggctccttcctcttcctggggcccaccggcgtgggcaagaccgagctggccaaaaccctggccgaggccctgtttgactccgagcgcaacctggtgcggatcgacatgtcggagtacatggagaaattctccgtctcccggctcatcggagcgccccccggctacgtgggctatgaggaggggggacagctcaccgaggcggtgcggcgcaaaccctactccgtggtcctctttgacgaggtggagaaggcccaccccgacgtgttcaacatcctcctccaggtcctggacgacggtcggatcaccgacagccaggggcggacggtggactttaagaacaccatcctcatcctcacctccaacctggggtcccagtacctgttggagggcatcaacgcacagggggagatctccgacgaggccaaactccaggtggaccagctgctgaagaaatccttccggccggagttcctcaaccgcctggatgagatcgtctgctacaagcccctgaccaaggagaacatcaccgccattgtggacctgctcatcggcggcctgaacaagcgcctggccgacaagcagctgaaggtggttctcacccccgccgccaagagctatgtcatcgacaacggttacgatcccctctacggggcccggcccctgcgccggttcctccagcacacagtggagaccctggtgggccggaagatgatcgccgacgaggtggccccgggaagcaccctcaccgtggactgcgtggccggagagctggtggtccactgagacggccccagcccctgtctgcacaccgccacgccgcaggcaaagatttctgcccgcggcgtggtctttttttacccttccgcctggccctgggtgagagcctgaaccgcaaactggagaaaggccttcaccgccggggcggcgcggggcagggagggaacagccacccccaatgtgagctgctggggcgggtccagcgggaggatggccaccttccccggccaacttttggtgatgagttcattcataatgctcatccccagatcattctgaatcatggccagggctgagactgtgtccagggtggtaaaggcaattttcggctccagaccgtgggtctccagcaggcccagaacatcgtcgtcccggcccagggcgggcatgatgaagtcctcctgggcacactgggccaggggataggacccccggtccgccagagggtggccgggcgggagcaccgccaccatccggtcctccgccaggggaatccagtcgtagggcatgggggccttgtggctgaaaaaggccaggtcggcggccttgtcctccagccattggatgatctcctggcggatgccctccatgagcttaatttggatgtgagggtaccgggcccgaaaccggcggatgacctggggcagccagtgggtggccacgctggaataggtggcgatggtgacgctgcccaccagcaggccgctcatctccccggccagctgatagatccggttctcctgctggagaaactcccgcaccgccggcagcaggcggcggccgttctccgtgagggtgaccccctttcgattccgccccagcagagggaggcccagctcccgctccagggaggtcaccagctggctcacccctgagggggtatagcccagcacctcgcccgccttggaaaaactgccggtctccgcggcggtgacaaaggctttgcagcgggcactctccatggttcccatccccctttcagtttcacttaaaggaacttctacaattcttagttttactttataatacccagccgctatccttatgtcaagggaagcaatccagccgccttctcccatccccttgggacaggggcctcattctcttcgctttgaccccggtagagcccccctttgctctgccggggccattttttctccgggattgaccttccccgcgccagcctgtatactgacccaaggaacccattgagaaaggaacgaacccctatgaccttcaccatttcccctgccatcaaacagtgctggccggaaaccgccctgggcctgcttctctatcaggttcaggtggcccccagctccccccagctgctggcccagttcgaccagaccgtggccagcctggcccagcagtataccttggacaccatcgccaagcacccccacatcgccgccacccgccaggcctacaaggccctgggggcctccccccacgaacaccggaacgcggcggaggccatgctccggcgggtggtgaagcaggcgggcctctaccacatcaacaatgtggtggaggtgaacaacctgatctccatctcctccggctacgccatcggctcctatgacctggaccagctccagggccaggtggtcctggcctgtcccccggcaggggcccggtacgagggcattggcaaggggagtctctccatcgcccacatgcccgtgctcaccgacgacctgggccccttcggcaaccccagcagcgacagccgccgggcgatgatccagcccggcctccgccgggtggcctccgtcctgtacgcctttgacggtgccgaggggctggtcccctggatgcaggcctttgaggaggcgctgcggacccactgcggcgtctcctccgtgacccagcagcggattgaatagcaaaaaacaccccccggacccacggccaagcgccggggttccggggggtgtctgcatgttgtctatcggttgtcgtagcggacctccagatgctcaatgagccgggccacgcagctctcatcgcaggaggggaggaccacatccgccgcggcccgaacctccggataactgttggcgggggcaaaggagagggcggagaccgccagcatggggatgtcgttgagcccgttgcccacgcagtagatatcctccggccggacccccaggtggcgggccacccacagcacggacaggcccttattggccccccgggcggtgacctccagcagataggggttggagaaggtgacatcgtaggtctcaggccactgggtttgcaggtaggttcgggcctggtggagcaccgccgtgtccgggtgctggaggatgaccttgatccaggggaccggcatctcctcaatggccttgggccggccggtgaggtggcaccgggtcaggtggcgctgggtgacctcgttggggcggaaaatatagacctcgtcctgatgataggcctcaaaccccacctggggaaaggccgcgcagacctgggccaggtggacgggcgcttgggcgggaaggtatttcagccacaggctctcctccgtggcaaagtcatagatggaggccccgttggacaggatcaccggggtattcaccggcaggcgctcccgctccatttgaatggcaaagttgatgtaggaccggccggtggagatgcagaacaggcccccttccgccacaaagcgggcaatggcctggcggttttcctgggaaatggtacagtcactgctgtacagggtgtcgtcataatccgtggccagcagaacgccggaaaactttcccatgggggctcctcccttcggtctttttttgaatagccgttttattttatactaaccggctgcatcttgtcaagacagtctgaaagtaggccggcaggggagaggagagggtcatccgctccccggtgcggggatgctgaaaggagagccggcgggcgtggagacactggccggccagctcagggaaccccttccgcaggccgttgtacaccgggtcccccaacaccggatggccctgggccgccatgtggacccggatctggtgggtccgtccggtctccagccggcactggacatgggtgtagcccgggtagcgggccagcaccgtccagtgggtcaccgcggggcggccgctggaatggttcaccgccatctttttccggtccgtggggtggcgggcaatgggcaggctgatggtgccctggtcctcccgcaggttgcccaaaaccaccgcctcatattcccggtagaggctgtggtcctggagctgctgggccagggccaggtgggccccgtcatttttggccgcgatgagcaggccgctggtgtcccggtcaatccggtggacgatccccggccgaagctggccattgatgccggacaggctctggccgcagtgaaagagcagcgcgttgaccaaggtgccgtcggggtggccgggggcggggtggaccaccatgcccacaggcttattgaccacgatcacgtcctcatcctcatagaccacctccagggggatgtcctggggcaggagctccactggggtggggtcgggaatgcacacggcgacctggtcccccggcttcagccggtcattctttttcaggggccggccctggcagaggacatggccctcctccaggagtttttgggccgcggagcgggtgagcccgtccaggcgggccgccaggaactggtccgcccgctggccggcggtctccacagacagggtgacgttcatggggtctcctccttgtccggttccttctttccctcccggccgaaaaacacaatcaggtgcaggcacaggagaaccccgcccagaaccacccccacgtccgccacgttaaacaccgcgaagttcacaaaggtggtggcaaacatgtcggtgacaaagccgaagagcaggcggtcaatgaagttccccacggccccgcccagcagaagggccagggccagcatccccgaccagtgggggaggactcttttccccaggcagatcaccagaaccacggacaccaccccggacaggagggtgagcagccaggtgtgctggctgaacagggaaaaggccgcgccggtgttctgcacataggtcaggtccagaccggggaggaagtccaccgccgtgtggaggggaatcccggcgcggaccagatattttaccacctgatctacggccaccagggcggcggccagcaggaaataaaggggcatgcaagcgccctcctttcttggtcagaggaaccggtggccggcccggaggccggccacgagtacaatgcactttttgacggaaaacgagcgttggcgtgccatcctcccgggcggctcacaccaggggggtcagcaccttggcgcagcgggggcacaggccctccccgttcaccgtgggcagtaccttccagcaccgctggcacttgtccccggcggcgttttccacggtggcctggatcgcctggcccaccgtcacctccacctgggagacgatgagcaggtcggccaggtccgcctggtccatctccgccaggaaggcgtcctcggcagggacggtgaggacaatcttggcctccaggctcttgccgatcttcttctccgcccgggcggtctccagggcgccgttgaccacgtcccggacctggatgatcttctcccaccgggccatctcctcctggggcagggcatatgccgtgaagggctggttcatgtcgttgaagaccacgttccggccgtccgccccttcgggatgggtcatggactgccaaatctcatccccggtgaagcacagcaccggggccatgatcttggtcatggtgtccagaatgaaatacagcgccgtctgggccgagcgccgggccaggccgtccttctcctcgcagtacagccggtccttgatgatatccaggtagaagttagacagctccaccacgcagaaatcgttcaccgcgtgggtgaccacgttaaagtcaaagtcgtcatagccctggaagcacttctcaatgaggacattcaggcgggtgacagcccagcggtccaggggcagcatgtcggcgggggccaccagatggttggggtcaaagccgttcaggttgcccaggcagtaccgggcggtgttgcggaacttcaggtagttctggctcagctgcttgaaaatcttctccgagcagcgcatatccgcgtggtagtcggcggaggccgcccacaggcggatcaggtccgcgccgtacttgttcataatatcataggggtccaccccgttgcccagggacttgtgcatggccttgccttccccgtccacggtccagccgtgggtgatgcaggtcttgaagggggcctgggccaccccggtggagcccacggcggtgagcaaagcggcctggaaccagccccggtactggtccagcccctccatgtacacgtcggcgggccagaacccctggtccttcttcatggaggccaggtgggtggagccggagtcgaaccacccgtccagggtgtcctcctccttggtaaagcccgacgccttgccgcagtgggggcaggtgaagccggcggggaggatctccgcggcgtccttggcaaaccaggcgttggagccctcggcggcaaagaggtcggagatgatcccgatggtctcgtctgtggcaatgggcttgccgcagtcgttgcagtaaaagaccgggatgggcaggccccaccggcgctgccgggagatgcaccagtcggcacgctcccgcaccatggccttcatccggtccaggccccaggcggggacccagcggacctggtcacaggcggcgcaggcctcgtccttaaaggtctccaccgagcagaaccactggggggtggcccggaagatgatgggattcttgcaccgccagcagtgggggtaggagtggacaatgtcctcggcggcaaacagcgccccggaggccttcatatccgccaggatgatggggttggactcctcggtcttcagccccgcgtacttgccggcgtaatcggtgtggcggccctggtcgtccacaggcaccaccatgtccatcccgtaccgcttgcaggtctggtagtcgtcggcgccgaagccgggagcggtgtggacgcagccggtaccggagtccatggtgacatagtccgccagcaccagacgggaggtcttgggcaggaaggggtggtcggccagcatattctcaaagaaggacccgggatgggtggccagaacggtgtagccctccacgccgccgacctccatcacctttttcaccagggcctcggccaggatgtagatctccccgttggggttccgcaccagggcatagctctcctccgggtgcagggcgatggccaggttgccggggagggtccagatggtggtggtccagatcacaaaggagaccttgctcttgtcatacccgtccagcttccccaggtcgtcgtggagggggaacttcacatacaccgtggtgcaggggtcgtcctggtactcgatctcggcctccgccagagcggtctcgtcgtgggggcaccagtagacgggcttgaggcccttgtagatatacccccgcttgtacatctccccaaagaccttcacctcttccgcctcaaaggaggggttcatggtcaggtaggggtgttcccagtctccaatggcgcccaggcgctggaagccctcgctctggacctccacatagtgctgggcaaattcgtggcaggccgagcggaactccgtgacgggcatctttttgcggttgagcttgttctgcttgatgatggcggactcaatgggcatgccgtggttgtcccagccgggaatatagggggtgtagtagccccgcatggcgtgggagcggatgatgatgtccttgatggacttgttcagggcgtggcccatgtggaggttgccgttggagaagggggggccgtcgtggagggagaaccggggcttgccggcgttcttcttcagcagctccccatagacgtccagcttcttccagttgcgaagcatctcgggctcccgcttgggcagacccgcccgcatgggaaagtcggttttgggcagatggatggttgcattgtaatcctgagacatggttgactgttcactccttcaatcgtgacccatcgtccgccggggacgtgggggctcttttttctctgagaaagaaaacggaacctgcccggagatccggccaggttccgtttgtggatggtgtcatctgattttccaggcggctgcctccgccaggccggggcccggaaacgccgtcgccgcgcctggcaatcctgtcctgggggctctccccgggatcactcgatctcgtaatccttcccgaactgaatctggtcaaagacccgggtgtcccccatgtccccgctgggggcggcggactcggcgggcccttcaaaaatcttggccatggaggcctcgatatcctgggccacctcttcctgctgttccggggggacggtcaccacgggctcctccgcgggctgggccgcaggggcgggggcggcctggggctgggcggtttccgccgtcaggctggacaggctgccgatgtactgaatctgcttggtatacagttccttgagctgggccacataggcggtggtggcggcgcgggcggcctccagccgggcctgctcgtcggccaggtccttctggatgccctccaggcgcgtgcggactgcctgctcctcttgctccatctgggcgcggacctcctggctgcgggcttccaccgcagacacagcctggtcaatggcggcctgctttttggcctccccctctttcaccatggcatcggccattttctgggcggagtggagggtcatccgcatcgcgtcctctgtggcacggtattcctcaaccttgtccaccaagaccttcatcttgttcttcagggagatattctcctggtacaaggtgcggtaatcctcgatcaggctgtccaaaaagttgtccacctggagcatattgtagccgccaaacgaagctttcggaaagacatgggattccgcttcctggggtgttaacatgatcggtcactcctatccctttttaatctactggccgcggcggcgctcagaagtacagaccgttgttctccagttcgtcaatgaggtcgcccatgatatctacattatagggcgtgacgatataggtctgaagggccacctttttgatcttcccctcctgggcgtaggccacgccggacaggaagtccagcagacggcgggccacatccttctgggtcttctccaggttgagcaccaccgtgcgcttgtcccgcaggtggtcggcgatctcggaggcgttctcatagcgttccggcttcaccaggaccacctgcagctgggtggtggcgtggatgttcaccaccttgccgccggaattgcggcggggcggctcctggtattcccgttcacggcggcgggacggctcttcccggggaggcggggtgggttccacgtcctccggctcctcctcgtcctcgtatacgtcttcgtcctcgtcgtaatcgtcctccatctcatcctcatacggatgggtcagacgcttgagttcatctaagaatcccatggttactgtaaccccctaaattttgtgaaaaatggtatggcgaagtcgcctcatccctggggatgccaaggcggacgggcgccgaacagagccgttcccacccgcaccatggtggacccacctgcgatggccagtgggtaatctccgctcatgcccatggaaaggcagtcaatattagagacattatcccctaatttctccttcatgtcaacaaaaagctgataagtttcttggaaaaacccccgattttcttcctcggtggcggtggcgggggggatgcacatgagcccccgcaggcgcaggtgggggcactgggccgcatggcgggccaaggtcaggatctcctcccgtttggcccctcctttgctctcctcctggccaatgttcacctccagcagaatgtcctggaccacccccaccttggccgcctgcttctccacggcgtccataaggcgctgggagtcgatggactcaatcatatccaccttgcccaccacaaacttcaccttgttggtctgcaggtgcccgatgaaatggacccgggcccctgcgtaggcgtcgtcctccaggtgggccaccagctcctgcacccggttctctccacagacggtgatgcccgcctgaatggcgttgcggatggtttgggaggtctggaccttggtggctgccaccagggtgatctcctccgggtcccggcccgcctggagggcggcctgacgcatgttctcccggaccgctgccacgttggcggcaatggtctcatagctcttggtctctgtcatggttcaacgtaccacctttccatcgtatagttcctcggaggccaggacgatctcatcccctgcccggaggattctggtgtcttcctcgtctgtggggtcggccttcaccagatagctgttctcgtcctcggccaggattttcaccggccggaaccgcgccttctgggagaccaccacatagaccccccgctctccgtccttgctcacccgcagagcctccttgggcacccggatgccttcactgctgtaaaagatcacccggccgctctcctgacggaggtcctccgccttgtcgtcgtcctgggaggagcgcaggacgatgaccacctggtcctcctgcacctctcccacctggaagacctccatggggaaggtctcagagagagaattgaaaaacacatccacactatcgcccacggcaaagcgggttacacagtcccctgggacggtgaccgcgtaataccaaatggaatcggtcaccagcttgcccaggacattggcgtctgtggaaggggtcagctgggaaaaggcggccaggtccttggggctcagcccgtccagcttgtccggggtgagcagggtctcataaccgtccacataggaggagaacaggccggactcctgggccttgatggaggtggcgccggactggtagctctgcaagtcatcgtaccgcgcctgaaggtccgcagcggcctgggtcatggcggcagtggcctcggaggacaggaggtattcccgccggagaaccagcttgcggtaggtctccgtctgttccgacaggctgctgtaattgcccgaagaggcggcggtacggaggctggtcatggcggagagcatctgatcctccagggcggtgcccgaaggggactcgctgtatgtggcatactgaagggcgctcaggtcatttttcacctggagcagctcctcctggttctccacataggtctcgtcctggtagaccacggcaatctccttgcccttggccaccttctctccctggccccgcttgagctggaccacaccctccgcgccggccacaggctgctccgaccggaccacccagccggcggcgtccacactggtttccatggtgtccgtataggccacggtgaattgatacgggtcacgaatgcccacccaggccgagcagatcaggtagaccacaatggccacaatgacaatgggcatggcgattttggaaaagatggttccctgctgttggttcataaggtcagcctttctctatctccccgcgccctcccgcctcgtccggcggcgccgggacacggggcaaggcgcggtcaatccgggtcttcctcctcccaggacagcggccgctcggggaccacagtggagatggcatgcttgtacaccatctgctgctttccgtcgctgtaaatgaccaccacaaaggagtcaaagccccggatctccccccggatttggaagccattgaccaaaaagaccgtggctcccatccggctgcggcgcagcttggacaagaggtaatcctgtaagttgcgctttctctgttgtactgctgtttgtgtctgttgcatggtgacgcactccttttatctttggtgcgtctatggtaatcctttttcccgaagataatctgtcgaaatctgcacgacactggaaaaatcttgcattttatccagcaagatccattctgtgtcctccttgcgccggaaccaggtcagctgccgtttggcatactgccgggagcggcgcttgatctcctccaccgccggggccaggtccccgccggcgtccagggcccggaccagttccttatagccgatggcctgcatggccgtgcttgtccggggaatccccgcggccaatagggcgcggacttcctccgccagcccccgggccatcatctggtccacccgctggtcgatgcgctggtagaggtcctggcggtcccggtaggtcagggcgatggtcaccccctgataccggggcggctgggtctgggtctggcggttgtgctgggagatggtctggcccgtgtcataccagacctccagggcccggatgatccgcttggcatcgtgggggtggagccgggccgccgtctccgggtccacctggcgcagctgctcccacagggcatccaagccgccttgggccgcctgggcctggagccgggtccgaaccccggtctccgggcggaagtcggaaaaggaccgcccctgacacagggcgtccaggtacaggccggtgccgcccaccacaatgggctgtctgccccggcggaaaatgtcctccacacaggcggtggcctcctgcacataccgggccacgctgtaattctcccgggggtcggccacccccatcatgtggtggggaacccccgccatctcctcctgggtgggacgggcggtgccgatgaccaggtcccggtagacctgcatggagtcggcggagaccacctctccccccagagccttggccagggccacccccaggcgggtttttcccgtggcggtggggccgcagatgagaattagttgggagggcatgatcacaccaccttgcagaaatgaactggggcggaaggcgtcgccttccgttcggggtctattttaacacgttttccccgccctgtctatgaactccgtttaaactgtcgctccagctggctccgggtcatggtgatggccaccgggcggccgtggggacaatacttgacccggccggccatcacctcccggaccaccaccagcagttcctcccgggtgttccgctggcccccctttaccgcggccttgcaggccatggtgtggagcaccgcgtcccgggccgcctgggggtccgccccgccgccggtgagcagctggccggcgatctcgctcagggcgggctccacctggccgggctctaagtagtcagggatctcccgcaccaccagggcgccgccgccgaacgcctcgcaggcaaacccaaactgcgccagcaggggcaggtggttcagcaggacctctccctcctccggggcgggggtaaagaccaccggcgccagcagggcctgggccatgggctggtaccccgccgccttcatccggtcaaactgcatccgctcatgggcggcgtgcttgtcgatgaggtggaccgcatccccctgctccacgatcaggtaggtctgcaaaatctctcccgccagccgccagggggcctcctcttccagggaggggggcggaaccggagcgccttcggccccgcccagaggggccgggggaaccttcagctttagctggggggcgggggcctgctgggggacggagggtgtacggtggggtgtatcaggccggggcaccgccgccggccggggtttttcaacattttccaccggtttatccacatttccgcaaaaatcggtggatttcccggcggattttggggaaaaaccggggacagattccccctgcaagggggacgcgggggtgtacgcccgttccaacggccgcagcagagccccggcggcgtcccgaaggaccggcttgccctgcgccggctggaggggcggacgctgttctccgccggaaccggcctgcggagacggctggggtggggcaaaggtcaccgtggggtggcgcgtctccccctggagggcggagagcaccccatagtagaccccgtcaaagacctggcgctcgtggaggaacttcacctcagtcttggccgggtggacgttcacatccacctggctggccttcacctggagctggagcacgcagccgggaaacttgcccaccattttctggttctcataggcccgctccagggcggccatgagaagcttggacttcaccggccggccattgacgaaaaaatgctggtaggtccggctgccccggcagcaggcgggcagggagacaaagccggtgacggtcacatcctctccctctccccgcaccggggtgaagcccagggccatgtcccggcccagcaccgcatacagggcggacgagagtttgccgtctcccggggtcatcagctcccgcttgccgtcccggataaactggaaggacaccccagggtgggacagggccagcttctgcaccagggcgaacaccgccgccccctccgcagcgtcccgcttcataaatttcagccgggcgggggtgttgtaaaacaggtcccgcaccaccagggtggtgcccagcgggcagccggcaggctcctgggagagcacctggcccccctccagggtgagggaggtccccaggtcgcactgggccgtgcgggtgaagagttccacccgggacaccgcagcaatggccgccagtgcctctccccgaaaccccaaggtgccgatggccgccaggtcctgggcggtgcgcagcttgctggtggcgtggcggagaaaggcggtctggcactggtcggtgggaatgccgccgccgtcgtcggtcacccggatcatggccatgcccccccgctgaatctccactgtcagggtatgggcgccggcgtccacggcgttttccaccagttccttcaccaccgaagccggccgctccaccacctcgccggccgcaatgaggtcggccacgtgggggtccagcacttgaatttggttgggcatgaaaacaccaccttatcaaaaaagaaatcgtttccccagggaaacccaggggaaactggactgtgtcgtgatcatcttggggaaacgctccccgccccgccttgccggcggggccgcgttcagagcttttccttgagttcatggagcaggttcagcgcctgcaggggcgtcagggtctccaccggggtattgcggagcgtggtcaaaacctcctcctcccccagggccgtcagggagacttggctggcctcccgggctcccgtcttcttgggggcgtcctgctgggactccagctcggccaaaatctcccgggcccggcggatgaccttggggggcagccctgccagacccgccacctcaatgccatagctctggtcggctcccccggggacgatcttccgcaggaagaggatttcgtccttcctcttccgggcggcgatgttgaaattttttaccccgggcagctggccctccaacaccgtcagctcgtgatagtgggtggcaaagagggtcttggcccccaggcgcttggggttggcgcaccactccagcaccgcccgggcaatggacatgccgtcgtaggtggaggtcccccggccgatctcatccaggatgagcaggctccggctggtggcgtgacggagcagctccgccacctccgtcatctccaccataaaggtggactgtccccccgccaggtcgtccgaggccccaatgcgggtgaaaatccggtccaccaccccgatgtgggccgcccgggcagggacaaaggaccccatctgggccatgagcaccatgagggccacctgccgcatataggtggacttgccggccatgttggggccagtgatgatggcggccaggttgtccttgttgtccatgtaggtgtcgttggggacaaagagggcgtcccgccccatgacctccaccaccgggtggcggccttcggtgatctccagcttgtcggagttgtccacccggggcatgcagtagttgttctccgccgccacaacggcaaaggaggtcagcacatccacccgggccaccgccccggcgatctcctggatctggggggcctgggcggccacctgatcccggatgtcacagaacagctggtactccagggccacaatccggtcctgggcggagaggatggtgtgctccatctccttgagctcctgggtgatgtaccgctcgcagttggtgagggtctgcttgcggatgtacccctggggtacctggtcgtaataggatttggagacctcaatataatagccaaagaccttgttgaagcccaccttcagggacttgatgccggtcttctccttctccgccgcctccagcttggcgatgacccccttggtgtccgtcaaaatggcccggagctgatccacatcggggtggtagcccgggcggatgaggccgccctcccgaaccgagaaggggggctcgtccacaatgccccgggcgatgaggccggtgagctccggcagcccgtccagctgggcccgcagccgggccagcagggagggggcctgctggggcaggtggtcctggagcaggggcagccggtccagacccgcggccagggccaccaagtcccgggccccggcggtgccgtagacgatgcgggagatcagacgctccaggtccgtgatctcccgcagcacctggaccagctcctcccgctccacagcgttgtccaccagccagcccaccgcctccagccggcgggagatggccaccgggtccagcagagggcgctccagccagctgcggaggagccggccgcccatggcggtcttggtcttgtccagcacccagagcagggagccctttttctccttgccccggagggtttcggtgagctccaggttccgccgggccaccgggtccagctccaaaaagcggccggtggagtagtatcggagggtccgcaggtaggacaggtcggtcttttgggtttcgtacagataggagagcagtccccccgccgcctgtatggcggcctcggcctccggcgggacctggtccagccccgcggcgaactgtctctccacccgctgccgggcctccgccagggcaaaccgctcctccccggcctgctccacccggcaggggagcttcccggacaggtggtccagcagccccttatcccgggccccgggggagaggatgacctcccggggggcaaaccgggccagttcattgaccgcgtggtccacccagccctccggggcaaagaaggtgaggaagacctcccccgtggagatatccccaaagcacagccccgtcccctgcacccccacatagagggaggccaggaagttgtttcttccctcctccagcatgttctcctctatgagggtgccgggggtgaccacccggatgatctcccggtccaccaggcccttggcctgggcggggtcctcggtctgctcacagatggccaccttgtagcccttggcgatgaggcgggcaatgtatgcctcggcggagtggtagggcaccccgcacatgggggtgcgctcctcggggggcttgttccggtcccgggtggtgagggtgaggttcagctccgccgcggcggttttggcatcctcgtcaaacatctcatagaaatcccccagacggaagaagaggaggcagtcggggtgctggtccttgatggccaggtactgtcgtttcatgggggtgagttctgccatagtatcacactttcttgatccttcagattctgtctggggtttttcccgcactggcggggcgttttttcagcgctgttggaacgggcgggaacttggccctcccgggcggggtacccttgtggttttgtccccacgccgttggaacggcagggaaccttggcctgcccggccggggccccatttcttgggaagaaatgggggaaagaaccccagagggaagaggttcttccctctggactcccttctctggtggggttgtgtggggggaggttgtacttctcactggttacctggcctgcggccctcacattgaaaggcccgtaacggcccgcccaccggctgggcgggctggggacgtggcggggtaccctttgggagaaggcagagagtaaccgttcgggtttccacttttcctcccgacaataaaccacttctcccgcccgcccgagctggtgggcgggccatgaggcgttggtctttgaggccgcaggccaggcccctaccagaccaatcaccttcccccgttcctcccaccagagaatggggttccaaggggaaggaacctccttccccttggtgttctttcccctatttcttcaaagaaatagggccccgcccgggagggcaccgttcccgcccgttccaacggcgtggggagacactccctcacccctccaccacgtctccaaacagagcccaggtagaggcctccgtaatccgcgcgttctgccaggtcccgatacaccccgggtcccccgccagatggaccagccgccccccgtccgtccgggcggtgaggcgtccgtcggtcccctggccgtccaccagacagcggtaaatgccccccacgtacctctgatgcttttcccaggaaatttcattctgccgctggagcagccgctggaaattagcgctcttctgctccttgggcatggggtcgggcatcctctccgccggggtgccccggcggggggaaaagaggaaggtgaacagggcgtcataccggacggtctcaatgaggctcatggtctgctcaaactcctcctgggtttccccgggaaatcccacaatcacatcggaggtgaggacgatctctggaattcgggcccggagctcgtccaccagggagaggtagtgctcccgggtatacccccggtgcatggcctggagcacccggctgctgcccgactggaaggggaggtggagcaccggggccaccttttcacaggcggccatggtgtcaaaaagccgcgccccggcgtccttggggtggctggtcataaaccggatgagaaactccccggggatggcgttcacctgctccagcagccaggcaaagtccacccccagtcccaggtccttgccgtaggagttgacattctgccccagcagggtgatgtcctggtaccccgcctgggccagctcacggacctccgccaggatgtcctccggccggcggctgcgctcccggccccggacgtaggggacgatgcagtaggtacagaagttgttgcagccgtacatgatggacacccaggccttctgccggttctgccggaccaccgggatgccctcggccactgccccgggcacatcctcggtggcaaagacccgcttgccgctggtgagccggtccagcagcagctggggaaactgccacagcagctgggggccaaagaccaggtccacatggggaaaggactggcgcagccgctgggccacatggtcctgccgggccatgcagccgcacagacagatcacctgctccggatgccggcgcttggtgtgggtcagggcccccacgttgccgaacacccgctgctcggcgtgctcccggatggcgcaggtgttcagcaataccaggtccgccccctcctccgtgggggagaaggcgtagcccatccgggccaggtacccccgcagacgctcggagtccgcttcattctgctgacatccataggtgtctacataggccagtttctggccggggcgctggtccagcagggcacgaatctggtcacacagggccagctggcgggcgatctccgccggggcaatggtcagggtctgtctcaagatggattcctccgggtagttggatttggggataggggatacttacttataaaaatacagtgtgtagtatagcacaattcgacggatttttcaaggaaaacagccccttcccccgggagaatccaaacatcttccagggggatgacaaaaacagcgggcagggggtacgtcctgcccgctgttttcgcggttgtctctatggccccggcccgggccggaggcccttggttcagggcatcgggatttcgacgccgcccaccacaaaggcggcaatctcctccacagggatggtttgcgcgaaggttccgccccgggtgcagacctccttgccatcctggggcgccatactgccgccggtgctgccggtgccgtcggagagggagagcaccgtaccgtcggtccgcttgagcccatggggcaggtcaaacctggcccactgttcctcctgggcctgggtcatctgaccggtgccggaggccacaggctccgcctgctggtccacggtgtaccgcagatagtagccgatgggggagaccaccagggcgtcgatggtggcggtcattccgttccactccagggtctgacccaccggcagccgcaccgacaggtcccccgccttcagctggaacttcaggttccaggtcccctccgccaggacctgggacgcggtctcccgatcgcccacggtacgcaggtcctggagggtgatcttcaccgtgccgccggcctgggcctgttcatggtaagacatggtctccacatactggatggcggcatcggtggggtcggcgtcatagaaatagctgctgccgtgggccccggtggtgttccggccaatggtgctgtccgcgctgtcccaggtcaggttcagcctgccctccccttggggaatctcctccacggagaaggcggtcccgtcctcccgggcgatggaataggtcatcagatagttgtagccatcaaacaggatggcctccgcggtgacggtcacgccgttgtccgtgtcgctggcgccgatgggatagccgatctggtccatcacctgggtgtccgccgtggggccgaagacgccggcaaaggcctgggctacggttttcagcccccctgtggccccggcccccaccgccagcaccagggccgcggccactgccaccgccgcgatccggggcttccaatgggtccggcgggccgggccgggctccgcctgctgcgccaggctttggcgcaggtttctggtcatccgtgccttggcaacctgggaaaagcagagctcgtccatcgcctggcggtagtccgcttcttcacgatatttcatgtgcatagtcgtctcctttcagcagtgcccgcagcttgctccggccgcggctcaggtaggtgttcaccgacgcctcactctggcccagcagcccgccgatctcccgggcagaatagccttcataataatacagatagatcacctgccggtatttcaccggcagggccatgaccgcctccagcacgtaggacgccggtgcctccggggcggggggctccgccaccagctccagccccacggtccgctgccggtgggcgctgcgcagcaggtccttgcacgcattcactgcggtgcggatgatccacgccttctcatggtcccggctctcaaagacctgcccgctggtcaggcatttgagaaagacggtctggcagatgtcctccgcgtcctgagccgagtgcaaataggtgtaagaaagccgcaggatcagatcggaataggtgtttaccaaccgttcggcctgctcctcgtccacttgtctcacggtcctcatctcctttccaaaccagcccgtcggctgtgtcagcaacgtcgcttcacctacaatacgaatgaagggcgggaaacctgacaggttaattcaaaaaattttttcgaaacatccgcggccgctctccgcccggcggactggcaaaaaagcgccgcggcagaagctttttctgccgcggcgggaaggaaggatgattcattgttttcaggggattttctggttccggcttctcgtggttcagcctttttccctcttcctacgaaatcgcctccccgcccacggtatagccgtcccagtggccggatgggttctggcgggcggtgcagtgggtgaaccagtaggcgccggtgccgcttctccatttctgggcggtgaaggtgagcgccccggaagggttctcctccgcaagggagaggaagaggccgtcgtcccactccactcgctctcggtcgatgtatccctggtccgccagggcctcccaggtgccggtcagaacagggcagtcccgctgccagctcagggccacccccaccgctccctgttcggcgggggacaggcgggtttgagagaggtccaggcccagctgcgccaccccgtcgttgagggcggggtccgtcgcccacaggtcctccagcacctgaaggtacaaggcgcacaggtcgtcaaagcccgacgcctccaccaggataccggttacctcccccagccgggcggggaaggtctcctccacagtgccgccataccccacctgaatccggtcccccggacggatggcgccttggtccgggtcctggtaggccacggggcactggcccagggagaccgcatagacatcactttcccccgccccctcctccaggctggccaccagaagctgcgccccctccaccgctgccacccggccggtgaggcaggcctcggacgccggcaggcgggggttctccttgtccggtgcttccccgcaggcggccagcaggcccaaaagcaggaacagggtcagccccagcaaacaggatcgtctcatgggaaattcctcctttccacgccgcgtttcatatacaacaatgggtagggatttccttgttcatcccgctctgttcttttataaactgtaaatcccatatgttcatagaacccttttgcaagagggttttgttcgttcaccgccaaatcatggacggaatattgctcgattccatattgaagcagtgcctttccagcccctttccccctttcctcgtccgcaacgaaaagcatttccaggtgttgttctgcaattcccataaagccaatgggacattgattttcatggtttagaacgagtaaatgcggtacttcgctcagggcttgcggcacatacttttttatgttttctatttcattttctgatagaaacaggtgggtcgctctcacggaactctcccatacttccagtaattgtttgatcagcaatggcgttctgtctgctacctcaatcactttcatcttaactccgtcctccgtaaacaacagtttgtttttaatcgcatgatagcatgatgcttccatcctgtcatctcttttctgcttttgtgacaaagcaaattccaacacgttttaagggaaacaagcggaaatgaaatactgtattgtaggaaagaaaacatggggtttgttcataagacgtcgccggtggtcccttggttcccccacccggccagatttcaggggcaggccctggggaaaacaggccggggcgtgggagagaacgttgactatttccctggccacgtgctatactaagatattgtatcccatgtttgccattccaaaaaccaaagagaaggagaacccttatgcgcgcagtggtaaccagagtatcctccgcctctgtctccattgacggggccaccgtgggggccatcggcaccggctttctggtgctgctgggcatcggccccaacgacacccaggcccaggcggaaaagctggccgataaaatctgcggcctgcgggtctttgccgacgaggcagggaagatgaatttgaacctggccgccgtgggcggggccctgctggtggtctcccagttcaccctgtacgccgatatcaagagccgccggcccgggttcaccaaggccgcgcccccggcggtggccattcccctgtatgagacctttctggacctgtgccgggcccggggcttccaggtggagcacggggcgttcggcgcggacatggcggtgcagtcggtgaacgacggccccgtcaccatctggatggacaccgagaccctgtgacgccggccccatgggcccggctctgtttttatcaattcttcccccttgggggacaacgaggtgacttatgctgcaaatcaaacgtatgcccgtgggccagatcggcaccaactgctacctgctggaggacaccgacgccaagctctgcgccgtcattgatcccggcgaccagccggaggacattgaccgggagatccgcaaggcgggcctcaccctcaccatgattctcatcacccacggccactttgaccacgtgctgggggtccccggcctgctggagaagtggccgggcattcccgtctacgtccacgagaaggaggtcaactgggccggggcaggggaccagtacatgctcctggccccggtggagggcatccacaccgtgaaggagggggacaccatccccttcggcggcgccaccatccaggtgctccacacccctggccactcccccgggtcggtgacttaccgggtgggggacgtcctcttctgcggggacaccctctttgccggctcctgtgggcgcacagactttgtgggggggagctatccccagattctgaagtccctgaagcggctggtctccctggagggcaacctccgggtgtgccccggccatgaggggacctccagcctggacgtggagcgggcccacaacccctttgtccgggaagccctgcgatgaacctgttctttgccggccaccaggagaaatacgcggtggagcagaccctgctcaccctctttccccaggagcggccggtctatccagatacgcccccggggggagacaacgaactggtgctctccttttcccggggaagccagtggtgcaccgctcgggcggtgctgcgccggggggggaagacctacgtccgccagtgccgggtggctgccgccgaactgccggcggaggacccagtggtatccacccggctcacccgccggaccctccagcgggccttttacctggccgcggtggactgcctggggacagagcccccctgggggatgctctccggggtccgcccggtgaagctccccacccgggccatggaggccggggcctctccccgccaggcggaggccatgctgcgggaccaataccgggtctcccccctgcgccggcagctggccatggactgcgcccaggccagcctggcggtgaaacgggacctgaagccccaggagatctccctgtatgtgggcattcccttttgtcccacccggtgcgcctactgctccttcatctccgcctcggggtcagccaaccggctgatccccgactacttggatgccctgctggcggagattgacgccgccggcgccgcagcccggcgggcggggaagaccgtccggtcggtctatctgggcggggggacccccaccaccctggaggcccctcagctggccgagctgctggaccggctccgccgggctttccagctggcgccgggcacggagtgcaccgtggaggccggccggccggacaccatcacccgggaaaagctcatcgccatccgggagggcggcggcaaccggatctccgtcaacccccagaccatgtccgaccctgtcctggcagccatcggccgcagccaccgggcccaggatatccgccgggcctatgccctggcccgggagaccggtgtgggagcggtcaacatggacctgatcgccggcctgccggcggacaccccggcgggattccgccggacggtggaggaggtcctggccatggccccggaaaacatcaccgtgcacaccctggccctaaaaaagggggcccgcctgcgccaggaggagacccccctgccctctgggacagatgtggccgccatgctggacttcgcctgggcggccctgcgccaggccggttatctgccctactatttgtaccggcagaaattcatgtcggggtcctttgaaaacgtgggctggtgcaaacctggcttcgtcaatgtctataacatctgtatgatggaggaactccacaccgtgctctccctgggcgcgggaggcgtcaccaagctggtggaaggcggcgtggtccgccggctggccaaccccaaatatccccaggagtacctgcggaacatgggcgccattcaggcggaaaaggccgccttttcctggtaagaccccatcaaaccggcaactttttttcctgttttccacgttttgtgactttgttccttgacgtgcctggaaggaggcattaaaatgtcctatcagctgcaagagatcaaccgccgcatcgaccaggatgtgaaggggtttttggaggaatgcgacgcccagtacgcccagaaggtcagccaggccgccgacgccattttgaccaacctcccccacagccccatcgtcctgctctccggcccctccgggtcgggcaagaccaccaccgccctgaagattgaggaggagctggaaaagcggggggtgctctcccacaccatctccatggacaactacttcaaaaccctggaccccaaaaccgccccccggacggccgacgggctggtggactttgagtcccccaagtgcatggatatggacctgctcaattcccactttgccaagctctccaaaggggagaccattgtggtgcccaagtttgagtttgcccgccagatgcgcaatgaccacctgggaactcctctccgcctgaagaaaaatgaaatcgccattttcgaggggattcacgccctcaacgacgagtgcgccggacgaaatcccgccgccacctgcctgtatatctccgcccggtccgacgtgctggagggggaggacctgcggttcaagggtacctggatgcgcctgacccgccgggcggtccgggactataacttccggggcaccggggtgggggagaccatggacatgtgggccaatgtccggcgtggggagaagctgtacatctctcccttcaagcaccgggccaactacatctttgactcctctctgccctatgaggtgtcagtgatgaagcactacgccatgcccctgctggaggccgtgccccaggagaacgtccggcggcgggagctgctggacctgatccacggctttgaacatttcctgcccattgaccccgccctggtgcccccggcttctttactccgggagttcatcggcggcggcatctacgactatacctgagcgcaccccgggcggccgacgcccgtttatatcaacatccaaaggaaaggaagtctttctatcatgtctgaagaatgtacccatgactgcagcacctgcggctccagctgtgagcacgtggacgccaaagacctcattgcaccgctgaacaaggactcttccatcaagcacgtctacgccatcatgtccggcaagggcggcgtgggcaagagctccaccaccgcctccctggccaccgccatggccaagcggggttataaagtgggcatcatggacgccgacatcaccggcccctccatccccaccgccttcggcctggacacccgcgccgtgggggacggggagagcatcttccccgaactcacccccgggggcatcaagatcatctccctgaacctgctgctggagaacaagggagacccggtggtctggcggggcagcctgctgggcggcgtggtcaaacagttctggaccgacgtgcgctggggcgagctggactatctgttcattgacatgccccccggaacgggcgatgtgcccctgaccgtcttccagtccatccccgtggacgggatcgtggtggtcacctctccccaggacctggtctccctcatcgtcaccaaggcggtccgcatggccgagatgatgaacaagcccatcctgggcgtggtggagaattacagttatttccagtgccccaactgcggggagaagcactatatcttcggcaagagcaacttagagcaggtggccgccgagctgcaggtcaaggtgctggcccagatccccatggaccccgccatggccgccgccatggaccagggcgccatggagaccatggagcacaactacctggagcctgtggctgacgccattctggcccacgagcagggataagcagacaaccgcgccggcggggtgagaaaactcgccccgccggcgttttcacagaaagagaggaccgcctatgaaactcatttcctggaacgtcaacggcctgcgggcctgcctgaaaaaagactttatggcctccttcacagccctggacgcggatatcttctgcctgcaggagaccaagctccagcaccacgcagggcaggtggagctggaactgccggggtatcaccagttttggaacagcgccgagaaaaagggctattccggggtggcggtctttaccagagccgagcccctgtcggtgacctatggcctgggactggaggagcacgaccacgagggccgggtgatcaccgcggaataccccgggttttacctggtctgctgctacacccccaatgcccagaacgagctcaagcgcctggactaccggatgacctgggaggacgccttccgggcctatctccaggccctggacgagaaaaagcctgtgatcctctgtggcgacctgaacgtggcccaccaggagatcgacctgaaaaaccccaagaccaaccggcgcaacgccggcttcaccgacgaggagcgggggaagatgacccagctgctctccgccggtttcaccgacaccttccgggccaagtatcccgacgcagagggggcctactcctggtggagctaccgcttccacgcccgggagaagaacgccgggtggcggatcgactacttcatcgtctcagaccgcctgatgccccaggtgcgggaggccgccatccacagcgagatctacggcagtgaccactgcccggtggagctggtgctggatctataaattttatatggatagaaagcgggaaccggcgcatgccggttcccgtttttcgtcaccgtattaaaacaaaaaccaagtaatctcttgggacaggacagaaaagggagcgatcagcgtcatccgaaccacactccactcttgtccccataggagcaggcaggttgcggcaaccggcaaacaccccaaaaccagatcccggacccgccagcgttttttgaccacacagcgaatcatatacaccaggcacaagagaccaaagataccacttaaaatccatagaatcgcaaaaaacaaattcatgccatggtatacattatcctggtaatatctcccttccatcaaaaacacagcactgatgcacacgagtaaaccgaaacaagatagcaggtaacctttttgtggcagggtcatggtttgcaccgcctttcacgcttattgaaaaagtaaacatctatttttgtctttttccctcttaatcctattagattttttcccaaaatgcaacacattctctcgctttttcccgctgtatctctatgatctggactccattcagactcccttctatcttatttatgtcttgccaacgacaattttttgccgtcccatcaaaaattttttatttttttctgcctgtcgccctttctcccatgaatacgaaaattctgtccaatgaaaaaagcccctttatcggtgttggagaacctggaagaagccataaaaacaccggggcgcacaaaaaacttgcgcgccccggtgtgtctcttcttatggtgttttgggtcgtgtcacgtggtcaaaaacagcgatacatagaacatgagctgctctaactgcgcctggaataatcgttctgcccctaaaagcaccagaaataccggcactgctgtggctgctgacagagtaaaacgctttttccttgggaatgggactttctcttttccccgcgcttccagacgtgcccctacaataaattgcagcagacaaaagaccaggcagggaatggcacacaagatgccatagtattgtacatggtaattaaaccaccaagaactcaaccggggttccggcgggaacaaagagaggacgagaaagaacagatagctgatggcgatgccgttctttacaaggtccattattcggtaaagggtcatactaacacctcttacatcactttactccactaaaatcactttgttaacaaatcctatgagcctcaaattggagctctgatcttacgcctcccttcaaatgaaagaacgaataccattgaatcttgttacatacgctctgtaaccacttgtgaatgctgactcatgataattctgctaaactggacgcagaagggaaccacactgcggttccccccttttcatgcccctttcttgtacccggggaagccaaagcggtcacagccagttcttcttcttaaaatgccgcagcagcgccaccacgatgaccacactgaccacgatggccaccggatagccgtatttccaggtgagctccggcatgcccacaaaattcatgccataccagccggtgagcagggtaagggggagaaagaccacggtcaccacggtaaagagcttcatcagctgattctgctggatggccagttgggactggtaggcctcccgcatctgactgatgatgtcctggagattgcgcaccgcccccaggtaacggtccattcggctgcccagaatcaccatgcgtcggcggaccggccgggtgagaagctggttctcattggccgccagctcgtccaaaatggcggagagctgctcatagtatcgttttagccggagcagctcccgccgccaagcgatgatccggtggaggacatcctttttcgtggcctgggtcccggagaggatatgggcctcggcctcgttcacttccccctcgaaccggtccagataatccatatcccccttcagcaggcgcagaaaaaaccgggacagcgcctgttccgccgggaggtctcctccctcctgctccaaaatctcccccataatcccctggacacaggtctccgccggctggctttcacagaagaaaaaaagtgcctcttgggtcacatagaccaaaattttggccgtttcggtccggtcgctgtggatgtcataccagtcaaaggccagcagatcaaaatcttcaaaactctcaaagctctcgctctgcccctcgtggagatagtgcagccgctttgggtccaaatagggcgccgcctcctccatgcggtggaaggggagtaccagatgggtcatgggaaatccctcttttcttagattgtgccttcattataccccatccagagacataagaaaatataaaaaagccgggacacacagcttcttgtgtgtcccggcttggtttctttccagccgtctgttcaaaactcttggtatgatgggcaagcagcctccgccgttattcctcttcggcaggttcttcctccacccgtgtcaccgcaatggacaagtcgtccagctgcttctcgtccaccacgtccgggcagttcatcataaggtcggaggcattctggaccttggggaaggcgatgacatcccggatcgaggaggccccggtcatgagcatcaccagccggtccaggccgtaggccaggccgccgtgggggggcgcgccgtactggaaggcgttcaccaggtggccgaaccgctcctggatgtcctcgtcagagattcccagggcctcaaaggccttggtctgcatctcgggggtgttgatccggatggagccgccccccagctccgtgccgttgaggacgatgtcataggcccgggcccggcagtttgccttgtcggtgagcatcttgtcctcatcctccagcatgggcgcggtgaaggggtggtgcatggcttgataccggccctcctcctccgaccactcgaacatgggaaactccgtgacccacaggaaacggaactccttggggtccaggatatccagctgcttggcgcactccaggcgcagagcgcccagggcggcgaagaccacctcatccttggtgtcccccacgatgaggaccaggtccccgtccttggcgccggcccgggccaggatggcggcgttctcctcctccgtgaggaacttctggtaggaggaggtcaccttgccgtccagcagacgggcccaggccaggcccttggcctgataggttttgacaaactcccccagcttgtcgatcttcttccgggggaagtccttggcgtggccatccacattgatgaggcggaccgagccgcccccctttactgcgtcggcaaagaccccaaagccgcagtccttcaccaggtcggagatgtccttgagctcaaagccaaagcgcaggtcgggcttgtccgagccgaaccggtccatggcctcccgccagggcatccgctggaagggggtctgcacctccacgcccagcacttcctggaacacccgctgcaggaagccctcctggatggtctggatctgttcctcatccaggaaggacatctccaggtcgatctgggtaaactccggctgacggtccgcccggaggtcctcatcccggaagcaccgggcaatctggaaataccggtcaaagcccgagagcatcagcagctgcttgtactgctggggggactggggcagggcgtaaaacttgccggggtggacccgggagggcaccagatagtcccgggccccctcgggggtggacttggtgaggatgggggtctcaatctccaaaaagccgttctcgtcaaagtagtcccggcagatcttcacaatcttatgccgcagggcaatggtccgctgcatatccgggcggcgcaggtccagatagcgatacttcaggcggaccgcgtcccgtacatcggagtgctccacaatctcaaaaggcggggtggccgccttggccagcagacggagttcggtgaccttcacctcgatgtccccggtgggcagctcgggattcttggactcccgctcccggaccagccccttggcggcgatgacatactccccccggagggaagcggccttttcaaacaggtcccggggggtgctgtcatcaaaggccagctggagcaggccggtgcggtcccgcaggtccacaaagatcaggctgcccaggttccgctgacgctgtacccagccgcagaccgagatctcctggcccacgttggcggcggtaaaggtgccgcagtagtcggtgcggcggaaatgttgtaaattgtccatggttcgttcactccaatgtcgtgtaatttgtacctgggcgctccctgtccggcagaggaccgaacccacagcggggcagcgcccagaacgctctgcttggtatcctttttcctttggggcaccacaggccgcccctttgccggcaggggaggcaagccctcactcctgccgggcatcctgttcagtgtactcctgttccagcaggaagtccagcaccgattgctgaaaggcctgactgtcggtcacctggaaggagcggccccggttcccttccgccccggcggccaggtcaatggccttgtcccccgtcagggaatagcggaataccgcctccggctgggaaatggtgatctggacggtgtagtccagggtcacattccggctgctcccctccaagtagtaggggcagtaccatttggaagagagcagggagagcagttcctcccaggccgggtcatcaggcgaaagggagagggttctgcccctctcggcctccccgccgaaggcggtcaagtccacctgcactccggtgactgcgtcggggtcaaagccgctgcccagggcactgctgagaggccggggaaagaaaaaatacaccgcaacggccaaaatgaccaccagctccaccagggcgattttatgttttcgagatagttttttcatgacaccgtcataggttcctcctgttccacagggtttttctgggtatagggctgggctaagagcagatccaacagttcctgctgaaaggcctgctccacccggtagcttctgccctctccatccagccgggacagcaccgcctcccgatttccgctgaaatagaagaaggaggcgggatagccgtccccttccttttcaaacacaaggaaaccggcgatatagtagtccagcggaacgctctttcccgttatcgctccccagtggtagatgggacgataccgctggccgttcaggatggacagggcttcctccagcgccgggtcaccggcggagaggacgactgcccgggaccggtccgggtccgccacatcgttcagcgtaacctgcatctcccaaatctggctgggatcatagccctctcccaccgtctgggcaaaggttctgggccagaatgcccaggccaaaagcccgactgccagggccacccctccaagggcaagccaccttttctgtttcttcgtcattgtgtcctcctcttccggaaagcccggcggggaagggccgggcccggggatcacgccggggtgtcgggctgggccagcagaaggtccagcacggcctgctggacagcggggtccaggcggtagcccttgcggaaggggccaccagagccgatgctcacctcccggtatccgtcaaagtaaaagggaacgcttacgccgccgtcctccccctgaaagacgaacacaccatagatggcatagtccaacgcagttggatggccgctgatggcgccccaggggttgtggtagaccgggcggtaccgctgtccctccagcagagccagcagatccccggtggcggggtcgtcgggggagagggtcaggtcccgggatgggctgttgttcctgacatggctgagatggatctgaacttccttcagctgggcaaagtcctttcccagcacctggggaagggtactgggccaataggccgccatcaagaaggcggtcagaatggccagaatccccacaaggatcaggaggtttcttcgtcgagacatggggcactcctttctccggggatcggtccccggggcggatgctgctctctttcagcatggtcagaaggggcaaacccttggctccgtgccccttcccccgccggcggcagggaagaggacaagccggcgtttcgtctttctcagtccttctcccgaatgggcttgccctgggcccgctgggccagggcggcggccaccgtgtccaccgcctgggcgggggagagggtgtgctgttccccggtggccatgtccttgatcttcaccaccccctgggcgatctcatcctcccccaggaaggccacataggggatgcccagcttatcggcgtagctcattttccctttgaacttcttctgttccccatagacctgggcccggacgcccccttggcggagctgcgtggcaaaggagatggcggcggtgaggtcctccgtcatggggagcaccagcacatcagccggggaagtcaccaggccgtcgttgaggtatccctgctctcccaggacatagaacagccgggtcaggccaatggaaatgcccacgccgggaagttttttgtcggtgtaatactccgccaggttgtcataacggccgccggagcagatggagccgatctccgggtggtccagcatgacggtctcatagactgtgccggtgtagtagtccagcccccgggcaatggtgaggtccacggcaaaatggtcctcggggaccccgaaggaggcgagatacttgaccaccaggcccagctcctccagaccctggtcaaagacctggttccggccccgataggcttccagggccgccagcacctgggcattggagccagtgatggcgataaaacgcagaatctcctgggcggcagcctgggagatcccctgctccaccagcagggcctggaccttttccgggccgattttatccagcttatccaccgtgcgcatgatctccccggactgggcggacaggccctgcatctcgtagaatcccgtgagaatcttccggttgttcacccggattttgaaccgttccagccccagggaggtgaaggcctggtagataatggcgggaatttccgcctcgttggacacgtccagtttaccgtctccgatcacgtcgatgtcgcactggtagaactcccggaaccggccccgctgggcccgctccccccggtagaccttgccgatctgataccggcggaaggggaaggccaggtccccatagtggagggccacatatttggccagggggacggtgagatcaaaccgaagggccaggtcgctgtcccccttggtgaagcggtagatctgtttctccgtctcgccgccgcctttggccaggaggatctccgccgattcaatgacgggggtgtccagcggggtgaagccgtagagggcataggtggtgcggagggtctccagcatccgctcaaactgggtttgccgggcgggcaggagctccataaaaccggacagggtccggggtttgatgcgttccatagattgttctccttgttaaactggttttcctgtggggggaggggggtgtttcgatctgtctgcctgggggcgggttcttttctccacgccgttggaacgggcgggaacggggccctcccgggcggggccctatttctttggagaaatagtggaaagaacaccaaggggaaggaggttccttccccttggaaccccattctctggtggaggaaagggggaaggtagttatttcggtatgggcctggcctgcggcctccaagaccaacgcctcatggcccgcccaccggctcgggcgggcgggagaggtggttcgttgacgggaggaaaagtgggaaacggaatggtttttctcctccctttcccaaagggtacctgttcacgcccccagcccgcccagccggtgggcgggccgttacgggccttccaatgtgagggccgcaggccgggtatcccgtaagaagtacagcctccccccacacaaccccaccagagaagggggtcccgggggaggaacctcctcccccgggggttcttttccccatttcttcccaagaaatggggccccggctgggcaagccaaggttccctgccgttccaacggcgtaggcaaaacccacaacacccccaaccccttaaaaaatgcgccttcgtccctggccaggccggaacgaggacgcattgtcagctcttgaactgtactaaactctcagaccgtcacaggcttgagagaggggttgatgatctctctccaatccaaatcccctcgctccagaccgtgaatgagaatctccgccgtggcggcgttggtggcgaaaggaatgttgtactggtcgcacatctggttgatatacttcaggtcggggtccaggtcgctggactgggggtctgagaaaaacagcaccatgtcaatctcgttgtaggcgatccgggcgccgatctgctggctgccgccgtgggcatgggacaggaacagacggacgggcaagccggtggcctccgcgacaagacgacctgtggtgttggtggcgcacacggtgtgcttggacagaacaccgcagtaggcgatgcagaactgcaccatcagctctttcttgtggtcatgactcatcaaagcgatattcattcttggctcatcctttcgctgtgggtggccgcgctcccggaccaaaggcgggggaggggtcacaaaactggtgggagggaatggggaaggggctgcttcagcgaatccgcatcaggggcacctgctgcccggtgagacggcgggcaatgttctcataggccttcgcggccccccgctggctcatctgggccaggggacgtccgctgctggcggccagcaccaccttggcatcctcgggcaccagccccaagagaggcaggcccgcggtgtccatggcgtcgtcaatggtggccccctgccggcgcagcagccgggggcggacccggttgaccaccaggtggatggtctccagattgggcagctggctgaccacccgctgggcatcccgcagggaagaggggtcgctcaccgccaccacaatggcccggtccgcgtcacagaccgccagacggaaccccgcgcccaaaccggcgggggaatccacaaggacgtactcatacgcctggcgggcctgggccagcaggtcccgaaatcccgcctcgccggggaaatcctccggcagcgtcaggggcgcggtgaggagatacagcccggaaacagagggatggggcgccaccgcccggcccaggggacaccggccggcgatgacatcgctgaagtccatcagcgccgcgtcggtcatgcccaaggtaatgtccaggttgcgcagtcccacatcgccatcgatgcacaggaccttgtgtccctggagggccaaggcggtccccaggccccctgtgagagaggtttttcctgtgccgccttttccggatgtgatgacaattacgcagcccacggccattcctcctgaaacttctgcttcattgtaccataaacctacaatgcttgcaaccattttttgtgcaaagacactaaacttttgtctccttgatcttggtccatttccggggatagctcccaggggtgggccgggccttaaagactgtgaccacccggtgatagacctctgtcccggggaccaggtaatccatgacaaagggcttttctccccccaaagcctggatgatcttttcagctcccgcgatctcctcatcggtcttgttgctcttcatggccagaaagaggccgccgggcttgacatagggcaggcacagctccgccagcatgggcatggcggccagagcccgggagaccgccacatcgtactgctcccgatgggtctttcgccgggacagttcctccgcccggcccttcagcagcaccacatccggcaggtccagttcccggcagagctctgtgagccactccacccgtttccccaggctgtccagcagggtcagacggatggtggggtccagaatccgcaggaccaggccgggaaaccccgccccggttcccacgtcgatgagctttcttccccccagggcccgggtgggcagaagggccgcgctgtccagaaagtgcagggtcatcacatccgccgggtccgtgatggcggtgaggttcatcacctggtttttctccagcagccgccggcagtaaagccccagccgctccaccgcctccggcgtgtagggcacccccagccgggtcagcccccggcacaggaggtctctttgctcctctgtcattgtttccacctcaaaacgccatgatttttcccgaggcaaaggcataggtgtacataatcaccaggaacaccataaaggcaatcccgatccacgctttgatccgggtgcttctgctgtacggccgatagggctctttttccgggggatgctcgacctctccctctgacagcggaggctgagaaggggactccgccgggggaggagaggcctccgccggttcctttcgcttttctggttccatcgtcgtctccttttccgtgggggccttccgcgttttgccaatcggggcgggctccctcactttttgctgatgacctccagaccgcccagatacttctggaggacttccgggactttcacgctaccgtcctttaactgattctgctccaccatggcggggaagatgcggctggtggccagaccggagccgttgagggtatggaggaattccggcttcccggtggcctcccggcggaaacggatgttcccccggcgggcctggtagtcccgggcgttggagaccgaggagacctccttgtacccctgcatggaggggatctgaatctcaatgtcataggtccgggccatggaggccgagcagtccccggcggccagcttcaccgtgcggaagtggaagcccaggccctttaccaggttctccgccttggtcaccagctcgtcaaaggcatcgtcagagtcctccgggcgggtgaactggaacatctccactttgttgaactggtgtccccggaccatgccccgctcctccgcccgggcagacccggcctcccggcggaagcagggggtgtaggcaaagaacttcttgggcaggtcggcctcggccagaatctcgtcccggtaaatgctggccagggcagcctcagcggtggggagcatgtagtgggtgcggtcgtcggtggggttctggatcttatagacctcatcggcaaacttggggaactgaccggcggtctccccgcactggtactccagcatgtgggggggcaggatgaactcatatccgtcggccaggtgggtatcaatgaagtagttcagcagagcccactccagccgggcccccaggccggtgtacatccagaagccggacccggccagcttcaccccccgggtgtagtcgatgaagcccaggtcggtgcacaggtccacgtgatgtttcgggggaaagtcgaacttgtggggctccccgaaatagcgcaggggctcgttgttctccttgccgccgggcttcaggtcctcgtcggggaggttaggcagggagagcatcagggtgcggtactccgcctccacggtgcggagggtctcatcgttggccgcaatctggcttttcagctcccccatgcgctggaagacaggcgcggtgtcctccccggccttcttcagctgggggatggttttggagaccttgttctgctcggccttcatctgctcggtggcgaagatgatgtcccggcgttccttgtccagggctaagatccggtccacctcttggtcacagttgacttccttggcccggagcccagccttgaccttctccgggtcttccttgatgcgcttgatgtccagcattgctatcacctcataaattctttccctctgtgtttcacgtgaaacaacagggttggatttttctctctcaaaacagcatggcgtaaatggaacggtaggtatcggcaggggagtccgccccctccaccacagattcggtgggcaggctgctctccaggccggtctcctcaaaggcctccaccagctcccgggcccgggtgtaggaggtccgggtggctgcttcaatctgccgcagccactccagggcctccacctgcttttgctgggcctggacctgctcctccagggcctgcttgtcctctaactcatactggagacgttggttttccagctggaggtcggcaatctcctgggtgttgctgatggagtcgtttaggtcctgaagggccagatggttgcgctgctgcatcacaaaggagatcagcagcagcagaagggccacacagaacaaaacggtcagatagaccttcaccggccggctcttgctcttgggcttgtccgggggcgccggtgaatgggccgggggagactccacgctctgaggcggggtctcctccggcggggtcttgggtgcttcttccgggttcatggttttctccgctcctttccggtgtccagggcggagagggcctgcatgagcccttccaggtcctcctggtcatagtattccagggcaatttttccctttttcttcccctgggtgatggtcacccgccgccccagccccgcggtgagctgacgttccgcctccttatagtagaggcggagcggggagggggcggggcgcgcctgggcaggctggtcctgggcctggagccgctggcggattcgctcctcggtctcccgcacagagtaccccttctccataatctccccggcaaactgaatctgttcctccggggcgggcagggacagcagcgcccggccgtggccggcggagaggttgccctgctcaatgagccattggacctcctggggcagggacagcagccgcatggcgttggccaccgcggggcgggatttgctcacccggtgggcggcctcctcctgggtcaggccgtagtcctggatgaggctccggtatcccgcggcctcctccatggggttcaggtcctcccgctggagattttcaatgaggcccagctccatcacctttcggtcgtcggcttcgatgatggtggcggggacctcctccagccccgccatgcgggccgcccgccagcggcgctccccggcgatgatctgataatagcctgaggccagccggcgcacggtcaggggctggatcatgccgtgctggcggatggactccgccaggtccgccagggcctcctcttcaaaatgttttctgggttggttcaggcccggctccacctgggcgatggggaggctcacagagccccctgtctgggcctggagggagctatcccccaacagcgcgtccagccctcttcctaaggccatgttatccttcctttcctggcagaggattgtgttccagcagctcctctgtcaatcgctgataggccaccgatccccgggaagaaccgtcataggcgttcaccggcttgccgtggctgggggcctcggagagccggacattccgggggatgacggtggcaaagaccttccccgggaaatggcgcttgacctcctccgccacctggagggagaggttggtgcggccgtcgtacatggtcagcagcagcccctccaggtcaatcccggggttcagccgccccttgacaatgcggatggtggacagaagatcgctcaacccctccagggcgtagtactcacactgcaccggcaccaggacggtgtccgccgcgcagagacagtttaaggtcagcagctccagggagggggggcagtcgatgagaataaagtcatactgggatgccaccttggccagggcttccttcagcaggtactcccggcgctccatggggatcatctccaccgaggccccggccagggccttgttggccggcagcacatcgctgtacttggtgtggacaatggcgctctccaccggggcgccgctgatgagcacatcatacaccgtggggaacaccgcccccttgtccacgccaaaccctgaggtggcgttgccctgggggtcaaagtcgcagaccagcaccctggcccccacagcctggaggcaggagcccaaattcacgcagctggtggttttccccacgccgcccttctggttgacaaaggcgatggttttggccatggtctccctccctttccctggtttgcccgtcacagcaaagtcttaccatattcccgggctttatcaacttacagcaggcttaaattatactccattccataggttctttgcaagggatatttgggagaaagccggggtttttccagggaattccaccgccggacaggggagtttcggggaatttcccggtggaaaaaaggatggatgtttcacgtgaaacatccatcaaaggtgaaaggatatgcaaggaaaactcaggccggcccgctgggggctttggccttcgggatccgtatggtgagcaggatgtcgtccccttcctccacccgctggcacttggcgtccacccctgccgagcgcatgacggtgagactatggtccagggtattgaggaaaaaccggacatcccgaatgaacaaaggccggcggaccttcttctccttggcctggtctcggagaacctcctccacgtaacgctcggtccgggagacggtccagccctccttcaccagcagttccgccccctccttttgggcctcgggggtgggcaggcgaaggagagcccgggcgtggcgctcggtaaagccgtttttccgcaggagggtgagtacctcctggggcagacgaaggagccgcagcttgttggccaccgccgactgggattttcccactttggcggccgcctcctcctgggacaggccatagacggagatgagccgctccaacgccttggcctcctcccagaaatccaggtcacgccgctgaagattctcaatcagggagagcagacaggagctctcccgagagacctccaggaccagacagggaacctgttccaggccgcagatcatggcggcccgcagccggcgctccccggcaatgagctcatagcgcccaccgcccttgcgccggacggaaaggggctggagaattccatggacacgaatgctctctgccagctcagtgagcccgtccgggtcaaagtatcggcggggctggtcggggttgggagaaatataatccggcgatatcatggtcacccgggtgctttccatcaaccctcgtctatataaaaccggcatttctctggcctcctttctaagaacatccagagtttaccattttttggaagggaagtcttgggaagcgtgtcgacggaattggattttgtttgcttttggaataagcgggcaggggggcgggggatgctggcgggttttcccgcaattccaggaagaaggacggtgggaacgaggaagaaaaatatccctccggacagttgtccggagggattattgggatcaaaaaaggtccgttggattaccgcttgttggagcgtctccagatgcccatcttctcggcgtccttgatcaggtcctcacggaactggggatgcgcgatggagatgatcttgtccgcacgctcccaggtgttcaggcccttgaggttgatcatgccgtactcggtgaccaggtactgcacggtggaacgggggtcggtgcagatggagccgggggtcagggtgggcacgatgcgggacttcagctggccatccttgcccttcatggcggaggacaggcagatgaaggatttaccgcccttggacagataggcgcccatgacgaagtccagctggccgccggtgccggagatctgcttgatgccggcggactcggcgttcacctgaccgaagaggtccaggtccacgatgttgttgatggagatgaagttgtccagctgtgcaatgacgcgcacgtcgttggtgtagtccacgggagcgcccatgacctcggggttcatgttcacgtaatcatacatcttcttggtgccggcggcgaaggcatagacctgacggccatagtccagggacttgttcttgccgttgatcttgccggccttggcgatgtccacgaaggcgtccacgtacatctcggtgtgcacgcccaggtccttcaggtcggactcggcgatgagggcgcccacggtgttgggcatgccgccgatgcccagctgcaggcaggcgccgttggggatctcgggcacgatgaggttggccacggtgcggtccacgtcggtggggggcacggagcccagctcggggatggaggggttgttgccctctaccacgtaggtcacgtcagcgatgttcagctctgccttgtacaggccgtagacggggggcaggttcttgttgacctccaccacgatatgcttggcacgggcgcacatgtcatacaggtgggagggagccagggagaaggagaagttgccgtgctcgtccatggggggcacctgggtgaagaccacgtccacggggtccaggttctcccggtagaagcggggcagctcggaatagcgcatgggggagaaccagcccatgcccttggcgatgatcttacggtcaatgccggagcagtgccaggagtgccaggcgaagtgctccccggcgtcgtcggccttggcgatctcgggcatccacatggtcacgccgccgcggaccttcacgtcctccagctcattctgacgggcggccagagccttgtccagctccacggggtggttggtgcaccaggtgtagtccacccagtcgccggacttgaccagcttggcagcctcagcggcggtggtcagcttgctttgatacagtgcctgaaaatccatcgttcttgtctccttttctaaataaaaagaataaaactcatactgccccgggcgctggcctgggggagcatcctcctccccggcacagggccgaaaaagaagagggataaaataatcaggtacagtttatcggggttcgaaaaaaaagtcaagcaaaaccttgcatttttcacactttcttcttgcattttcaaccccaaacaccgccgctggtaaaaccgctgaaaaaccatgggatttcctctttttttccgtggtttttttggcggacttccccccttgccagggtgtgcgccatccagtaaaataaaggtattatcctctattttcatcagaagccgtgtggaaaggggcgttttttgtggaagcattgaagcagcggattcagcgggacggaaagatccggggaaacaacgaggtactcaaggtggacagctttctcaaccaccagatggacgtggccttcctggaggagatcggacgggaattccgccggcggttcgcaggatgtcaggtggaccggattctcaccattgaggcctccggcatcggcatcgcctgcctggccgcgccggcctttgaccacgtgccagtggttttcgccaagaagaacaagaccaaaaacatcgacgggaacgtgtatctcagccaggtggagtccttcacccagggcaagcgtccctatcccattttcgtctccaaggagtttctgcaccccggggaacgggtcctgctcatcgacgatttcctggccaacggcagcgccctgagcgccctgattgacctggtccatcaggccggcgcccaggtggtgggggcgggcattgtcattgagaaggccttccagcccggcggggccctcatccggggcaagggcgtgcgggtggaatccctggcccggatcgaaagcatggacgaggaggacggcatcaccttctgtgactgagggcagtctgacggagggggacggtcttccgtcatggcgcctccgcgcccgcccgctccgatcccgccggcgtcatgtccgtttgtttccaagcggccgccggaaaacccggaaaatagattggttctgtcaaaaaggcggtcagtctgtccgactgaccgcctttcgtgctgtccggcctcagcccgccgccagctgctggataaaccgacgggtccgggccttctcctttccactggggtctgcaaaacgaaaaaagggcagaaaaagagggcctgcgtaaaccactcgccggccctgtttttccgaaggttaaaaaatgaaaagaagctttcttgactcttgcaaggatatcttaccaaggacttgttacaaaaaaaggctacaaatgttacagaatctttaagttttcgggactttttttccgcacctgggcaaagaagtcctggaggagctgggcgcactcctcctccaaaatatgccccacgatcttggggtggtggcggaagtcctcctcaaagaggttgaggatagacccgcaggctccgaagccggcgtctttggccccgtagtagagctctggaatccgggcggagaggatacccccggcgcacatggggcagggctccagggtgacatagagccgggcgcccttgagacgccagtccccatgggaccggcaggcgtcggtgatggcggccagctcggcatgggccagggggcttttgtcctcctcccggcggttgcggccccgaccgatgatctgaccggcccggtccacaatgacgcagcccacggggacctccccggcggcggcggcctcccgggccagggccagggcctggcgcatgtagtcttcgtgggtcatgtctctgcctcctgtccgtttctggccctattgtaacggattgcccgcctgggtgcaagggaaatgtgcttttctgcgggtgtgtcggcctgcttctgggcaggggatggggaggttgtggggattggcccacgccgttggaacggcagggaaccttggcttgcccagccggggccccatttcttgggaagaaatgggggaaagaacccccgggggaggaggttcctcccccgggacccccttctctggtggggttatatgaggaaaggctgtacttctcacttgttacctggcctgcggccctcacagcgaaaggctcgtaacggcccgcccaccggctgggcgggctgggaatgtgggcaggtgccctttgggagaaggcagagaaaaaccttttcgtttcccacttgttcctcccgtctatgaaccacctctcccgcccgagccggtgggcgggagaggtaagattggggttcttggataaaggataggaacggactctcatctgggatcagataatttttaccgttatgaacaaccttgaaaatcttcatcttttgttcacaaaaccgcaaaaggacatccaacaaaatgttggatgccctttcgtcttcattcctaagtagagcattgtttcactaattatccagtaatcttggttctcatcttgatcttcctaacaaggagaagtaggtagatcacaaacataaagagagccaaaaagacactgaaaggaaaatcccttaaaattatggtgtcaatttcatatggaatggacctcaaagcaataacaggtagcgcaataaaactttctgctaagccaactatcaagcatatccacgaaattttctccgcgtttttcaaaaagctttgatgtcctaagaggagaagaagtgcataaataaaacacaaaaaacacaatccaacaaattttcccatttggaaagattgacgtgggtctcccaatggatctgcataaaaaacgcaccacaaaaagggaatttctaaccaaggcaataggactgctatcatatttggaatcaaccattcattttttctcatcactcattacctatgatcagggaaattaaactcgacagtgacaatgtaatatccacccattccaagtacttgacttttcacttcactccatgcccaaggagccgctatcgtaactatattttatgtgcaaaatttacatataaatagtatcaaaattcttttttcttgtcaagtagagaagttacagtctctatttccctatacctaaaccaaagaaaaatggaaagtatggagacgggcaagaaggagagattccctgcatgagatacttcccgctgacttgcccaacaatagaaaacaacagcctcttttactcaaaaaaggctgttgtccttttattgacccagtaaaacttatggcggcagtccgccccctttgctcccggcccccatggcctgcagggccgccaaatagagcagcagtccaaagcacagtccccccaccgcggcgggaaaggagaccaggccggcccgaagcagcaccgtctccatcaaatccccgcaggaggccgccaggcaggcggccagggtgggggcggtaaaccaggaaaacaccggcagggaaagcccaatttcccgggaaaccacccgccagctgagcaccgctcccagcagggctgacagggcaaagctgaaggcatacccccccatgccccaccggcccaccgtcaggcaggtgagcaccagctgcacactgtccgcggccagggcgattcccgccgaagccccctggcggttgaccccgctcaaaacgcaggccgagagggtctgccagcaggagaagagcacccccagggccagcagcgggagatgatcccccacccggtcatcccggtacaggctctgcccgatggccgagcccagcaccgccagcagggccagggcgggaatgaggatcagattggccgcccccaccgaccgcttcacctgccggcggatggcctccttctgtcccagggcggaatactgggagagcttgggggtgagcaccagccccagggcgctgagaaaggccgtgggcagcaagagcatgggcagcgtcatgccaaaggtcacgccgtaggccgacaccgcctccccctggtccattcccccctggaccagcagccgggggatgagcaccgcgttggccgaggagatgagattccccagcagggccgcaaaccccaggggcagggcgatccgcccaatcttgccccggagggccttgggggtcagtttctccccggacagacccgccggaggccccaagtacacccggaagagcaccgtctgggtgagggcggagaccacctcgcacagggccatgcccagcacaatggtccccacggccttctcggcggtgtcgggcgccaggcgccacagcagggccagcaccagcagggaccggaggacctgctccgccagctccgtgatggcggcggggtagacccggcccgtgccgtaaaaatagtgtttctggagattttccgtccccgtcagcagcagacaggggaccaggaggatgagccccagctgggttcttgcgtcccccaaaagatacaccgaggccccgtccgaaaagagcagcagcagggaacagggcatcagggccagcaggaaaaacagcttcaccgcctggccccggacctggtaaatggcccgctggttccccagggcctggtaccaggcggagagattggacaccgccgtggtcagccccacagaggtcagggacagcagcaccgaatacaccggcaggatcagctgatacagccccaaaatctccgcccccgccagacgggtcagcccaatccgatacacaaaccccaccagctgggacaacacccccgtgatggtcagcaccgccacaccgcgcacccgctcacctcctgttcctctcactgtatgagaggccggagggaaactatgccaaaaaaccgccctccctgtgatgggagggcggaagtgtgtactatgctttccacctttgcagcagccagagcaccgcaatcagattcagagagataaaaaagaataccgtcccttcggacaacgacacaacaaagtgcgactgagctatcgcctgccaggtcatgttatcggacaaaatatgctcgaagagccgcagaattccatattccaagagccccaaaagaaaagaaaacaggagggagaggggataggagaaaagcatcagcaaaaagcagggccattgttttttcatatcgttcagaaatcacccgcctatacgacaattcacataaaataacacctctgtactcttgtactttaacattaggaagattgatttgtcaacaaaaacaccagtgtattcggttcaatttttgtatgaaactgaaaatacgatttctctctccctcacgaaaagcagaaactgcaaggggaagcttcccttgctgctgcaagagaaacaaatccctttcttccggaccctttcccagatttcccgcctccgactcctcacaggaaagctggagacaccagaccttgggaagaaagaaaacgcaggctcacttgcaaaattttcaactttttacccatatgaagggatcggtgcaggaaaggccaggggagtctatcatttttacggaaattggttgttttctctcccttttttcggtaaaacggcgaaaaggtttgccttgtcccttgggcgaaaatacagtatactatttcgtgaagtatttatatacaggggtagcatgccctgtatgaccaatgttaggaggaaatccctatggcatttgttgaggtcaccaaaaaggaccacatcgcggttgtcaccatgaaccgccccgaggcgctcaacgccctgaacaaggccgttttcacggacctggaggtcgccctggacgacgtggaaagggacgatgaggtctatgttgtcatcatcaccggcgcaggccgggcattcatcgccggcgccgacatcggcgagatggcacccatgaatgtggcggaaggtctggccttcagtgagctgggcaaccgcattctcatgcgggtggacatgatggagaagcccaccatcgctgcggtcaacggcttcgccctgggcggcggctgcgagatggccctggcctgcgacatccgcatcgcttccgagaaggccaagttcggccagcccgaggtgggtctgggcatcatccccggcttcggcggcacccagcgtatggcccggatcatcggcaccggccccgccatggagctgatctacaccgccgacaccatcgacgcccagcgcgccctggagatcggcatggtcaaccacgtggtccccgctgaccagctgatggacgaggccatgaagctggcccagaagatctgcaccaacgcccagaaggccatccgcgcatccaagctggccatccgccgcggcattgactgcgacatctccaccgctgtaagctatgaggccctggctttcgccacctgcttcggcaccgaggaccagaaggaaggcatgcaggctttcctggagaagagaaaggaaaagcacttcaagaacaagtaagcttttctctccctttgcttttttccgtctcctcccgtggggagggacaaccgattgttttctaaattataaaattggaggaacaccacaatggctatcaataagattatggtgctgggcgccggcaccatgggtatggggatcgctcaggttttcgctgaggctggcaagaccgttctcgtccgcgacatcgccgacgctttcattcagcggggtgagggcgtgctgaagaagaacctggagaagaaggtcgccaagggcaagatcaccgaggagcagaagaacgacatgctctcccgggtctccttcaccctggagctggccgacgccaaggactgcgacctggtggtagaggctgccatcgaggttctggacatcaagaagggcatcttcaaggagctcgacgagatctgcaagcctgagaccatcctggcttccaacacctcctccatctccatcaccgccatcgccgccgccaccaagcgccccgagaaggtgctgggcatgcacttcttcaaccccgcccccgctatgaagctggtggaagtcatccgcggcgcccgcaccaacgacgagaccttccaggctgtctacggctgcgccaaggagatcggcaagaaccccgtcgaggtgggcgaggctcccggcttcgtggtcaaccgcatcctgttccccatgatcaacgaggccattatcgttctggagaacggcattgcctccaaggaggacattgacaccgccatgatgtacggcgccaaccacaagatgggccccctggctctggccgacctggttggtctggacatctgcctggccatcatggagaccatcttcaccgagaccggcgactccaagtatcgtcccgctctgaccatgaagaagatggtccgtgccggcctgctgggccagaagaccggcgagggcttctacaagtattgatccctctctttggtttgacctctatatggaaccctccctgcggcagagccgcagggagggttttttgctgtaaaaaggagacaatccccctttcagaaagggaagctctgttgacgaggagaggcagatatgttatgttcaaagaaagcggggggcccatggggcggaaccagacgacgcaggcagtcccaaggggattccgcctcccgtgaggatgggcttttccaccggcacagcaaccttacagaataaatgtttaggaggtaccggcatgaagcatggcaaacgatttctatggattgtcccccttttctgccttctggcggcctgcggcgggcagggaacccaggcggagagtgcccgctgggacacctttcaccacgaaggggacaacgtgcagctctccctgggcatgacccaggcggaggtggaggacaaacttactccggcagagggttcctctccctcgacggacacggacacggtgatatacggggacaccccggaggaccgcattgccgtcacgtattacgacggtgtggtcaacaacatctccctggatgaaaccctccagacagagaagacctccaactggtctctgcagggagggatcaccgtgggaagctccaaggaagaccttgacaaggtctatggtgcatgcaccatgtccaacgaacaggaccagtattttgtgtactactatgattccagccataccttattgacagaagaccatatcgacgatgtggattacatggtctcattcatcctggaagaggatgggcttcttgcctgcgccatcggctctgcggagccggcgctggagcccagctccagtccttaacctccgcagacaaaagaggaaactatggaaacggcccccgtcctgatgggacgggggccgtttttcaaacgctgttgggcttagggggaatctttgccgaacagacgtcccaacagccggtggagggcggagggcttctcgctgactgtgggagcctgctccggccggtggagggagacccgcatcagctcctcctgactgtccacccggacggtccggatctctttccgcagataggcgccgctgggctgcagaaaggaggccttggcgttgtcctggagctggaggtccaaaatataccgcagctgctcctggatttccctgtcccagatggggcaagcgatctccacccgccgctggaggttgcgggtcatcaggtctgcggaggcaatgaaatatttggcctggtttccccggccaaagacatagatccgggcgtgctccaggtagcggcccacaatgctggtgacctggatgttctccgtcttcagaagcacccccgggcggatgcagcagatgccccggatgatcatctcaatctgcacccccgcctgggaggcctcccggagcttgtcgatgatctcccgctctgtgatggaattggccttgatgcagaggtagccctggggtcccttgtcaatctcctgctggatcatggcgcacagctgggactttagaccgttgggggccaccagcagggagtggtatcccccctccaagttgtcggtgagcatgttgcggaaaaaggccgcgccgtcgtccccgatgacaggggaggcggtcataacgctcaggtcggtgtacagggcgctggtcttttcattgtagttgccggtccccacctgggtgatatagtgggtgcccttcttgtcccggagggtaatcaggcagagcttgctgtgacacttaaagttctccatgccgtagatgaccttgcacccggcttcctccagcattttggaccaggcgatgttgttggcctcgtcaaaccgagcccgaagctccatgagggccaccacctctttcccgttctccgccgcccggcagagaatccgggcaatcttggaggtggaggccaggcggtaaatggtgatcttgatggaggccacgtcgggccggtccgccgcctcttccagcaggcgcaggaaggggtcaatggaatcaaagggaaagaagagcagccggtccttccggcggatctgctcaatcatggactcctggcggtttaagtcctccggccaccggggatggtaggccgggtaggtgagcctggcccgcaggtcgggggacagggctttctccaggtcatagacatagcccatggacaggggagcgctgtcgtaataaatctgatgggtctccacttggatcacccgctccagcagggcgagcatctcctgggagggccgctggcccagctccaggcggacaatggactggttggcccgccgtttgaggagcttggtcatcagcaggcggaaatcgtcctcactgtcctcaaatttttccgtgtcaaaggtgaggtccgcgttccgggtggcgctgatgacgcaggtctcctccaccttgtattttccaaagagggtaggggcccactgacggaggatggtctccaggcggagaaagcggccccgggtgccgggcaggagaaacaacgggggcagcgaggtgggaagggggataaagcccagggaggtcttgccgcttttgctccgcagcagggcggtgatatacagcgccttgttgtccagatggggggtgggatggcgctggcccacgatctggggcgagagaatggggaggaccacagagtgaaagtagtccttcacctgggcccgctcctcctgggtcagctggtcataggtcaggtccacaatgccctcctgggccaacagaccgctgacccggttatagagctggcccttgatctctatgaggccgggaacggcctcatagaccgccttcagctgttcccggggacgcatgccgctcttgctgtccacctcctccggggagaccgccgccatgtccaccaggctgcccacccggaccatgaaaaactcatccagattgctggcgaaaatggcgataaatttcagccgttccagggcgggaacggtctcgtccgccccctcttccaggacccggcggttgaaccggagccagctgagctcccggttttgggtataggtataatcggttacgacgctttgcggatcttttggcatagatagccctcccgtaccccatatttgctgacgatcatctccccggctccaaaaccctccaccatgtggcggaggatcagcaggccggggatcatggtgtggatgcgctccggctccacctttaagatcaaatccgccgccgccttatgggaggagcacagcagggcgctcacctgctccagctggcccacagagacccggttggtgtcctccggcaggtggcacacccgtttggccagcttcagggccgcccgggcggtcccgcccacacagaccagggggagaccctggcggacgggcccctccaccaccccccgggtggcctggcggatggcctttttcatgctctccaccgcctgctggttgggcagaatctttttcacccagtcccggtagagcttcagagagcccacgggacagctgaccgccgagaccagctgaccatgggcaaagcggaccacctccgtgctggccccgccgatgtccacaaacagtccctctgacaatgccagctcctccatggccccggcgtagcccaggcgggcctcctcctccccggagagaacctcaatggcaaagccggtgccccgctggatctccgccaccgcctgggcggtgtttcggatatttcgcagggaggccgtggcaaacaccgccacctgggggatgttcagggcacgcaaggtgccccggaaggaccgcagacccaggatggcccgggtgatcccctcggggctgagcgccccttcctccacatagccggccagaccggccatgatcttatccttaaagagaatggtgaaagtgccggcctccgtggtctcatagaccgacaggcgcatggaattggagccgatgtcgatgactgcttgtttcatggtttcctcccgacctgcctgacacacagacaggaattcctatcttttagcatacttggactctgtaaaatcaaaaaccaattttctgttaaatgccggcatatctcactccccggctcacgccggcgggggagaggcggggtcggcctgcttggggtttacatggaccatacagtgcttcaccaggggaaaggcctgctcaatggcctcgtggaccgactccgcaatggcgtgggcctgggacaaagggagatcagcctgggccgcgatctccgcgtccacgtagattttcgccccgaacaggcgggtttgcagcaggtccagccccagcaccccgggctggtccagaatgacctgggtcatctgcgccagggtttcctcatcacaggaccggtccaccattttatccacggcgtcccggaagatgtccacggcggccttgacgatgaaaatgcagatcaccacactggccacgctgtccatcactggaaaacccgccagggaacagacaattcccaccagggccccgatggaggagaggctgtcagaccggtgatgccaggcgtccgccatgagggcgtcggagtgaatcttcttggccgcggcccgggtataccagtacatccactccttgaccacaatggagaccgccgccgccacaagggccagcatcccgggcaccgccaggtcggcataggacccggccagaatggttttcagccccttccagccgatgagcagcccggtctccagcaggatcagggccagggccaccgaggccacgcactcaaaccgctcatgtccatagcggtgctgggcatcggcctgcttgctggaaatctgaatcccgatcataacgatcagggtggaaaacacgtccgaagccgagtgaaccgcgtcggagatcatggcccccgagtgggcgaacacccccgccagaagttttcccgcggagaggacgagattcaccgccacactgaccagggagacccgcatggccaggcccttggcctgctggggggagaggggcgattctgctttggaagattgggtttgcaagggaatacacctccatagacaggaagccacccgcgcataaggggcggatggctttccaaactgcacttgttggaaggaactcagccctcagcgggcggggttcctccaccactctttcggtggccttttttatgccagtgagaacggccctttctctcctccccaggtttggtccggttgggcttttccgggtggggatggggattggacctgttccggctccggctgttccggtggcggcggcggacggcctcctcctgatagagtgcctcctccgcttcggccgccaggccctggagctctgtctccaggggaaggggctgctggctcttgccattgcgatggtggcggggccggtggcgggctttttccttctcccgctccacctccgcctccaaggcccgctccgcccgttcggcgttccggccccggtcaccccggcggcggcggttgggggcgtggtcgggctgggcctgggtaggcgtcccgtgttcggccagaaactcatccaaggccgcggccagggcggcctgctcccggcggtactggtcctccggggactcggtgaccttccgcagcttggccagctcctccttggggggctgcacatagccctccgggcgcttgcccttgccgctgcggaccactcggatctcactgttgtgataggtcttcagggtgtccggggcgtcgtccaggcggacccgcaccttttcccgcagggtgttgacgctgatgatggtgcccgccccgtcgggggtctccacaaaggaatccatacggggggcgtccttcatcaggtcctcataggcctcctgctcatacttcaggcagcacatgagccggccgcaggtgccggaaatcttggtggggttcagggagaggttttgggtcttggccatcttgatggagaccggctggaactcccgcaaaaaggagttgcagcagaagggacggccgcagattcccaggccccccagcatcttggcctcatcccgaatgccgatctgccgcagctcaatccgggtgtggaagaccgcggccaggctcttcaccaggccccggaagtccacccgtccgtcggaggtgaagaagaagaggattttggtcccctcaaagctgcactccacgctcaccagcttcatgtccagtttatgctccaggatcttctcttgacaaacccggaaggcatagacctccttctcccggtttttctccaccacggcaaggtcttcctccgtggccgcccggaccacggggcgcaggggcgcggccagctcggcctcggccaaagtaaagttgccccggacgcactgggcgtactccagacctgaggcggtctccacaatgagaccatccccagggcggcagaccatgccctgggggtcaaaataatattgtttgccctcgctgcgaaagcgaacgctgataatctctgccatagttttctcctttgcttacagcgcggcggcgatccagccgctcaaatggccggggctgacgggaaactcacaggccgcccgaatggggaccaggcggtccagcaccggcagcaggtcgggccgccggggcagttccgccgccagccgggacagggcggcctccaggaggaggggaaattcctcccggtccttcttctccagggagaggaggaagggcaggcggtcccggggagaggccccggtgaggatcaggtcggctaaggtctcccccgcctggtcggcctgccgggtctcttctcctggagcccggagggtttcgcaccgggaccggatggtgggcagcagaagcccaggctggggggagagaaagaggaagcaggcgtaggcgggcccctcctcgatgagcttcaacagaatattctgccccgtgggattgagcagctcactgtgctccaaaagatagacctttttgggggcctcattggggcggatataggcatcggaccgcagggcccggacctcctcggccttcaggccctccccctctgggtcggcccggataatatctggatgaattcccaggccggccttccggcagcccgggcagtgcccgcagggaggggtctccccggtacagacccaggcggcggccagggcctcggccaggggacggcggttttcccccaccaccagataggcgtgggataagttgcgctttgccatgcgaatccgcagatgggctgggacctccatggggaggctcacctccttttctccacaaaaacaggggaacttggggaaagacgggggctcatcccttggaaaaagcccgccggagggcggcgtaggtcagttcataggcctgcttgctcacctccgcctcggggacactgagctcaaagcagtgatagcagccgggaaacacatggcactccaccggcaccccggcggccatcagccgggaccaataggtgaggttctcgtcccggcccgggtccagctgcccgatgaaggagaacaggggcggcaggcccccaaggtccttggccagggcgggggactcatactgggtgggcatgtgcccggggctgagcaccttgtcccaggagatccggcagttgtcccggcaccagaccttccggtcggtgatctcctgggaggagggggtctccagccggcagtccagctccccataaaggggaacctgcaggcagagtctgggtcccttccggtcccgggccagcagcgccacggcggcggccaggttgccccccgccgacagaccggccaccgccagacggtccgggtccacccccagggtctggtggttggtccaaacccacagcagggcggcgtagcagtcctccaggggggcgggcatcttccactggggcgccaggcggtactccaccgagaccaccacgcagcccacgtgctttacataccgctggcacaggtcctcctgccggtagaccgtgccgaagagaaagcctccgccgtggtagaagaacaggcagggcaggggggctttctcccgctggctgggggcgtacacccgaattttcacctggggcgcaccgtcgggaccgggaatcatctggtcccaagccttcacctgggggtcctcccgcaggttggccagttctgcggcgttgcacttggggacaaactcctccaggtgctcaaagtcaaagccggctgaggcgtcataccagtcccgcagctggggctggatacggtcacggaatgtcatggcaatccctccttgacagcggggccagagggccccttttgaaagcaaaacggcggtggagcacagtcctcctccgccgtttcaggtcaatatgcgtgcttgccccgggagaaggccaccaccgtgcggcggttgggctcggttcccgtggaataggtgatgacgtcgggatagtcctggagggtctcgtggatcacatggcgctcataggcgttcatgggctccagggtgatattccggcggtatttgaccactttgacggcaactttattggccaggcgcttgagggattcctcccgcttggcccggtagtgctccgcgtcaatgtgaatccgcacccggtgggtccggccccggttgaccgcgtagttggtcagctgctggatggcgtccagggtctccccccggtggccgatgagggcgcccagcttcgggccctccagggtcacaagaatcccattgtcccctttgggggacacgtggatggcggcctccacccccatgtgggccagcaggccggagagaaaggcgcggattcgctcctccaggtcccccggcttggctccgggcacaggggaagccggggcctctgctttggccggtcccttgggggcggcctccgccggacgggccggggtcgcggccggcttcggctggggggccggggcgaagatctcctccaccggggagaccggggcctcctcctgggagacttcataggtcaccttgaccttggccggagagctgccaaaccccaaaaatccattcctcgcccgctccaggacctccacggaaacactgtcccggtccagccccagctgggccagggcattctgtatggcagcctcttccgatctgcctgtggcttcaatccatttcaacatcaggctcgtctctccttatttctcgtcgttgtcctgttccggctcttccaggaaggattcctccacgaagccctcctcttcctccgggacgggcgccggctggggcaccggtttctccggggccgcggacgtgggggcggcggaaggtttctcctcttgggcggcctgggcgggtttttctgtcttggtgggctgattgggctggtccttcttgcccttcttccccttggccttggcggtcttctgttcctccgccaggcgctgctgctcctcctgggcctgcttggccagatcattggggtcctggtaggggaaggtggggtagcgttccgggtcatacagccggccccgggcgtaggcccggataccctcccggctggcggtggcgatgctcttgttcagcttgcgctccatctgaatccggcgcatctcctcggcggcctttttcttggcctccgcctgggcctgcttttctcgtttgacgcgctctttctcctcttcccgacgcttgaccttggcctcttcctgctttttcaggaaggagcggaggaaggggatgttcagcacttcctgcagcatggcaaacaggctgttggcaatccagtacacacccagggcggcgggcagggtgaagcagatccacagggagaacaggggcataatgaacatggtcatccgggtggactggtccatggttctccgggtgcccaggacctttccgttgatgtggttggtgacgatcatggacaccacgcccagggcggcggagatcacggggatcagccagaggccgaaggcggcgccgatatcgtcggccttccagaacatgaagtggggggtctgagacaggtttacccccaggaaggtaaagtcaatctggggcatgttggccagctccggcaccgccgcgacaatcttgtcatggttcaggaagacatcctgggccatttggagctgctggtttctgtaatccagcacgtttccatacagcaggttggagaccacgttgaactgatcctgggtcatgttcagcagataggtcaaaggctgccggacgatggcgtacagcaccatcagaaaaggcaggggaaggaaggaccagagacagccggaggagggcttgaccccttcctcctcatagagcctttgcagctcctggctatatttcacccggtcccgggcgtacttttgctgtaataccttctgcttttccgccaggccgctcatggagagcatgcccttgcgccccttgaggaagatggggaacaggatcagacggatcaccagaccgaacagaatcagggacacgccatagctgccggtcaggtcgtagaacagcaaaagcagtttggcaaagggggttaaaataatactcattgcagcgcctccaggttggatggatgccgccggcggtcaccggcaggcgaaacaggctgtcccggatcaggggacggggtcatactcaatgctcttctgccggtgaaagggattgcatcggagaatccggcgcagggcaagaaagccccccttccaggcgccgtatttttcaatggcctccaaagcataggccgagcaagtggggatgaaacggcagcaggggggacgggcaggggagatgaccttccggtaaaaccggatcatccagagcagaacagccttcatggcttctctccctccgcatcagaaccttggggggagagaagctggagcttttttgccaggcggagaaaatcccgttccagttcggcgtaccggctgtaaaccgcccgaacccgggccacgacgacaatatcgtagccgggggagagccggtgctcctgcaggcggtagatttcccgcagccggcggcgcactcggttccggaccaccgcgtggcccagcttggttcccgtggtcaggcccaaccggttttcccgccggccgtttttccggcagtacagaaccatggtgggcgaaaccgcgctccggcccttggcgtagagccggcggaacactctgttttcctttaaggaaacggtatacttcacggtgaaattctccttgctttgaggacagacagcgaacggggagggcccgcctcccgccatcggacaaggccggccgggagaaggcccgtccagcgcccgatgcttcgcaggggcggtggaatctgattccccgccccttgtatgtactctttatgcggttaaccttggcattagtgggtcagccgggcacggcctctggcgcggcgacgggccagaaccttgcgcccattggcggtggacatacgcttgcggaacccgtgctccttggaacgctgacgctttttgggctgataggtacgaaccattctgatacacctcctgtatcgatttccagcgggaattcccgccaaccacaacggccgaattgccccggccgcggttgtcaaacatacacgcaccatggcagaaagccatgattacatgaatgatattatagcggaaaagaatcctctgtgtcaaccttaattttcacctggcagggggtggggttgggagaggaaagcaacgcaagatattgtgggggatggctgtttttgcgggggctttcagattgctctcaggctgtgctttgggtggaggttctttttccggcgccgttggaacgggcgggaaccttggcttcccagccggggccctatttctttgaagaaataggggaaagaacaccaaggggaaggaggttccttccccttggaaccccattctctggtgggaggaatgggggaaggtagttggtcaggtaggggcctggcctgcggcctccaagaccaacgcctcatggcccgcccaccggctcgggcgggcgggagaagtggttcgttgacgggaggaaaaagtgggaaacgaaatggtttttctcctccttttcccaaagggtacctgtccacgtccccagcccgcccagccggtgggcgggtcgctacgggcctttcgctgggagggccgcaggccaggtatcctgtaagaggtacagcctcccccacacaactccaccagagaagggagtccagagggaagaacctcttccctctggggttctttcccccatttcttcccaagaaatggggccccggccgggtaggccaaggttccctgccgttccaacggcgtgggtcatggaacaacctcctcccacagcaaaagaaacacctgcttgccaaaaaataaggaatctgatataataaactgattttttatcgattgttctgaaggaaagtcaacaggtccatgaaaccatgggcctatctcgccgtggcaggagaaccccggcagacgttggaacgagaaagaaggaggaagcccatgaactccgccgccgacatttgggagcgcgtgctctctctcatgcagcagaccatgaccgaaaccaccatcaccacgtggttttccgacgcggaacccatcgccctggatgaaaaccggtttattttatacgtgcccacggactttaagcgggaaatcgtggcctcccggtatataggggatatcaagaaggccctctatgatctcttctccgcggagctggaggtggtggttctcagcgaggaggagaaggagaagtatggcaaacgggagcctgtctcccgctttctgccggggacggaggagtacacctttgaacggttcgtggtgggcaactccaacaaattggcccacgccgccgccctggcggtggcggagcatccggcggaaaattacaaccccctcttcatccacggggaatccggcctgggcaaaacccatctgctctacgccatcgcccacaccatccataaaaatcatccagactataaaattgtctacatccggggagaggactttaccaacgagctcatccgggacattcgggcaggcaagaaccaggagttccgggacaaataccggtcggcggatgtcttcctcatggacgacgtccagttcatcgccggccgggactccacccaggaggagatgttccatacctttaacaccctttatgaggacaaaaagcagatcgtctttaccgccgaccgtccccccaaggagatgctccggctggaggaccggttaaaaacccggtttgaatggggcctgctggcggacatccagcccccggactatgagacccgcatggccatcatcaaaaacaaggccatccgcatgggggtggagctgccggaagaggttctcatctatgtggcggaaaacatcacctccaacgtgcggcagattgagggaacggtcaagaaaatcctggccttccgggaccttttgggcagcaacgtggacgccagctccgtcacccgggcggtgcgggacatgtttaaggagacctcggacatcctccccaccgcggaggtcatcattgaagaggtgggcaagttctacgacatcgaccccaacgccatccggggccagggccggaccaaggccaccagctgggcccggcacatcgccatctatctcacccggcacatgaccaaactctccctgaaggacatcggcaaggagttcgacaaccgggatcacaccaccatcctccactccatcgaccgggtggagaagcaatgcaaaaccgacccggagaccaacgaggtcatcaaggacatccgctccaacatcaacgaacgatataactgaaattcctcccctttcccccaaaatattccaccgtattttgtggataagtggaacaagctgtgtggacaaggggaaactttccacaaagggaaaaaacttgtcccattctgtccacggagccatgttgggaaacaagccctgtcattcctggattttttcgggttttccacaaaaaatttccctactgctactactgcgacctttctttcctgttctccctattttgcggggaaaatcgggaaatgacgattccaacacgacaggaggtctttccatgaaattcagctgcgaaaaagcactgctgcaaaacgccatcctcaccgcctcccgggctgtctcccccaagagcaccattcccgccttagagggactccttctggaggccgaggactccggcaccgtcttcctcaccggctataaccaggagaccggcatccgctccgccatccaggccgatgtcaccgaggccggttccatggtcctctccgcccgtctcttcggtgagatcgtccgaaagatgcccgacgacaccttgctctttcaggaagaggccctaaaggttcacatcgcctgcggcatgagtgaattcgacctcatgggcatcgaccccgaggactttcccgagctgcccaccgtggagtatcaaaactccctgtccatcccggaacagaccctccgggccatgatcggacagaccctgttcgctgtcagcgacgacgagagccgcccggtccacaccggcagcctctttgtggtggatgaggagggactcaccatggtggcggtggatggattccgcctggccctacgccgggagccggtggcggagaagaacgggaccttcgagttcgtcgtccccggggcctccctcagcgaggtggagaagatctgccgggagaccgacgagctggtgggcatccaccagggcgcccggcatatcctgtttaagatcggcagcaccatcctcatctcccggcggctggaaggggagttcttggcttggcggcaggccattccccggaacaaccccatcaaggttaccgccaacaccaagcagctgctggcctgcatcgaccgggtgtccctcattgtcagcgagaagctcaagagccccctgcggtgcgtcatcggagagggcgagattgacatgaccaccaaaaccgccctgggcaacgcccatgactgctgcccggtggagggcaacggaaacggcctggagatcgggttcaacaacaagtacatgatggatgccctgaaggcggctcccaaagatcaagtgaccctggagctgtccagccccatcaccccctgcatcatcgtcccggcggagggagaggagaatttcctgttcatggtcctccccgtccgcctcaaagcagatttctaagcaaaataacggcgtcgtacttcgcatctcccttccctccctgctttctcctcccaaagggtacccgcccagccggtgggcgggccgttaccagcgtttcaacgagagggccgcaggccaggtaccaagtgagaagtacatccttcccccacaccaccccaccagagaagggagtccagagggaagaacctcttccctctggggttctttcccccatttcttcccaagaaatggggccccggctgggtaagccattgttccctgccgttccaacggcggtg

SEQ ID NO: 2226 - DNA, 98822 bp, KLE1738
gataataagagattatcctcactcctacaacaaagacgggtatgccaaaccgatggcatacccgtctttgtcacgcaaaatgtattttatttctggggtgtttttctaatagaatatcccgctgttttttaccagccacatgggtgtagatttgtgtcgtcaaaatggagctatgcccgagcaaccgttgaatatatcgaatatctacgccttcttccagtaaaagtgtagcgaaggaatgccgaaacatgtgcggcgtgatatggctctccacgcccgccagtctgcagtacttattaacgatgcttcgaacggattgatcggataagggtttgtgcagtctatttacaaaaaaagcaccactctgcgttatgacatctttgtacgcctcttgataacagtggagtgcacccaaaacatttggatttgcgatttgcacaaaacgctccttggcacccttgccgtagattttaatttccccttcttctaaacgaacatcatcgtacccaagtgtgcacaactctgatactctgactccagttgcaaataggagttccagtacagcgatatcccgcaaggttccatcccgttgtatttgtgaccttgcggtttccttttgctgataggcggatgccaaaatggatgagatcaccgaaagcggaattgtccttggcaggatcaccgggatagctaatttgatccgaagttttgaaaacggattttcctgtaccagcccttcatactccaagtagccaaaaaacgctttgatactggcaattttgcgtcggattgttttcggcttatattgctggtgtaacctggagatatatgccataatctcgtttcgtgtgaacttaaagttcttttggcctgcaagttctaaaaattgagccaagtcgattcgataggcttttatcgtctttgggtcaagccctttttgatactgacagtccagtaaatactgagaaatccactgttgtaagtcacacatttgtgatgcctcctttctggtatggagacattatcatacaatacaaaggaatctaacgcaaaagacaaattcccttattttatacttcattgcttttgaaattccacgcgattaggttccatgttcttcgcctcctttgcaaagcgcagacaggcgcaaaggaatgattagaagcacttatgtgttttgaccatttatcattgtggctgtaatatcccaatacaaggcaaataaagaactgcccccggaagggagcagcccgtaacaaatttgcagttggcaaaccattcatgcgtcttatgacgcaactgtattaggcccttatagggcggctggtgtaagccaccggctctgccggtgttcttgactcgttgaccaaaacatggccccaaatgtctactacttagggctatacttggtctattgccttacccactgcttttattacgcttaaacatctttattcaacggttggtaagacagccatggggggggatagaaatcatggggcggccatggcccgccggaacagatgatatgtggcggtaaagtagcagagcagcagaagaagaaagctgccataggtcagcgcggagagaaggaacatgcgggacaggggcaggtaagcggtaaaatcctcgtagttgatcccgatgaaaaaaaccaagatgcccaggctgcacagcacagcggcggccacaggcaggccgaaccagaagagcatctgccgccggatcacctggtcccggtcctctgccgccatacccaggtggatggcagtttgaaagcgccgccgctgctggcgggcatcggtgagctgctggacagccagcagggtgaggcagctgatcatcaggatgcccccggcgtatgtgccgaccagggacagcaggagcaggttggagacgccttcgttggcctgcagggtgtgcagacggacgtagaggttttccggggcgaagcggcctaagctctgctggtgggcggcggcgatctggtcaaaggactgggcgaaggagtaggagagaggctgtgccgtgttggcggcgtagaaggtggtggccatggtcagtccctggcaggcggcgtcgggcaaaatatagacggcctctgtctggctggtgaacagggagattcccacggagtcctggcagtccagtgccggcgctttgtgcaggcgggagccgccggcggtcaggacgggggctgtctgctgaaacccgtcgatggtggaggcgggggtggtgttgctccaggccacgccgtattgatctgcggccagggaaaggggcggcaggcccgaaagggcgcgtagctggttgtaggaggagagggagaccgccagcagaggcaggtcccggtccttgcacttcaggtcctcccggcgcagaaggtagagggcgccgctggcggtgccggtgacggggtagcccccctggttgagggtgtcggtgagaaactggtcatccagcgggccggtgggcagggcgtcctcctgggcggtgtatatggtgcccacttggacctcgtagaccgacaggacctgctggtacccttgaatccggaccgccagcagggggaggagggtaaagcagaccagggcggcggtgagcaccacggtaatcacgcccatggttttggccccgctgcccagacggcttttcagctgccccaggagaaagaggttgcggtaataccggggcttgggtgggcgcagggaccgggataggctccaggagagggtgctgaacagccccaccaaggcgaacaccaccagcagcagggccagcagagggggcatggtgagataggcttggagtgcgccttggcgtaccaaagatttcatcagtgggtacagagccagtaggccgccccctgccagcagcgcgcccagggagagcaggaacaacgggcgctctccgcctccgttgcggcaggcccgaagaaaccaaatccctgtaaccaggttccacagggcggcgcccaggaccaacagcagggccagcagccagggcaggggaaaggacaggcggctcagaagggagagaatcagtcctccggcggcggtggagaccaggagaacagcgggaatccatccccgcatctgggtgcggagggggaaggactctgtcttccggtcagcctgcagcatggacagcacgggaagccgccgcaccagaaccaggttgcgcaggcccaccaccaaaaagatcccgccaaagaacaggagagtctgggcaagggtatctggaaaaaggccgggctggagccggtaggattctccaaaggcccgaaaaaccgcgaaactggccagttgggagagaaaggcccccagggcgatccccgccaggatggccagagaaccgaggagcaaggtttccccgaaaaacaggagggccacagtccgccgctccatgcccagaatggtctgcacggcgaaggacttctgcttggcgcgaagaaggtgggcgttgacatagctcaggaggaacagcagcagtaggccgagcacggggatggccacctgcatcccgcgctccagaagctccagatggatcgagcgggggagggcggcctggtagtgggagctggacagggagagaaagccgtagaacatgcccacggacagaatcagtgtgaccagatagatgccgtaatcccgggcggaccggtgtacgttccgcaggatcagcttgcacagcataaaatcacctcctggagagcatggtagcagaaagggacgggcgtttgtatggggttttcttacaaagttctaacaaaattgtaagaagtaagagggggcagagggaaaaacagcgcccctggatgcaggggcgctggagaaggaatcacgcggccgcaacatcggctaaaaattgcgtccaggtgtcggggtgctccacaaagaacaggggacaggccttgccggtcacatcatagtgacggatcacccgatcccggccgatccctgcggtgtcacagagccaggcggtgagacggaccagggtatcgtaactggcctgggtaaactggcccgaggcgtcggggtggcagacttcgatggagatggtgtcccggttgcgctcgttggtggcggaggacttctcctccagggggatgcactggatcacctccccgtccagccccaccaggaagtgggcgcttacctgggtgtccggctgggcgaagtagttccggttggcctgggcggtggtgccggggttgcccacgtagtggatggcgatgtctgtgaccttcttcatgggctctccccggcgggcggcgccgttgacggggatgatctggacatccacccagtcgggaagggagacggacttcaggtggcgcatctgaccagagcccagatgggaaaagcccacggcgatgaccagagcggcggcaagcagaagaaagaggggccagcgccgctggcggcggcgacggcggcgggagggggcccgtgtgatctgtgttttcatgggggaaatctccttggttatttgagctgtttgtgttgataggttttgtagaggagggggataaagagaagggtcagcacggtataaaggaccagcagaatgggaatggcccccatgacagagtcccccagttggtagaggtcgaaatacgccaggtcccggttgatctgcagcagcttatcgggcagcagccccaaaatgttgctgagtaaggtgttgatatcccccagcatcagggcgggcaggaagatcactgcgaagggcagcacggcggccagcaccgtggagccgctcttggcggagacccacatggacagcaggcccagaaacagggtgccgagatatccacccagggcaatgagaagagccccctggcccagggtgaggttgtacagggatttccaggcgtacagctgcaccgggcagcccgccccgtcggcccccaggaaggccagggtgattcccccgaagaggaggaagggcacccaatagagcacggtgagcaggagaagaccggcgcccaccttggcagaaacccctctgccccggccgtggaaagtggtgaagaagatggcgtcggttttccactggccctcctgggaaaagatgcccgagaccagaaagcaggcgaagaggcacagaatgataatgactgtgggggaaaactcataaaactgctgccagcctgtggtgtagtccacgtacatgggggtctccagcgcctggtactgctggaccaggtagttctgctcggcctgggagaaggcgaaggcgttgtcctccagccactgctggagcagacggacccggttggcgtaaaagtcaggggcatcctccggggtgagggtgtcggcggtgaagtagtcgaaggcctggaaatcctcggaataggcgctgttcagcaggtcccgaattgcctcaaaggcctgctgccggtgaaaggccatgtcctgccggacgacgtcctcggactgggcgtcgggggaggtccgcacatccaagttggcctggatggcccggcggagctgggcctcatccaaaggaccggcccaagctttttggtcagcccggagctggcgcacggcggacaggccgtactgggtctgtccttcctcgtcggtgtagcggacatggcaggcgaaaaaggtggacacggccaccagcactgccagaagcagaagggccgccttgccgctggggcgggcaaagagtttacagagttcatagcgcagcatcggtttcacctgccgtttctccaaagtagtggaggaagaggtcctccaaggtcatctccgccgggtgggcctccggcgtggggggcgtctgggagagcacccgcagctggaccccctgggggagggttttgaggttgaccacgggatactggtggagaagctggtccgcctgggcccgggggacggtgcaggtccacacctgggtgggggccgcggccagcagctgctggctggtgccgtggtgaaccagggagccgtccttcatcaggaggatttggtcggcgatgtactccacatcggagacgatgtgggtggacagcaggaccaggcggttttccgccagctcgctgatgaggttgcggaagcggatgcgctccttggggtccagaccggcggtgggctcgtccaggatgagaattttggggtcgttgagcatggcctgggcgatgcccgcccggcgcttcatgccgccggagagctttttcattttctgccgccggacctgggtgagccccacctgctccagcaggttttgcatcctctgccgggcggtggccgggcgcaggcccttgatggaggcgatatagagcagatagtcctggacagagaagtcggggtagtagccaaagtcctggggcagataccccagcagatttcgataggcgctgcccagggagaagatgtcctgcccgtcccaggtgatggtccccgaggtgggggtgaggagggtgcagagcatccgcatgagggtggttttgccggcgccgttgacgcccagcaggccgtagacaccggtgtccatggtgtaggacaggttgtttacggcgggaaaggatgaaaaggtctttgtgagaccgtcaaggatcaatgccatacaggggatacctcccaaattgtttcacaggtgttttgcagcttgcggatggcgtagagaaagtagacggtggccagcagaagcatccccagccacatgggcagggagatcatccggtagacctggtcactgaggatgagcagcacccacaccgcggtccaggccaggcagaggggcagcgccgcgtagcagacggtatcccgccggtgggacagggtgcgaagacagatacagccggtgaccaggaacgggagcagaaaattgatgatgaggtcccgcagggtggcctgcccggccagcagggcggcggagaagaacagggtgagcagagccaggtccaccagaccaaacagaaccatccgggcggcgtaaatttgccgcagggagtagtaagcggtgcactcgatttccaaggcgccgctggaccggtttttccacagctcgggcaggaccagcaccacaaacaggggagccagggtgcccatggcccgctggacctcataggcggtgccggcggactggagcagccaccagagcaggaccagcaccgccccctggagcagccaccaacgcttgtggaggaactgggcctgctggcggagaaattccagctgggacagggggcgggaggcctcccgctggcggaaggcctgggtggcggcccgaacggtggcctgaacggcctcctcccggggctgtggtgtgggaagggtgtcaaaggggggacgtttcatcaaggcgcctcctttctgagaaactgcgccaggagctctctggctttgcggatacggtacttgaccaaggggagaccgatgcccagaattttggcgatttcccgctgcttgcgttcctggaggaaaaagagcaccgcggcgggctgaatctccggcggcaggacgcgaaaggcgtcctgcaggtccaggcgggtgtccagggtgtccagcgggcggtccgccggttcgggcaggtcggcaagggggagttccgactgccgacggtaatggtcccggcacaggttcccggcaatgacatagagatagttggccgctttgccgtagtgcttgtatcggtccagggaggcgaagaaccgggcaaaggtctcttgggtgaggtcctccgcgtcgtggatttcctggaggtggtagtggcagtattgcaggatgctggggtagtatttccgaacaaagcattcgatggcctcttcctccccccgtttcatctgggaaagcagccggaaatctgcgtccatgggagtccctcctttctggtcaaagtagaaagcgctttctgcatagtataacgcgggggaaaggcaaaaggatagcggcgggaggaaaaaatgttcaaaaaaaggggaagcaaagaaaagggaacccccttccgcacagctgcgcggaagggggttcgttgaaacaagagggttatccttgtcccaaattgacaattttccagtgtcctccattagagcgagcaacgtaccattggtaatcataagtatcattagggttaaagccatttttgggggcaaagaaatcatctgtggtaaaagttgaatgaaaaacaactccctcgtcagcattgtattctgctgcccagttccaggtatctgaagaggcataagcatcaacatactgtaattttgtcatcgtgcagccggaaaaaccgtacttgaaacggcggagcacaacatccgccgcgtcctgaatttcctcctgggtgaactgttcagagggagcggatttgaactgaaaatccttcgacagtgttcccccgaacagggtccagaagagaaggaagcccagcaccaaaaggggcaggaggatgaagaggggctttagggcggtcagttcttttttcataaatatagctcctttccaagacgctgatgttccctcgcggcgttgtggcagaccagggagatatctgcctggattcatggctgatgggagtttcggtcatgcggacgcacgtttgccgtgatgtgccgaaccccatgccaaacgaggctgaggaggactgcgatccctgtggaaaggcacagggtggctgcgaacaacagcagcatcccggacatgcccagatggaaccgggggaactggcgtagataatagatcaccaacacatggttatagtagatccccatggcgtgccgggaaaagaacgagacgacccgtcctgctcccgggcatgccctgagccactcccacacccctatgccgcagaaaaaggccagtagggtggctgccagcagagcgggacgaatggcgtggaggatgctgagccgatgggacaaggcgcagtacagacaggcaaacacagcggaaataagcagaaggggaagggccgcttttttgcactgaacccgcagatgggagcgatccaaccgctgtaagcacatgccggcgacaaagtaaaagctccaagtgggaaagagcatccacaggtgggccggaagggagaatgggagcagctccagatcatgaaggagatatcccccttgcagcaggaaggtgaccatcagggcccaggcggcactttggaccggcgcccggttcacccaccgccgcagcagggggtagaggagatagcattggaagaggatggggatgaaatagagatggggcgccccctggccggtgagcagttcccgcagcagccagggagggtttcccagctggccgccccaagtgtgcaggtcaaagcctgtgttggcgagggcatagagcaagacccacccaaggtaagggggcagcacacgggcgctgcgggtccgcaggaaggtcaggtaggggacctgtctgcccgtttgctccagagagaagccggagagaaggagaaagaggggaacgctgaaccgggcggcttggttgaggagaaaggccagattcatccccaggaagaggtggccggtctcataggagaggtaggtgctgctgacgtggatgctgatgacggccagcatggagacgagccggagaaagtcaatttccagcagccgggctgtccctcggggcctgccgcctgttttgcccagggcagaggtggtttgagaggggggcgcaggggacgtccaaggggagggggtgtaccccccttttctctgttcagttgtgttaaaaatggaaatgatcatgatatgtgtgttatagagcgcaaagagagtggattgccgggggcctgccctctttgctggtgacggttgggcacggttcagcaccgtttcacagggggcatttgaggggtgctctaccaataagacgaatgagggaggggaaataagacacaaagtgagaaaatttgtggaagttttttcgatttttgggcaccgctggggaccgttgcgggagaacggccagcctcccttccgcaaggcggcgcggaagggaggctgaaaaagcgggagaaaattaggcggtcagggtaaagctgtccagcaaaagctgttcttccgtgtcagggattgcgtctgcctggaaaaagaggtcatagaacgcatcgcccttggggaagaggtagtggatggtttccggctcgtctctgtccggccaaggaacgagagaaaggctgagatatccatcctccccataggactcaaacatgtggtccacgtgtccctccggagcgaccagctgtaaaatctggttcagttccttttccgcgtgcccgtcaccgagagaatccaggtccagcgccgctgcgttttcataggcaatgacggccacaccgcccacctccgtgccgtccaggaacagcgtaagggtgttgttttcctgctctttggcggtgatcgtggcgggcagggtcagggaataggcctccgtccccgcggttttcgcagcggtctcccccttctcctcctccgcttgggccgcacaggcacagcatgtgagaagaagtgccgcggagagggccaggaggggaagttttttcgtccatcggtttggcataaaaagcaccgtcctttctgatgggttcaactataaaacgattgagaggagcgatttgtgacacaagatgggaaaatttgtggaaaattttgcacggcgcgatggaggacgtctcttgaaaaggggaaaggttatccctgcccactactcacgatcgtccaatgcccgccatttgaccgggccacacgccaagaccagtcttggtagttgctgtttgcgttcaggtgactttgctcggcggtgtcatcggtgacgaagtcacaggtgaaatagaggccctgatccttgtcatatcgttcggcccagttgtccttttcgctggaagaagcaccatctacataccgaagtgtggtcatggtggcgccgcggaagtctttgaagcttcggacgaccgcgtctgccgcgtctgaaatctcctggggggtataggtctgggagggctctgtgacgaattggaagtcctctgccagctgcccacccccaatatttcggtacaggctaaacagaccgacagacaacaccaaggccagcagagtgagggagacggtgtggtgttttttcataagaaacgacctcctgtttgttttgttggtgttctactgataaaacgaatgaggaggggaaaatatgacaggaagcaccccacttttatcgaatgctaaggttattttaattactcccgtccccagatacgaacccggggacgggagcacatggatgatagcgcgaagacctgatgcaaggaagagaactggtttcctttccttgagagagaaatcatggtgtatcggagtccactttgatggacgatatttcttttacagaaatatcatgttcaaatggaaaatagcggacgccttgatgatccatgaaatagggttccgtatcctctaataaattgttgagcaaaatttcttcaccgctatgatacgcaatcgtaatggtgggaaggtctgaaaccgacttgtatttctcagccggacagacaatcccccatggagttacctcgggtataggtgtctggtttcgcagcaaagcatcctcttttacgcggcgcatgaggaaacttgaggcaggatggctgggattttcttgtggcacatcaagtgatacatacaagaaaggggagctgttatccggcaaatcggtacgatatacataagtggtggaggatggattggctctaaatttccggatcaaatgatctggatggtgggacagtgtaccggggctgttgctgctcctgttttgtgaagcggcatacgcgctatttatggtgtctggaacagacacagaataaaaacaaccggcttccgttgaaatagcatagtccaaggtcactgtatttccattctcaaatcgtagttttgaggttggtactgtattcaaggggccattcttgaccaacaaaaagatcaaaaaaacgaggatgacaacagaaaagatgccaatacaaacccttatatgttttgttttcatgagaagattccgtcacctcctgaacggtcatttctgatcactgcatttgtttttcggcttattggtttgtcataaaaagcaccgtcctttctggtgtgttcaactataaaacgattgagaggggcgatttgtgacacaagatgagaaaatttgtggaaaattttgcacggcgcaatggaggcagaaagagacgtcctctcaggccgctgcgccggaggacgtctccagaaaaaggggaaagttacccctgtccgtggtttacaaccttccaatgtccgtcgtctgaccgggcaacataccagttccacccctgataggtgctgttgggattcaggctgctcttgttggggagatcgccggtggtgaagtctgagacaaaatggatgccttgctccatgccgtctttctccgcccagttgtcctcttcgctggaagaggcaacatactgcaactttgtcatggtggccccggaaaagcctttgaagtagtgcaggaccgcgtctgccgcatcctgtatctcttcgggggtataggtctgggaggacccggttatgagcgaaaagtcgtcagaggtcttcccaggaaaggggaagttatgggtcaggatggtgaaaccgacagccagtagcagggccagcagaatgagggagatggtgtggtgttttttcataagaaacgacctcctgtttgttttcatgagaagattccgtcagctcctgaacggtcatttctgatcactgcatttgtttttcggctattggtttgtcataaaaagcaccgtcctttctggtgtgttcaactataaaacgattgagaggggcgatttgtgacacaagatggaaaaatttgtggaaaattttgcacggcgcgatggaggcagaaagagacgtcctctcaggccgctgcgccggaggacgtctcttgaaaaaggggcggtgtttctgttttcaggatgttgcggttccactgtgttaagagtagcgtgcgacatccccgatgacggatggtatatcatcgattttctcaaactcgaaccgttctccctggatggtgatggcaaagcccttgccgtcataggtgaattcctggtcggggatacgatctccatagttggaactctgacaggagattaaatacgaatctcccttttgctgtcgcacctcaccgagtataaagcagtcatttttttggtccgcgtagtaaacctgattattttggtctactgctaaaatcttttgaaattctgcttcgccagaggtataggttccacaaatggtttctggggtagaagaggagttgttggtacagccgaccagaagagccagcattgtcaaaaggcataacgaggtgaggatgcgatgcttcttactgttcatacaagtctaacctcaaagtaattccgagttggtgttacaacggtattataacctttaaaccaccatttagaggttccaatcaagcgttcatagttggcatatcttttgcaggtaagatccctataaacgaaaagtttgcaaggcttattcacgggagcgctgacaaagtaaccggctgtactccctgtggagccgacagagacacttgtagaaatgggtccccaacctaaattcaagttaagggtcacagaattaccaaaacctccatcgacccaataaaatccgccgccataagaaggaaatactgtgccattagaaggttgtcccttagcgtaaccaatggggtgtttgactaacgtttgtgtgttgacgagttctcgcttggcttcgacatcatgtgcccttgggcttatcgttgtagaaccgtcttcaattccatctgcagaggcggatactgatatcgccatagagaaaacaaaaagaaacgacaatattacggataaaagttttcttttcataaaaaattcctccttttaatttgtaatccattccatggggctttacgacaactggcgagaatataactattctctgggtggttacgaacaggttcttgtcacagacttctggggctgcttgacgccgttgacagtgtagtccacggtcagcttgtaggtcttgcctttggagacggtggcggttttggttgtttggattttcccggttcccttgattgtccaagtttttaggcaagtttttccggtccaaagcttggcggttgccgagagagtatccgaacttctgtctccgcggacgataatccggcaagatgcggtggtcccactaaaagagagagacggctgtgcggcggggagcatcgcagggccggaggcctgggcggtgatgcccaagagcatcaccaggatcagagacagtgccagcagttgttttctcatacaaatcacctcccttcatttcgtgttcagctactgtaacgaatgagggaggtgatttgtgacactaaatttgaaaatttttcagaaaatattatttttcttctcgaatgacgttttctgccatatatatcaaagtatcttcttctaagtaggcggacaaagtgagcaaggcttttgtttcagggtccgtccagaccagtgtgttggagtgggttcctgtattatcaaaataataatctgcgggggttccgttgattgaaactgtcttttgctccatctcatctacgaagaaaagggagagcatagattcagtgtcttctgttacatactgataggaaaaacttaaatattctccggcctcgttttcatagagttcatctcctgtggtttcagcttcataacggtctgtttcccagtatccagacggaatttcagaaagccgataacggtgtgttgcctccgagacatcgttgtggaatcgataatcgacggtgcctccaatttgttcagataaccacccaaagaatgcctcccgtgcctgggcattggtggacaggaaaatcgttccccccagcaggaagaagcaggccacgcccttgaggacccggtacaccggcgcgcgttttcgtctgcgcaggagggcctccattctgttcagaaaggcgggggagaaggtgtgatgacattggtccgggtcggggaggctctggtccagcagagcgccggcgtcccggacggcctggcgcagacggtcctctgaaatcataaaattccctcctctcggcacagttcttccaggcggtccctggcccgctgctccagcttgcgggcggcgggccaggagatgcccatgagttcagccacctccttggtggagtagcccagctcgtgtttcaaacggagaaattcccggtaccgggcgggcagcttcaaaatgcaccgggtcagcccgtcctccggttcgtaggcgggggcgaggcccgtggtctcctcccagagaatttcttccttgcgatgggttttcttgcggtataggtcgatagctttgttctcaactatagtaacgaggaaagccttggttttgtgacgctccagacgagaaaattttttgatatgttccgccacggacaaaaacgcgtcgtggaccgcgtcctcggcatcctgctcgttctggagaatctggttggccacgtagaacatcagaccccggtaggtctcatacagggtgatgaattggtcccggtcctctggggcgtcgatgacttgcagatagatcaacatggcccgtacctccttggggttgatgtcacagcatggcggagacccgctgatgcatgtcataaagttcctccaccatctcccggatgatctgggcggcgggtttcacgtcgtggatgcggcccagaacctggcctatggcgatctgggcggcctggggctcgtcctgctcgtaggcggctttggtcacggtgccccggatcagagggtagagttcgtcaaaggtggggtggtgctgttcaaaggcgatgatgtccagggccccctgggttttcagggagcgcagggcgttgcggatgctggtctgggtgaggacggtgtcggtctccctggcgtcgatgaccgtttggcgcagtcggggcccgatgtctgtctcctgggccatgaggaaccgagtgccgaccataaccccgtccaggccggcagccagggcggcgtacagggtccggccgtcgcagacgccgccggcccccaccacggggagggtgcatcgctcggtggtcaggggccactggaccagggagcccaccccggccatgcccgggtggccgcccccctcataccccacgatacacaccgcgtcgcagcccacctcctgggcggtgtgggcgaaacgggagtcgggaatcttgtgcatgaccaggcagccggcccccttcaaggtgtccataaacggcttgggggaactgccggcggtctccacaatgcggaccttttcctctgtgatggcctggagaaagcccttgatggggccgtcgggcttggtatccggcaggagggagaggttgacgcagaagggtttgtctgtgagggttttcagcagctgaatgtcctgctgaaaggcctccggcgtgtcataggtggtcatgttgatggtgcccaggcccccggcgttggagaccgcggcggccagcttgggcttggagagccactgcatggcgccttgaatgatgggatactgaatgccgaacaggtcggtgatgcgcgttttcatggtgcttcctcctggatggaatgaaatctgaggaggcacgggcgcgggacatgtgatcttgtccatggtacccaatttgccggtgaaagtcaatgcggacggtgggccgggcagggccgtttctgacggagaaggttgtgatactgcctaattcgtcggcgggaaataaaataaattataggggaaatggcaaaaacaggtttgacagcgtctctggatgggagtataatacaccatagattctactggaagcgtgaaagggaggaaccaatatggaattcaaaaccgccaccatggccgactttgatgtggcctttgactacattgagaaactgtggacctataatacctatgacaaggaagtcatccgcaaggtgtatgccgatgtgctggccgatgagaacagctttgcctttttcctcatggacggggatacctaccacggcttctgtcacggggcgtatttcaacaccttctggctgtccggcatgacctgctacgtctccagcatcatcaccaatgaggacgagcggggcaaggggtgcggcgtgaagctcatggaccacgccaaggaactggccaaggccagaggctgcaaggccttggtgctggactccggtatgccccggacccaggcccaccggttctatgagatctacggatttgaaaaaagctgctacggctttgactattatctggagccgtaaacgaggaaacctgccgagaaaaaaccggcacctcccgccagggaggtgccggtttttcggggttccataccgggttttccccgatgtacctttacaaaaaaagaaatccctttagaatagaaggggatggatatggacaccctctcagaaaggagcccccttatgagttttcgaagaatcgaatattttttatcggtggccaaacacctgaattttaccaaggctgcccgggaatgctatgtggcacaggcggccatcagccagcaaatcaagcagtttgaggaagaactgggctttaagctgtttgaccgggggggcacggcggtggcgctgaccccggcgggggagtattttgcccgccaatgtcagagcgttctgtcccagtaccacggggcggtgaagcaggccaggtccattgccgacggcaagaagcaggacctccgcctgggcatcaacggaccctacacccaggagagcattcccggctacctccggcagttccggcagctctaccccgaggcggccatccacctgcgggaggggggacgggaggaaatcctggacgccctgttccaggaggagctggacgtcatcgtggtccctgactatgacctggagctggaccagcggtttgacgtgctggagctgaacagtgagcgggcgaaatttatgaccggtcctcacacgcctttggccgggcggcagtatgtctccccggaggagctggtgggccagaccattttccgggtggagggactcagcgaggaccctcagggacatcccctccccgactacttcgtccgactgggactgggagagaacccggtccagcgggtaaagacctatctggaggccaccattctggtgcaggccggtttgggcatcgccgccattcccggggggatggaggggaagctggcccgggatgtgagtgtcttttccatagagggggactcctttcgcatccggacggtggccctgcgtctgctcccgccggtgagtgtggccgcggaccactttttccaggtgattcgccaggacccggagcgggtgaaacagggggtataagtttttctgattaccccattagttttcggtgtttcccaaatcccggggattgtgctataacagagtcaggaagaaaccttcccaacacaatgaggtaatggagcaaaagaaggatttggtccctgttttgcaagaatagaaaggagcaccgagtatgaacgtcaagctggacgaacgatatgatctttacatcaacggaacgtgggttcccgcctccgacggccgggttttcaccaccaccaaccccgccacaggggagaagctggccgagtgtgccgaggccaccaaggaggatgtggatgccgctgttcaggccgcctgggctgccttccccgcttggcgagacttggagcctgacaagcgcgccgatatcctgctgaaaatcgcggatgtgatcgacgagaacaaggaactgctggccaccatcgagtccatggacaacggcaagcccattcgggagaccatgaccattgacgtgccctattcctccgatcacttccggtattttgccggcgccatccgcaccgaggagggaaccgccagcgtcctgaaggaccatgtgggccactttatgaacatcatcctccatgagcccatcggcgtggtggggcagattgtgccttggaacttccccttcctgatggcagcttggaagctggcccccgctctggctgcgggcgactgcattgtctttaagccatcttccaccacctctttgagcgtgctgaccctggtgaagctcatcggtcatctgctgccccccggcgtgctgaacgtggtcaccggcggcggcggccgtgccggccagtatatgctggaccatcccggcttccggaagctggccttcaccggctccaccgaagtgggcctggatgtggccaaggccgcggccgacaagctcatcccctccaccttggaactgggcggcaagagcgccaatattttctttgaggactgcgactgggatcgggccttggacggcctccagctgggcatcttgttcaaccagggccaggtctgctgcgccggctcccgggtctttgtccaggagagcatctatgacaagtttgtcgaggctgcggtaaaggcctttaaccaggtcaacgtgggcgatcctctggaccccaacacccagatgggctcccaggtggaccagggccagctgaagaagatcatgtcctatgtggagctggccaaggaagaaggggccaccatcgcctgcggcggcgagccctgcaaggagggtgcctgcgccaacggcgcctttatgaagcccaccttgattgtcaacgccaacaacagcatgcgggtggcccaggaagagatcttcgggcccgtggctgtggtcatcaagtttaagaccgaggaagaggtcatcgccatggccaatgactctgtctatggcctgggcggcgctgtctggacccaggatatcaaccgggccttccgggtggcacgcgccattgagaccggccgtatgtgggtcaacacctataatatgatccctgcgggcgcgcccttcggcggctataagcagtccggtatcggacgggagacccacaaggtcatcctggagcactacacccagcagaagaatatcatgattaacctcaacgaaacgccctccggcttctatcccgcgaagtaaactggagtcctgtgtcagggcggaggggaaactccctccgccctgtttcatcaaaacccgccctcgccagaatgtttggcaatctgttggggcgtggtcccgatagaaccatgtcagaaaggaagaaaaggaatgtctacttattattttgttcccagtagaaacgtatttggcgagggctctgtggcggaaacaggccatctgatgaagagcttgggcggcaccaaggccatgatcgtcaccgacgagtttttggcctccaaccccatgaccacccggattcaggccatcctgaaggaggctggcgtggattccgccgtgtttggcaaggcagagcccaaccccaaggacaccaacgtggtggagggggagaccttctaccatgagaatcgatgtgactgtatcctctccctgggcggcggctcctcccatgactgcgccaagggcattggcctggtggctagcaacggcggcaagattgccgactatgagggcgtggataaggcccatgaggccctgcctcccctggtggcggtgaacacgaccgcgggaactgcttcggagattacccgcttctgcatcatcaccgacacggcccggaaggtaaaaatgtgcattgtggactggcgagtgacgcccgccattgccatcaatgacccggagctgatggtggggatgccctcctccctgactgcggccacgggaatggacgcgctgacccatgcggtcgaggcttatgtctccaccgacgcaaatcccctcaccgacgcggcagccatcaaggccattgataagattgtccactatctgccccaggctgtggccaacggggactatatgaaggcccggtccgagatggcgtatgcccagtacctggcaggggtcgctttcaacaacgcctctctgggatatgtccacgccatggcccaccagctgggcggctactataacctgccccacggcgtctgcaatgcgatcctgctgccctatgtgcaggagttcaacctgatcggcaacctggagcggttcgcggtgatcgccaaagccatggacctgaatgtggacggcatgtccccctttgaggcgggcgaggcctgtgtgtatggtctgaagacctttggccggtacctgggcattccccagaacctgcgctccctgggggtagacccggcggacttcgaggtgatggcggagaacgccatgaaggacgcctgcgcggccaccaaccccagaaaggccaccaaagaccagatcattgcgatcttccaaaaagcctacgacggagattgatttctccctcccttctttctatccaaatcctttttcaccacagggcggagtacactccgccctgtggtgatttttagaagcaaacagaaacaccccctggatagggggtgtttctgtgcgggttagaagatgccgtcatacccgtcaatgtagtaatccagtcggaccagttcctccacctgggttccgtcgggcaaggtgcccgtacagtggagcttgaaggtaatgaccggataggtgacaaggttggcggtgacggtttccgtggcggcctccttggcggcggcctcgtcatagcgcagataaaccagggaaaaggcatcgggcagggtaacggtctgatcttctttccggctgattttctggcactgctccttcactttggccgctgtgggatactgctcgatctcacagggcaggccgtttgcagtggcggaggtcacttcgaacgaggtgtaaacctctttgctttcacgggtgggggttagggagaagaccatcttgtccttctgacaggtgacgcattcctcctcccaggtgcaccgtccggcgttatactggatgcccctgtcagcaagcagttcttccagggtctgctccgagtccttacagggtgccggcagagcacgcacggaaatccaagcgacatcgccccggtcgaaggaggtggtggaggcattgtactctccgtgggtgatccccagtttgtcagacagcgtccaggcgctgtcccaggcaaaatcggttcccgacacgtatcccaaggcccggagaacaaaggtcaggtattccgaggcccgaatggtgctgtccgggtcaaagcgggtttcactttttccgttggtcagccccttttcataggcatagccgacatagggcgcggcccagtcggggacatcctggaagggggtggtccatgtgcccgccagggcatcctcctcctggcccagcagacggaccagcatggtcacgccctgggcacgggtgggggagcggtccagggaaaagacggggaatccctccgcgtcggtgtctgttccctgaaaaaggcccatgtagtagagctgccaagcggccgcctcctcctgctccgggggtgcggccccagcgggaagggccagggcaaggctcaaaaccagggccagcagcaaagatatccattgtttcattgggttctcctttgtgttttctccgtcgaatgggacagagacgggggatcagaagatccccaagtgttccagcagaattttcaggcccaggagaatcaggatcacgccccccaaggcctcggccttggactgcatccgggtaccgcagagactgccgaacttgacccccaggctggagagcaggaaggtggtcagagcgatacagcagacggccggcagaatatccacctccagaaaggcgaaggtaatgcccaccgccagcgcgtcaatgctggtggccaccgccatggcgaacatgacccggaagcccagggaagcgctggcctcctccgtgtcgccgcttcgggcttcccggagcatgttgatccccagaatcgccagcagggcgaaggcgatccagtggtcgatggcggtgatgtacagggaaaaccgggagcccaggagccagcccagcaagggcatgagcccctggaatcctccgaaccatagtcccaccaggaccatccttcccaaagtgacccggtccatggccagtcctttacagatcgaaactgccagcgcgtccatggacagccccaccgccaagagcatcagttctaaaaatcccatcctgtttcgccctcctggttcacagtatgcgtctggggcagggggtagaccggatcacccaagggggagggacatcggttatttctcaagggtttcccaggctttgtccaggaagctctcgtcatagatctgttcttccgtggggtcgccggtgatgccgccggccagcttggtcagggatacggcggcctcaaaaccagatttggtgtggtagccggtgaagctggcgaccttccgctcctggtcatactgggcgtcgtagaggagctcttcctctgcgccctcaaagagggggaggagcttctgggcgatgtcctccggggaggcggtttccatccactgcatggccttggccatggcgttgaccgctttctgcaccagctccgggtcggactggatcagcgcgtcggaagtgatgacggtgaacagctcatagctggaggagccgatgatgctctcgatttccgcgtcgtcggtgccgtccacaatgaccacaccgccggcgtccagcagctgcttggcggaccaggggttggtggagacggcggcctggatctcgtcctggtccatggcggccagatagccggagctggcgacgttggggaggctgacatcggtatccgcgttcagaccggcggagttgacgcaggccttaatgaaagaggtggggccgctgttggcactcagaccgccggcgatggccttgcctttcagggagtcaagggtggagtacgactcgttggcgccgatcagctggtaggggtacttctgtgtggcggagagaattaccttgcagccctggccggcctcgttgaccatgagggcggtctcgatgcccttcaggcagaactgggcgtccccggacaaaaccgcggtggtggcgtcgccccccttgatggtctggaattccgcgtccaggccctcttcggcaaagtagcccagggtctgggccaggtaggcgggggcccagtgatagccgcggatttgttccgtgaagataatcttttgcaggtctcctttgtcctcggttccgctttgcgcggaggtgggttcctcctccggggcgggctcactggggccgccgcagccggccagcaggccaagggacagcgtcagggtcagcagcagagcaagtagcttcttcataatgacactccttttcctttcatggtttctttcgttttatcataaccgcagggcggatacgatcgaacgggggctcatcgccagcgcagcaggcgggcttccaacagacggaccacgccgtccaggaggatgatgaggatcaccaggatcagcacgcagcagaggacccgctgggcgttgaacacatcccccgccgcggagaggagccagcccatgccgcgggtagagcccagatattcccccacaatggcgccggacagggacaggcccagaccggtgcggagactggtgagcagccagggcaggcaggcgggccagatgacctttcccaggatctgtccctgggtgccgcccagcaggcgcaccgcccccaccaaggcggggtccacactctggacgccggtgtagaggttgaaggcaaaaataaaaaagaccatcagggccgagatcaggaccttggaggaaaggcccatcccgaaccaaatgataaacagcggccccagagccagcttgggcagtccgttgaggccggtcatcaggggcatcagggcccggctgacccggggagagagccccaggcccaggccggccagggtgcccagcgtgccgcccagcagcagacccaacccggcctcctgggcagtgacggacagatgacgggccagcatgccgctgtggagcatggtccagaattcctgccagagcaggctgggacggctgaaaaagaaggggtccacatagccggccgcggcggtggcctcccacaggcccagtgccagcagcaggagcagggcggtccatccgcccgggctgagcagcgttttctggcgtttcatctccggccctcctcctgggggagctgggcctccagctcctgccaaatggcccgctccagctccacaaagcggggagaaaatttcacatccatcacccgccggggacggggaaggtcaatgggatactcccgcaccacgcgccctggccgggcgctcatgaggaccacccggtctgccagggtgatggcctcggtgaggtcgtgggtgacatacaggatggtacagcccgtattctcccagagggagagaatatcgtcctgcaggcgctgccgggtgaaggcgtccaagggggcaaagggctcgtccatcatgagaatggcggggtccactgccagcacccgggcgatggcggcccgctttttcatgccgccggagagctcccggggatagctttgttcaaagccctccaggcccatgcttttcatcagggcccgggcggtttcctgccgctgggatttggggacgccccgcagctccatcgccagggccacgttgtccagcacggttcgccagggcagcagggtgtccgcctgggagatataccctaccgacggaagaatgccctggacgggttctcccgccagacggacttggccgctggtggggacaacctgccctgccaggacattcaaagcggtggttttcccacagccggaggggcccaccagagccaccaattccccttgcgccacggacagattgacttgattcagtgccagcagagcgggacggccgtcgggaaacgcaaaggacacggttacctcttttaattccagcaacgacacagggcgcctcctcccacagttatgatacaaggatttttttctttccttattataaagggggggcaaaagtctgtcaaccgtttccgggcaggcggggctcccccggagacaggcaaggaaaagcgggaagacgacggttcgtctccccgctttggaatgggatgatcagtttttggggcggaactgcccccggatgagcttgccgttggcgttgtgggccagcgcgtcaacaaattccagagcccggatttttttgaagccggcgcaggcgttgttgtgaaaggccataagctcgtcctccagagcctggctgggggcatagcctggggccagcatgacatagactttcacccgctgtcccaggtctgggtcaggctcccccacggcgaggcactcataaacggcagggtgcagggagaggacgtcttcgatctccacagggctgacccggtaccccttggtcttgatgatcccgtcaaaccggccccggtaaaacagaaagccatcctcgtcccgggtggccaggtccccggtgtggaagaagtctccatcccacaggcggcggttggcctcctcgtcgtccaggtatcccatcatcagcccctccggccgccggccaccgtcggccaccagaatgatctccccctcttcccctggctgggcaaaggtgccgtcctctttcagcagctctacatggtacttgggaagaattttccccacagacccctccttccggcccagggccttggaggctgcggcgattaagccggcctcggattgggcgtacccctcataaagcacgtgccctgtctgggcggtgactttttgggccagatccggggagagtttttctcctcccaccgcaaagttggtgatggaggagaggtcgtaccggtccatgcccacctcggtgagcattcggtagaccgtgggctgggccatcatgccggtggccctgacctcctccagaagagagaggaccttttccggcggaaagcggtcatagtcgtagaccagcagggcgcccagatggagccactggccatagaacttggtgccggagaccacttcccatccagtatctccggtggcgaagtggagggacccgtcgtgggtgtcctgcatgtagcgcgccccccagtggttggccagggtgaaggcgtggtcgtggagcacccccttgggctgccccgtggtgccggaggtaaagtagagaaggatgggttcggaccagcgggtctccacccggtccatgacagggctctgcgcggccaccttttccaaaaagtcctcaaagccatctccgccgcccaaggcaaagcgcagggggacgccggcttcctccgcagcggccaggactctggcctccgcctggctctcccggcaggtgatgacacagcggacgtttgccttttgcatccgaaaggcgaagtccttttgggtgagcaggtagtaggagggggagaggaccagacccagccggtgggcggccagagccaccacccagtaactccagtgggtgcgcagcgcggtcataatgacatcgccctttttcagcccccggctttgaaaaagattggcggcctggatgctcagggttttcagggcgccgaaggtcagccgtttttcctcgccccggtcgttccgccacagcatggccagacggttggaacatcgttcccccagggggtctatgacatcgtagctgtaattgtagttgtcggcataggtgtaggcccagtgggtgatttgaccggtttcatcaaaggtctcctgaataaactgggtgtagaatgcttccatggcgcaggcgcctccttccgaaatcaaaggtgacagagaaactcccgtgtgttgcgcacgggagttccgaaaggggaaaaatcttatttgccgatgtaggtgtacactgcagaggggcggccccctgtggagtagtccacgccgccgatgacgctgttcttgtcaatcagatagttcatgtaccgccgcagcgtgacccgggacagagagacgtttttcgcgatatcctcaatggagagcttttcgcttttgtgttcccgcagaaaggaacagatgatctccagggtcacgggatggattcctttgtccacgaactgcccgccccgctggccctcgggggagatgactttgtccaactcctcctggttgaaagccttgtccccggcaaaggcctcccgccgggagacaaatttttgcagggcggtctgaaaccggttatagtcaaagggtttgatcagatagtcggacacgccgtaggagtagagctcactgacgtgccgggcttcactggcggcggtgaccataatcacgtccgctaagattccttctgctcggagcttgaccagaaaagtccggccgtccatcacaggcatataatagtccagcataatgagatccactgggtgagttcggacaaagtccaaagcctcctggccattttggaagattcccgcaatggccattttgctgttgtgttccacatattgcttgtcaatttccgcgaccatggggtcgtcttccacgatgataacctgatacatacgcattcctcacagatgggtaatttcttacataattatacatggaaaaatcggaaaaggcaatatctgcggggaaaaagttagaaagatagggcacaaaagatttgtagaaagagaaaaagttttcaaacaaatattggaaatccggaactggagggttcagaaggccaaaaacagggcgcgcggcagctgccgtgcgccctgtttgtaatcgtttagttccagtaatcggttttttccttcaggccgatattggcggccttaaattcgggatttttacctgcttttcgctgctctgtgtagtctttcagggcttttatcgcggtccgtcccaggatcagaatgacgggaatgttgatgacaaccatcagagcctggaagagatcggcggtgtcccaggccagctgcatgctgatgacagcacccagcaggacaatcacggcggcaatgatccggaaaacggtcatgaaggtctggctgggggtcttcttaaagatgaaccgcaggcagccttcgcagtagtagtagttgccaatgagggtggtgaaagcaaagagggccatggagatggcgataaagacagggccaaaatcgcccagcgcgttctgcagcgcggcctgaacatagggggcgccggcggcctccgcggtgggctccacaccggagcagaggcacataagggcagtggcggagcagatgagaatggtgtcgatgaagacagagagcatctgcaccaggccctgcttgaccgggtgggagacgtccgcggtggccgcggcgttgggggccgaacccatgccggcctcgttggaatacaggccgcgcttaatgccctccatcatgcaggagccggcgaagccgccgaaaatggcggggaaatcaaaggcgctggcaaaaatgttctggaagacggtggggaccaggttcaggtgcatcagaaccacgaccaaggcaatgacaacgtagagaacgcccatgatgggaaccagtgtgccggtgactttggtcagacggtgggcgccgcccagcacgcaggcggcaaagagaaccgccaggatcaggccgatgagaaagggggaatggtcgccgtagaagctgaagccggcaaaggcggactggaggttgtaggaggccagcatattatatcccaccgcataggtcaggataatgatgatggcgaagacgaccccaagccagcgctgccgcagggcggtttccatgtagtaggagggaccgccgtagctgctgccgtccttgttcttccgcttatagatttgggccagggtggactccacaaaggcggaggcgccgcccagaatggcggtgacccacatccagaacaccgcgccgtatccgcccaggcagatggcagtggagaccccgacaatgttgccggtgcccacccgggaggcggtggagatcatcagggcgccgaaggaggaaatgcttcccttggttttgggcttttccgaaaccacccggaaggactcgcccagcaggcgaatctggataaacttgctgcggaaggtaaagaataacccagcagccaagagcagaagggggacccatggcatgtacaggaccccgctgatggcagtgaccacagaatcaatgccgtcaagaatttggttcattggaatcactctctcttttcttttttctgataggggcataataaccaatgctatcatcttacaggaaacgacaagaaaatgcaagaaaaatcaacaaattgtcgtgagaaaagacaagaaagagcgtgccgctggaaagacagcggcacgctcatgaaacagaaactatggagaagaaacgagtgccttacgcatccttggcgtggctgaacatagccgcggcacgctcttccggagagatccggcgtctctgcacaccggaggcaaggaagagaatgatgccaatgaccatccagcccacaaacatgatgctggctgttttgcccatgtaaacagggttgttggggataaacagcagcacgaagaccacggtggtcacaatggcagagaacgcgcccatggcaattccaccgggaatcttgtagggacgctccaggttgggctctttcttccgcaggcggatgagagagtaggaggtgatggtccaggacagcacgaaggcggctgcggagaaggaggtaatatcctgaatcaggccggcgcccaggaaaggaccgatcagagacagcaccaggcagacgatcagaccgggaacagggatgccgtttttattctgcttggcaaacaccttgggcaccaggcagccgcggcccatgcccatgagcaggctggcggaagccatgaagaagccgttccaggtggtgaacaggccggcgatggcgcccagggtaatcagccaatacagcacctcgcccacggcaccgggatacaggttcaggaacatggtggaggcagaggggtttgccatgtgggcaaactcctgccagggccagccatagccgaagcagaacagcaggatggcatagaaaacacaggccagacagacggacagcaccacggttttgcccacgttggtgatgtcgccgccggcgtcctccacgccctggggaatggtctcaaacccggccaggaagaagggggcggaggccagaatggccataatgccgccaaacatgctgtggtgagagacctctttcagcccctcggaggcagcgccgtagatggtggggtcagagacatcgtagatgggctgccagtttttcgcgtcgccgccgatgagagcggccaccgcgccaatgatggcggcacccaccaggatgaagcacagcaccttctgcactgtggcggccgctgccaggccgcgcatgttcagggcgaacagcagcagggaggccacggagccaatgatgatggtgacgagatagacatctgtcccggcgatctgatagaggggttccccgctcttgatgtcgggaatcaggtagcccaacacgtcagtgatctgaatggcttcccaaggaatgatggagacgaacgcgccaaaggccgcccatccagagataaaagagacattctcgttgaatgcccgataggagaaggccatgccgccgccagcaacggggagcatgggaaccagctcacagtagcagagagcaatggggatcatcatgaccagcgccacgatgtaaccaatcgcggccggaatggggccgccgcagctggtcatccatccgttgatggcgactgcccagccaacgccgacgattgcgccaaagccaatgcagaaaaagtcaatggcgctgacacctttcttttctgggttgttactcatacagtacctcttttctgaaatgaccgcttccggatggagcggggatgatggattcgtgcaggaaacgaatcataagttcccggaaagtgcggccctcctttcagcccgggggtgctcataaacgaaaaagaaaataaaaatggcgaaaaaatggtgacttaaatcgacaacttattataaaaaatgtcaataaagatgtaaaatagagaaaatctatggcaatataaaaaaattcttggaccgggcgatgaaagaaaaatagcaaaaaacagccgaacaaaacggctgcttcttgctatccgaagatgagttcaggaaaagttggcccgggttgggggaaaaaacggcggtctctcccgcccagaagaggcggcctcttgtctgcctggaagaagaagggcgaacagacaccagcccagaccggtagggcagctttgcgctgcggtcaaagttcttgaccgccgattagtatactcggggaagaattttttgtaaaattgagaggatttatgtcgccataaaaaaattcttgtaccaattttgcggtagatgtggtatcatcatgtactaatcatggattgcttatccaaaacaggacacagcagaataaaggagagatgagcaatgggtaaatatgcaccggtcatcaagaccgctgagtgcggcagtatgacccgggcagcccaaaccatgggttacacccagccaagccttggctatattatcaataacattgagaacgaactgggggtcaagattttttatcgggaccagcgaggggtcaccttgacagaggccggtgtcggcctgctggaaattatgcgccagattgaggccatggagatgcggttgcaggaagcggcccgggtcagcaaatgggagctgctgcgcgtaggaattttttccgacgtggcggcccagtggatgcccggaatcttagaggcgttttatgaggcgtacccagatgtggtagtgaagctggagcaagagtcatgctacctgaatggagagcttgatgtgaaggagcataagctggattgctgcttcttcattggacagtgcccccctggcatggagagctttcccctctatgaggacccctactatctggtggtggaagagaagagctatttggccagcctcaaagaggtctctgtatgggatgtggtgggaaagtaccagtttattccaaccaatgagagctttgatatgggaagtaccatccatgagatctatcagctttttgccagattcagccggttggatttccaaccccaggaaaaccaaatggccattgcgctggtggagaaaggattgggaatcacggtcctgccgggtctgactctgattgacttgattccaaaccgggcggtgaagatcattcccctgaaggaccgcctgacccggacggtgagccttctctgcccccgggaatcggagcggtcccacttgaccgaggtatttcttcgcttaacgcagcagcgggtcgatgcatggagaacggcacaagagaacaaaagcccttgaaccactggttcaagggcttttttcatggggaagacctgtgagaggcagggaaaattacttggaaacgaccggaaacttgatgaaaatggagaaaatggattgccatttttatcaagcttccgttacaataaaaagggttatatctcaaaacaacagggagggctgcgcctggacagcggtgaaaaacgggacattccagtgagaatagacggagagataaaacagcatttccctgggctcccggagcgtggtcaggtttcggccaatgattttggcaaggtatgcgcggttgccctcctcccagcagcataggaccagacgctccacagagcgggaaatggtgcgcggatttttgttgagctgtttggcgacctccgggtaaatgtccttggtcaccatgatctcatccatgggaattttctgaacaaagagcagttcagaaaggcaatccaccgagcaggccagggggcgggtatcccggcggattggcccgagaatggtgcgaataattgcctctgtatttgtcataaggaaccaccttccgttaagagatggttcgataatacaatgcttttaagggaaccaagcagtacgcgacaaaagacgacaaaacttccagaaaaatccagttttttctggccggaaaggggaaccttttggaaaaacttgcgtctcaatcagtagaagcttatgaagtggagaaaggagcgtgactctgatgaaacattggaaaaaaggactgtgcggcctgctggctgcggtgctgatggcgccggccgggctggcagcaccggtgaacggcgagaaaggcttgtcagatttggaggggcattgggcccagaaggaggtagaggccgcggttgcatctggatgggtggacggttacccagatgggagttttaagccggagaagagcatcacccgtgcggagtttacaaaaatgctgctggacgcgatccacttgacgccggacagtgagacagtggcatagatgaaagcgcatgcaaaaatgaaggatatttggggaaggccgacagcatatacgccgaagctgtacgatatgagcggccactggctgaccagccaggggtggctggacgcggcgctgtactccggcatggtggtgccagatgactacaatgggaagaatttccggccggagaaagcgattgcccggtatgagatcgcgctgatgacggaccgggccctcggcctggtgtacccggccagccaaccggtggagggggaactgccctttaccgacaaggaggaaatcctggactggatgaaggggtatgtgaacgaatcggtcaaggctggcgttctgaaggggtatcccgacgggagcttccagcccaacaagacctccacgcgtgccgaggccgtggtgatgatccagcggatgctggaggagatggaagaggggattgatgcgttggattctgccacgacgatacgtgtgcagtacagagaatctattccgtatacgcatgaaatcagtgataccattttgcaagaaagagaaacggaccaaattcaattacaagtgattgataatatagtttatgcgtcactcaatgatttgtatgatgttcaaattgaaatgatgcaggagaacggaaatacacagtgggagattattggttttgaatggtggcctatcgagcaaaaattttatgtggaacctatggacggattttattgggagtttcagtaccaggctggagatacaacctactactggggaaagtggtcagtccatccatcctatttctgtgagcctgtgcgctttctttatggagaactcatggttccaatttgcgacttttcccatccaaaggaggagccgcaggaaggttggcaagctgcttgggatgcggaaacccaaacgctgactgttcctatgttctattacaatggatggggaatgatttcgtgaatctttttatataacggggtggccgttttggttgcctccgttttttaggaagtgaatataggacagagcagagggacatatcggataaaaaatttttgaggaaatagttaaattttaattaatattatatattaaaaaataaaatgtattaagaaagtggcgtgactcgaatgaaacattggaaaagaggactgtgcggcctgttggctgcggtgctgatggtgccggctggactggcggcgccggtgagcggcgagaaaggcttgtcggatttggaggggcattgggctcagaaggaggtagaagccgcagttgcatctggatgggtggacggttacccagatgggagcttcaagccggagaagagcatcacccgtgcggagtttacaaaaatgctgctggacgcgatccacttgacgccggacagtgagctggtggcatggatgaaagtgcacgcaaaaatggaggatatttggggaaatccgacggaatatacgccgaagctgtacgatatgagcggccactggctgaccagccaggggtggctggacgcggcgctgtactccggcatggtggtaccggatgactacaatgggaagaatttccggccagagaaggcgattgcccggtatgagatcgcgctgatgacggaccgggcccttggcctggtgtacccggccagtcagcccgtggagggggagctgccctttaccgacaaggaggaaatcctggactggatgaaggggtatgtgaacgaatcggtcaaggccggcgttctgaaggggtatcccgacgggagcttccagcccaacaagacctccacccgtgccgaggccgtggtgatgatccagcggatgctggaggagatggaagaggggctgaaccctgatatcacggttgtagcaagatatcaagagggttggaaaggggagagcattgtacaggaagaggagaccaacaagattcaactgcaaatagttgacaacattatttacgcatcggtaaaggatctatacgatgttgaaatggaaatgatgaaaaaggttggacatatcaatccagataatagaatggggttccaatggtggccagtccaacaaggaattgtagtgcttaatgtaactgtatatgattattataactatggattccagatgggaagtactaagtactattggttgggatttgataatgaagaagtatattgtgcacctgcacgtgccttatacggagaattaatgattcctgtatgcgatctttcgcattatgatagggagccacaagatgaatggaagggcggatgggtgccagaaaccaataccctgactttatggatgctttatcagtctcccagggattggccctgattttattattgcgttttgagtctctcagaatgggggaatcatgaaaatacaagaatggaggcagctttttgctgcctccattcttgttaagagagaggttcagtgctgaggataatggaggagcgggcgctttggcgattggatagaggaagtacagagaatcaggaatacattgggcaaaaaaatttttgagaaaatagttgcattttgagagatattacgtcttaataaacaaagggtaataagaaaggagtgtgaccctgatgaaacattggaaaaaaggactgtgcggcctgctggctgcggtgctgatggtgccggccgggctggcggcgccggtaagcggcgggaaaaatctctcggatctggaggggcattgggcccagaaggaggtagaagccgcagttgcatctggatgggtggacggttacccagatgggagttttaagccggagaagagcatcacccgtgcggagtttacaaaaatgctgctggacgcgatccacttgacgccggacagtgagacagtggcgtggatgaaggagaatgcactgacagatgatatttggggaaatccgacggaatatacgccgaagctgtacgatatgagcggccactggctgaccagccaggggtggctggacgcggcgctgtactccggcatggtggtgccggatgactacaatgggaagaatttccggccagagaaggcgattgcccggtatgagatcgcgctgatgacggaccgggccctcggcctggtgtacccggccagccaaccggtggagggggagctgccctttaccgacaaggaggaaatcctggactggatgaagggatatgtgaacgaatcggttaaggctggcgttctgaaggggtatcccgacgggagcttccagcccaacaagacctccacgcgtgccgaggccgtggtgatgattcagcggatgctggaggagatggaagaggggttaaaccatgacatcacggttgtggcaagatataaagagaactataaagagcatggagaagaagggacgattctacaggaagaggaaacagaccaaattcagctgcaagtgatagacaacataatttatgcgtcgcttaatgatatgtatgatgttgaaatagatttgataaaaaaatatggaaaggagagtgcggataaacttggagttgcttggtggccgattcagcaggagatgatagcgggcattacgaatgtaagttctggtagtctatattactatcaaatgggaaatgaaatatactattgggaaagcaatggaagtgaaaaaatgttttgtgcaccaacgcgtgcgttgtatggagagttgatggttccagtgtgtgatctttcacattacagtagagaagcacaagatgaatggaagggaggatgggatcctgaaaccaatacgcttactctgttaatgtattacagggttcccccggaacggtatagctgagaatagagatggaggcagccggaaggctgcctccgtttttaaggggaagaagaaaataaattacttttccaaaagagcgccactatttttcagaatattctggactgctgtgatatcggcagaaccgaagttcaaaggatcgatgttgttgttcacagcgtaggcggcggcaacccctgcggcgtctcccagaacgcactggttggggatggtccgggcctctgcccagccaagggaagcgataccggcagcataccctgggatcagcaggttgtatacgaagttggtggcaatggcgctgtaggtgatgtaggtggggctcacgtgttcagggaacttgatgtcggaacgagctgcttcggtaacttcgtgtccccagatatattggccattctgtttcaaatcttcgaatttataggcgttgatgtcaagaccatagtagttcagccccatacgtttggcataatggcggctgtcgttgccggtgtttttggtagcgccgggattccagaaatcctttgcgctgagtgcatagttggtgtcttcggtgccgttggcccggtcactggaagaaaaagcggagtggatggtctcccgaaggtacagggagttgccaacaacgggatcaccgtttttgtctcggacgagatcggcaccctcaaaaccaaggaaagaacgcaaggcagggaggaaatcgggatagtctaatacttttctggcggcgacccaggcatcatccacagtcttgtagtcggagcgcatgtcggaagggaagagataactggtgtcacctgtgaggtctcggttgtaagcccgaccgtctacgttaaataccaggagcatatttacccaccattcgtcagaaccagggccatcttgtgccatattgaagggcttcagagcaaagccttctggaccatgcgtattattaaaatttaaaattttggtattggttttataagcacgcgtaccgcctgttgcgctatagacaccgttgttatctttatctccagcagtcagttcatcgtcatctgctttaaagcgatcgaaatttttcactttaaacatcaacgttgctacctgctgacgggctttaccattacttccacgctcgtcgctgtctaacaggctggcgggccagtcatatcgtccgacggtaccgccaaagttagacatgcgggtcaaacggccagattccgaggcgtcaataaatacatcgccagcgatggtgagggtgtccgctttttcgtcccatttaacggtgccatcggtatctcggaagatgcgtttcaggcgaacttcagtgatgtgggacgattcccagccgataccggtgatgtcgtaggcgtaatgaatcttgattctgccgccgtattcggcctttgtcagatcgcgcttcagaaggtcggacatggcatccacattgtaatgctgccccatttggccgcaccaccatttgaaagaaccgtttgtatagtaggttcgggctaggacatctttccaaccaatatcaaaaaagttctgtccacccaccgtgccaatggcgccgaggcagcagccgttgccgttgtagtccacaggatcgggcacaatgaggtgaatggttgcgctgggggcgttttttgccgcctttgcggccgcggccacaccggccatggtggcgccgtatactacgattgtttttgccatacttaaaatctccttttatttttttgaattccagtccccgccggctgttgcccggcaaatgaattcccaaccggtttgtactggtttcaccagaaaaggaggcaaacggggcagagaagtaaaccggacggggcaaaaagttgggaaaaagtttgggcggaaagagggctggcgctctgcccggggggttattggggggtgacatagtccaaggcaatccaccccgcgccgcttttcagctttccccactggctgtcaccttggccgtcggcggtttccacgatggtgtagacaccctggtcccggatggttcccacaatggggcagttggttcccggaccggagcgaatgtggagcgcgtcggcggtaacccggcccagaaagggaaccgcaggggaagcaggggcggctgcctggcccgttagggcggcagagaccgcctgccggaaaatatccatggtgaggccgaagggggaccaaaggtgctcagggtccccgtggttggtggcgatgccccgctggtggccctctcggtgggagagaatgacgccatcgcccagagggtccagggaaaaggtccggcacagctgggcaaagaggtccacggcggtgccataggtccgcaggaccgccgcctcggtggccgcggggtcttggtctaagaagtttgccccgctggtatagcgaatggaggcgggttcacacatttccacgccgatgtgggtgttgttggaggacccgccgccgtgccagccgcggcaggtccaggggagggtctggtaaactgccccggtgttggcgtcgatgaagccgtggacacaggctttcaccccgggctggttccaactttggacaaaggccatggcatcgggctgggcgcagcccacggagtggagcatcagcccctgaggcgtgagggcaccgccggaacggtagcagtcgttttgggtgagataggtttggtgtactgtgagcgccatgtctgcgcctcctctcttaggatgggggatcgttgtcccctgattttttcagatagctgagcagggtttggactttttggggtaagggaaccccgagttttcccacattttccaggatgctgatgccttcgttggacagataaaagatggtagacaccgtctccagggcggcctctgcgtgaagcagataggcgtccaacacgtgacaaaacgcgattaccacaaacatcgcaacctttttggtgatccccttggcgccgatctgactggagagctgcttggtctgaatggcgacgcagattcctgtgatataatccagcagaaccaacagcagcagcgccaaaagcaggccggaactgttcccacagaaggagcggagccaagaatcaatccattcggtggattccattttgattcacctcctctctcagaagaaaagaggggggagagggtgggaaagtaaaccatctggcgggagtgtgagggcgggaagatgtctcgcttgatatctcatatactttgattacatgtatttgattagattcaaattataaaacaataatatgttgtattgaaatgtgatctgagtgcgagtaaaataatttcgtggggaaacaaggcgttttttcgggaaaattggtttctcccaggaaggaatggactgctgctggactgtgaagaagaaagaatcagaaaagatggatgtgcctccgaccacgttgacagaaaaggacgatatggatgaccaagaatttatggtgtggctgtacaatcactatgaggagcggatgctccgtacagcaaagaaatactgtcgggatgcgtttctctgggaagagatcctgcaggagagctttcttcggctgctttcaaggattccgaagctgcgagccctgaaggaaggggagcgggttggctatcttactgttaccgtacgcaatacggccttcaccctgctcagaaagcaggccaaggaacggggatggtgcgtttccctggagacgggtgctctgcctgtggagggatgcctgccggaggaatgggtcattcaaagagaacggtggaatacgttggccgctgtctggcctcagcttgcccccacagagcgttttttgctggagggacggtatttccagcagagaagtgacagggaactgtcagatgatctgggatgcggggcaaacagcatacgaatgatgatgaccagggcccgccgtcacgtgcagcgtctgatgagacgggaaggagaagatcaggcagcagagcagcaaaaataaaatatggcgtcaggccaggatgagacagaaaatgccgaaaaatacaaaactgtatttttcggcatttttgttgcattttttggaaatctgcgtttcatgtgttggaatattctctcatactccacagaaaagcagaaaaagacagaaaataaaaatggaacgtttccttttggtcccggattctctcttttacttccatctccttgagaatggaaggatgaagaatgctgatggaccaaattatacaggcgaaacaggggagccaggcggacatgctgtcgctgctccagcagttccagccgatcctgaaaaagtatggacgaaagttgtggggagaagatggattggaggatatgaccgcggcgtttttacaggtgattcacgacatgaagccggaacagattcggtgccgtgcggagggggccgtggtccagtatttggtgcagtctgtgcgccatgcctatgagcggctgcaacgggagcggatgcgccagcctgccattgccttttctctgaatgaaatggaggagcaggacagcctgccggcgctggccaaggaggattctgctgagaagcagcggttttcagacctggtaaaaggctgcccgaggctgacggaaaaagaaacctatgttttggaacaggtctattactggggatacactgtggcggagctggcccccgggatggggaccagcaagcaaaacgtcaatcagatcaagctgcgggccctgggaaaactccggcggcagtgggaaacagagaaataaacaagcagcctctccccggagaggctgcttgttttcccatggaatccgttaggggtttagaatgattttgatgctctgcttggcctgggtgatggcaaaggcctgctccatttcccgcagagggaagtgatgggtgatgagggggtctaccttgacccgcccgtcttcgatgaagtggagacactcctcgaactcctgccgggtatagcagatggtgccatagatgtcgatctcgcttcgaaccactttgcctaagtccacctggggcagggtgtggtaaagtccggtgatggcataggtgccggctttctttaagaggttcatggcggtgactggaacggtgggggcgccgacgcagtcctggacgtagtcggccatggcgccgttggtgatctctctgacccgctgtacagggtcctcccgggagacgttgatggtgtagtcggcccccagggttttggccagctccagccgctgggcaccggcgtcggtatccaggcagatgacggttttgacgccccggagccggatcagctggacggcgtaaagtccgatggggccggcgccatagacacagcagacatccttggaggtgatcctggaggccttgaccgtccggtaagcggaggccacgggatcgacggaggccccctggtcataggtggtggtgtcccgcattttccggcagaccttggcggggacccggacgtattcggcaaaggcaccgtccacgtggattcccgtctccaccaggttgtcgcaaagaacctctttgccttcaatgcacatgtcgcagtcaccgcagccgatgacgatgcagggggtgacccggtctcccaccttgagatgctggacggcggaacccacctccacaatgtcgcccgcgaactcatgcccggggatcaaaggataggggaccggacgggtgccggccaggatcgggccgtcggtgccgcagatgcccacggaacggactttgatgatgacgtctgtgtcccggaggacaggataggggacctcttttaccgcgaagcccgggccttcgtgttcttttaccactgctaacataatagtttacctcgattctgtttgcgtttggaatccctgcaaggctatgacagcacaaggataatgacttgggagatgaccaccaccgagagcagcgcgatgggataggtggcggcgtaagcggcggcgacctgctccgttttggccacggaaatcagggtccccagggcgggggtggaggtcatgccgccggtgatggagcctaaattgtttaggagggagagttttagcacatgcttggcgaaaaggtatcccaccaccatgggcagcgcggtcatgaggatgccatagacaaagtagatggggtggaaaaactccgcgaaccgggagccgcccgccactccggcgccaatgaggaaaaggaccaaacccagttcccgcatggccttgagggtggtgtccctgggcatcaggttgaccggaccgatccggccaaagtgcccaaagaccagaccggccagcaggcagccgcctgtggtggtcagggaaaagtttcccaccttgcagctgcccaccacgatgccgcagacaatggccagggccagaggcatgagcccgaactcatccaaacagacccgcccggtccgtctggcggcgttctgggagacttgggtcagccggtcccgttcccggtccagatccgcgtgggtgagcttggggatcagttggacaaagaggaccacccccaccaccccgaagaggtaggcgatgccgtagcccacggagaccagggactccagctccgcagtggccaccgtggccttggctgcggagaaagcgggggtggaggtgagagctccggccagaaggcccaccaggatggcggtgaactccgcgtgggacagcccggtgaaggaacggccgatgaggatgcagagtacgcaggctaccccgccaaacagggtgatcaccagccccaggcacacatacgacttgaagttctgtttgaaattgtggacaaacccggggcccgcaatgaagccgacggcggtgacaaagaacatgagccccaaattctccacaatcttcagcccgtcggtgacaaaggtggcccctgctacggtgagctgttccgacaggctcccataacagaagcagccgaagagcagggcggccacaaagacaccggcggtacccaagctgacgccttggatggtgacccggcccaacagatagcccgccgcagcaatggcaaagacgcagaacaccaggaacgtggtccccgcgatggaaaaggtaacatgcatgcaatcgcttctttcctatttggatggttccgttaccggtttttctgcttttgataggcgcgccaggtgcaggcgaaggtgtccatgttgtccagccggtcaccggtgagctgggtggccaaggcggcccgatggggggcggtttttaccacctcgggggtggcgtatgcctcctcggaaatggactggagggccgcggcgtattcttcgatatccgctttggaataggtctcgcaggcctcgggggtgaagggctcggggatgattctggggtggtggctggcaaagtagctctggaatccgtagtccacaatccggcggtcaatgtcgtcggtggtgacggaggtttcctggcacagcttttcccagctgagccgggcctgctccagccggggcttgccctcggccatgggcatggagagcccccgaacggatgccagctttttcaggagatagttgttgttgagaatggccagctcagagacctgtttcagcccgtcggcccccagactgcggatataggcgtaggcccgcagaaccacggcgggcaccccgtagaatttgcgcagcttgccgatggagtgagggcggttgtagtccagatagtattgagtgccgtcaaactccaccgtgggcagggggagaaactgggccagttcctcggtgcagccctgggcgccggcccccggcccctggctgccgtggggggaggagaaggtcttgtgcaggttgaactggcacaggtcgaagcccgcgtccctggcccgggtgatgcccatcaggccgttgaggttggcctggtcatagacgcacagaccaccggcggcgtggacgatgtccacaaattcccggattttttcattgtaaatgcccgtgtcctcagggttggtgatcagcagggcggcggtccggggggagactgcggccttgagggcgttcaggtcggggatgccgctctcgtcggggtagagggtgatgaccttgtagcccagggcggcggcggtgccggcgttgcctggatgggagagaatcgtggtgatgatctcatcccgctgcgccccctctccccgggcctcgtggtaggcgcggatgatggccacgttggagaagatgccctgggaaccgccggcggggttcagactgaagcggtccattcctgagatggccttgaggtactgttcggtttcatagagcacctgcagaatgccctgggtggtggacgggtcctgataggggtggagctcagagaaccgggggtcccggacaaagctctcgtggaccttagggttgtacttcatggtgcaggtgcccaggccgatgtcgatgttgaggtccgcgccgatggtctcttgggacaggcgcagatagtgccgcagcagctgcatttgacccagctccggcagctcgggggcttcccggcggaggtagccctggggcaccaggtcgtcaggcgcaccggcggcctgggcgacttgaggctctatctcctccaacagaagggcccgctggccgggctctcccagttccatcagaatgggttcgtcccatctggcttcgtggaaatcacgtgtgccgtcccgtttcatgctcccgttcctcctaaaatatcgtgcagcgcggcgcacaaggtgtcgatgtccgccgcggtggtggtgtcgctgacgcagtatagggcatagccggcgtacgcggggaaaaccttgcccaggtccacaccgccaaagatgttccgggccaacagggcttggtgaatctccgccacggattttcccgtggcccggaagtccaccatgaattcctggaacacctggccgccggctgggttggcggtgacgccgggcagggcggacaggcgctttatggcgtaggcggcataggacaagatccgctggcccagctcctgcatgccccggggccccatggtagccaggtaggccccggccacaatggcccataggccgcattccgtgccaaagtattccttggcattttcccgggaggcgtggctgcaccggtagtacagggcgcggccccagccatactgcccgtctttttgggtttcggagatgccgtagaggtaggtgggcagctcgttaacatagtccggatcattgtccatggcgatgaagccgccgcagccgctgccgtactgcatgtgaatgcccaggggctgaatgtcgccgcaggtgatgtccgcgccgtagcccgatggcggggtgaccacccctaaggaggagacctccggcatgacaatgccgatggcgccggcctggtgggccaggtccatgatctctttggccctgggctcaaaggcgcctaagtaagcggggttttccagaaagaccgcggcggtgcggggggagagcttggcctgaaggtctgccaggtccagcaccccgaaggggttctccacaggcaccagagtgccaaaggggcggcagtaagcggccgcctgggagcggatttccggattcatatgggcgggaaccagaatctcattccggcctgggcgcaggcgcagcgccatacggaaggaggaggagaccgcctggccagcgtcgtaggtggggtagctgaccacatccagttccagcagttccgccatcatgctggcgtactcgaagatcgcctgcatttttccgtggtcggagtaggtatcgccgcagtaggcggtgaggaattctgagcggttggcgatctcgtcacagaccgcggggatataccgcttataacagcccgcccccagaaagctgatggcatcctctgtggaggtgtttttggccagtaagcggctgacatggcgtttgagggcctgttcactgagcaaaggcgccggcaggtccatggtgccttgaaagagaaggtcctctggaatgaccgtgcggtagagttcctccacgctggagagcccaagttcccgcagcatttcctcttcaatgtgaggaacgctgttgggcatataggggtgaatgaaatgatgacgcaagagagaatccctccaatttcttgatgatgaatgggtgatcaaatgcttgctatattcttagtataaaggttcccagcaagggaaggtcaagcagtgtttggcagggccagagatggaggaacggagatcgaaatggggcaatttctttctgagaagagaagaaacaaggaaaaagtaagagatactatggcgccatgagaaaaatatggggggaatgaggaaaaatcctgcggaataaaccttccagaaagggaaaggttttgaagtggaagggatggacatttttcaaaaggttgggtaaaatacaataatatggtttgaaaaccacaccggaaccggtggggagagcatggggggatatgggatgaagcggtcacgatatacagtgggggagatggccaacctctgcaatgtcaccgccaaacagctgcgatactatgaccagcaggggcttctcaagcccgcctatcgagatagacagaacggctaccgctactatgaggacagccagattgaggaggtccttctgctgagcagcctgaaggagctggacctgcccaaccagaggattggcgcgctgctgaaaaaacgggatctgcggaccctctcccgggaactggaggaacacctgtatgaggtgcgccaggcgcgggacgccacggtggccaagtatgacgccctcattgacaacattctccgcattatgggggggttgtcctttttggagtcccgccaggctgccgcggagcccagcgtctctgtggtggaatttcccgcggcctgggtggcctatacccgctaccagtgctattggaaggccagccggctcttcatctcccgccgggcggagctgctgaagctgatggatcaggcggggctggaacctgtggatgtgaatatggcgatctttcactccgattacaagaagcagttcagtgaggacccctctgacgacgagggggatttggaggtctgctatcggattaagaaccccaacccccagctgcccaactgtcggcgcctgccggcgtttcgggcggtctcctgtatctatgtggggccgtattccgagatgcttcccgcctacctgtctctggaggcgtacgcccagcgccatggacttctgctgcgggggatctctatggaggagtatctcattggcgccaccatgacggcgaatccccaaaactatgtcaccagaatttacctccccatcgcagaggagggggaagagacacaaccacctccccgttgaggacgcccccgccgccggcgggggcgtccttcttgcgcggaaagcgcttaggaggagacggggcactgccggcctgtgtggtcgatggtgtagtcggtgccgtattccccgtccaaaatcagctggctgatggggacgatctcatagccttctcccaacagatattccaggatgtcgggcagggcctccggggtatggagggcggcgttgtggaagagcacaatggacccggggcccacgctggaggtcacccgctgggtgatagtggccgcgtcatagtccttccagtccagactgtctacatcccactggatgggttcaatgcccatcccccggacggtggtgatgacgtggtcgtcgtactccccgaaaggcgggcggaagagcgtggggcgcttgccggtgatcttctcaatcttatcgttgcaggtgttgatgtcctccacaatctgatctgcggagagggtattgaagtgggcgtggtcgttggagtgccccatcacctcgtggccggcatccgccagggccttgacggactcggggtacttatccacccactcccccaccacaaagaaggtgactttcacgttgtacttgtcaaagatgtcgatgagggtttgggtgtcttcgttgccccaagctgcgtcaaaagagagggcgcaggtcttgtagtcccgctggacgcagtagatggggagctgccgctctgtggtggaggcggagacgtaggagggcagggtggtcaccaggcacagggcgcagatgcacagcagcgccccggggatggccagccaacgcttgcgcaggaagacgaccttccgctctttagcaggtttcacgcgaaagaatttcatatcgatcccgtcctttctatgtcgttctatctatatgcgctggtttccaagtcatgcgcccccatttcccatggcatggggacagggagatgggaaaactgggctccgtcaaattctacaaaatgcaggaaatcttgtagcaaaaagaggaaatgaaagaatttacagatgttttgtggggattcgttgcagtttggggagaaatcagttataatacttgttaaactttcaaaaggggaaaggggaagcggcgggagcgtctattgacttgtcacctgtttgggcatataataaggcgattttatcggaccggcccgccctgggtgtgaccagggccccaatttccgggcggcggaacgccccatcactgaaacagaggatcttgccatgaatacaaacaagaaactgaacatgaccatgctgtgcgacttttatgagctgaccatgggcaacggatacttcaaggccgggtacaaggaccggatcacacattttgatctgttcttccgcagtgtaccggacaaaggggggtatgccattgcggctgggttggagcaggtcatcgagtacatccaggacctccactttgagcccgaggatatcgagtatcttcggagccggaaaatgtttgatgagggattcctggactacctggcgaactttaagtttaccggggatatcttcgcggtgccggagggaacccccgtctttcccaatgagcccattctgaccgtccgggcgcccgccatccagagccagctgctggagacctatctgctgctgaccatcaaccaccagagcctcattgccaccaaggccaatcgaatcgtccgggcggcccggggacggacggtgctggagtttggctcccgccgggcccaggggtccagcggcgccattgacggcgcccgggcggcgtttattggcgggtgcaaaggaacggcctgcaccatctccgaccagctctacggcgtgcccgcagggggcaccatggcccacgcctgggtacagacctttgacacccagtatgacgccttccgcgcctactgtgagatctatccagataacccggtcctgctggtggacacctacaataccctgaaaagcggcgtccccgacgccatacgcgccttcaatgatgtgctcaagcccaggggactgaccaagtgcggcattcggctggactccggtgacatggcctatctcacccgccaggcccgccagatgctggatgaggcgggctggaccgagtgcaagatcaccgtgtccaactccctggatgagatcatcattcaggaccttttgatccagggggcccagatcgacgcctttggcgtgggcgagcggctgatcactgcccggagtgaaccggtgttcgggggcgtgtataagctggtggcctatgaggacgacgaaggcaatgtggtgcccaagattaaactcagcgagaatgtgtcgaaaatcaccacccctcagtataaacgggtctatcgcctcttcggcaacgaaaccggcaaggccattggagactggctgtgcacctatgacgaggatgtgaagagcaactgcaacccagacggcagcctgacgattttcgacccggacgccacctggaaaaagaaaaccatcaacaattttaccgccaaggagctccagaagccgatctttgtgggggggcggctggtttatgacatgccctctctggaggagattcagcagtactgcgcggaccagatggagaccatgtgggatgaggtaaagcggtttgacaacccccataactattatgtggacctgtcccaaaagctctgggacatcaaatatgacctgctgacccacaataagtaatcggtctggaagacggggaaggagtgtggtggaggagatgaaggcggaagagcggagaagggccattgccaaaaccctgacggcggagcatcctgtcagcgccactgccctggcagggcagttttccgtgagccggcagatcatcgtgggggacatcgcgctgctgcgcgcggcgggtctggacattgtggctacgccccgggggtataaactgggggaaaccacgggcctgcttcgggccgtggcctgcgtccattccgcccaggagacggagaccgaactgctggccatggtggacaacggctgcaccgtcattgatgtggtggtggaccatcccctgtatgggcagatgaccggccagctgagtttggcctcccggtatgatgtgcggcagtttgtggagaaggccaagcacgccgcccccctgtcctccctcaccgatggggttcatattcacaacctccgctgccccagtgaggaggcgtaccagcgggtctgcgaggacctgaagcagctgggcattctctatacccaggggggaaccctgtgaattcgcccttcagggttgacaagctcccttgaaaagaatacaatagaccttgcacgtgtcttgacacctgcaaggtctatttttgatttgaggaaagaaagaggagagatgatggaacaatttcgtgcttttctccggcggaaaaacattgtattttccgccaagcgttacggggtggatgccttgggggccatggcccaggggctcttctgtacgctgctggtagggaccattctcaataccctgggaacgcagtttcacattggattcctgtcggccacggtggtgaccgtggggaccggagaggcggccacggcctataccattggggggctggcctcggccatggtgggaccggctatggcggtggccatcggctcggccctgcaggcgccggcgctggtgcttttctccctggtgccggtgggctatgccaccaatatcctgggaggggctggcgggccgttggcggtgctggtcatcgccatcgtcgcggcggaatgcggcaaggcggtctccaaggagaccaaggtggatatcctggtgacccccattgtgacggttttggtggggatcggggtggcttatctggtggcgcctcccattggcaccgcggcttcctgggtggggaaccttattatgtgggccacggagctgcagcccttcttcatgggaattttggtctcggtgatcgtggggattgccctgaccctgcccatctccagcgcggcaatctgcgcggcgctggggctgaccggtttggccggcggcgccgcagtggccggctgctgtgcccagatggtgggctttgcggtgttgtccttccgggagaaccggtggggagggctggtgtcccagggactgggcacctccatgctccaaatgggcaacattgtgcgcaatccccggatctggattccccccaccttggcctcggccatcaccggccccattgccacctgcctgttccggctggagatgaacggcaccccggtctcctcgggcatggggacctgcggcctggtggggcccatcggggtctacaccggctgggtggaggacatcgccgccgggctgcgtacctccattgggggaatggattggctgggcttggtcctgatctgcttcgtgctcccaggggttctgacctggctgcttgggattccctgccggaaggcgggctggatcaaggaaggggacttgaaactggaggactgagtgacagggcggcatggtggaaaagtcagaaaccctttcttgtggaaaaatttcataaaaaacggttgtgatcttgtacaaaatttacaaagcgtattggtgcaaactccagaagttttccggcgattgcacaaaatgcttgaaatgcgttgggaaaaggtggatactattctcagcgcagcctaagctgttgtgtcatgtgctgaaatcatggaaggaggaaatcgaaccgtgaaaaaaatgcttgctctgtgtatggcgatgctgctgtccctggccatgctggccggctgttcctctgccgaccccaaccacccctatgagaaggaacccctgcccgccaacaactctgaggctgagccggaggaggagacctcctctgtcccgctgtttgagctgctctgagcaaaggggaaacatatacggcccgacagaattttctgtcgggccgtatggtttggtcttattcttttatgaaaaccccaatgacacgggcggggaagacaacgagatcagtcctgatccacaatgatgccgtatccgccgtcttttcgtttatagaccacggagaacgcgccgccgtcgtcctcattgcggaaagcgaagaaggtgtggttgaccaggttcatctggaggatggcctcgtcgatgctcatggggcggaagaagaaccgcttggtgcggaccaactgataggagggttcctcttcttcgtccgattcagggatgaagtaggactcctccgggtaggcgtcaaaggcatccttccgcaggcgcttttccagacgggtcttattcttgcgcagctggcgctcaatggacgccacggcggcgtcaatggagacaaacatatcagaggtgctttccgccacacggatgacggtggagccggaacggatggtgacttccaggttgttccgacccttttccacgctgaagacgatggaggtctcgggctcggtctggaagtagcggtctaatttgccgatcttcttctccgcataggtgtgcacacgattgggaatgttcacttttttgtcggtaaaggtgaatttcatggatgtcagctcctttcgtagggggtaagggaacggggcgtgcccccttccttacacccatagtataccatggttttccaaaaaagtcacgctgtttttggccggaaggaaaagaagccgggaaaagaggggcttcgacgggatttgacaaaagacaccccttgaccattggtaaaaaatggtatactataaatcacggcggaaggtgttgtccgtcatgacatcgttcattccattctcctgcttgtgcgcttcccattctgggaagcgcctcttttttgcgggcaaaaaaaccaccctgccctttggaaaggggcagggtggttaaacgatagagcttaacggtgaccgcggcgggagctgcgcttttcgttcagtttcaggtcggacaaccggctgtcagaggcctgcatgaactgcttgagccgggcctcaaaatcggcggggccggcgggctggggcgcggcggctctgggctctctggtgtggggagcgttaaaggtacgatttccccctcggaaatcagaacggccctgccggtcccgggcggaaccctggggacgaggaggtgggggtgtggccttcttgatggacagattaatccgccctgcttcatcgatgctgaccaccttgaccttgactgcctgcccttccgaaaggaagtcgctgacatttgccacataggagtgggcgatctcagagatgtggaccaaaccggaccgcccgcccggcagggagacgaacgcgccgaatttggtgatgcttttgatggttccttccaggattgcgcctacactgatttccataaatggtgagaatcctcctcgttgtaatcacgctcaagcaatgagcaaataaagagcggggcccttaatcggcaatattgaacacacggtcattgggtgccaccagacccagtttttcccgggcgatgtcctccacataggagggatcatcgcggttttcgatggcgttggagagctctgtgttggtctgggtctgatcgctgacctgttgggtgagggtctcgacggcggcgttggcgtcggcaattttttgccggacgctgaccagggtgaagatcatgtaggccaacaggatcagcagaatgatcttcgcaagaagaccaacctttttggattggaacatgtggggcagcctccgtttcttggcgttcaggggcgacagatttgccatgtttccctattagatgacatattgtactccacaaccgggaaaaagaaaagaactttttccaagtttttttccactttcttaaaatttttgccaacggagccgtgagaacacgaataagccaccggaggggcgctgtcacccagcccagaaaccgggcggcggcccgggccaggatgtccagcgcccgccgggtccaggggctgagcagaagaaaataagccgttgcccccagcagcaggcacagggccatgtacagccgcacccggccgttgccgaagacgatcccgcagaaaaagagcatcccgcaggcccccagccaaaacaggaggtccaaaatttcctggagggtccggcggggcagggtgaggcggaccaggcggagcagatcatacagcagccccacgcccaaccccatggccagacaggaaaagagagtggagatctgctcctgaagggagacgctcatccccggaagagacggcccagaaagctgccctggcggggctcttcctcctcataggttaaggagtccaccgtaccctccaccagcaggtccccgccgtccagacttaatttttcaatgtggagggattcgcctcggatgatgaggcttccctccgcggtggacatgacgatggaggtctcgtcaaagctctccaccccgtccaccccggacaccgtcagccggttccggttgtccagaacaatccgatgcgccgctccccccgtctgggggcttttttcgtcgaaggacataccatcccatcctttcccgtgatgtgatcttggctatgtatatggcggggagaagggaagtatgcaggggaaaggaggaaggaacaaaactgtcaaaaggtgtaccttttgacagctggcaaaaaggaggaggtttttgaaatgcctttggaggaattctccgaatcttcttcgtcgaggcttgctttttttagtgttatcctgtaaaatatgactcgaggaacaaaactatcaaaaggtacaccttttgatagctgggaggtggagtaagggagtaagaaaatcgtttagaacgcgcagctttaataaaaacaaacaaggaggatacagacgatgaaaaagcgatttttgtcggtatttatggtgctgtgcatgatgctgacaatggttccatctgcgtttgctgagggagcagacggagacacattacagaacaagattaaccaagcgtcagaaaatgcaacaattaccttggacaaggcgtacacggagagtattaccattccagagggtaagacaatcacgctggacctgaatggacagacgctgatcaacgaggaagggaagcacaccatcaccaacgagggaaccttaaccatcgtggggactggaactgtggacaatgtgagccatgggaagggtgcggtgtacaatgatgcaggcgcaacctgcaccatcctgggcggcaactatactagaagtcaggaaaacgggcaaagtgattcggattccggcggaaacagctggtatgccattaagaattttggaacgatgaccatcggcgaagaaggtgctccgaacgacgcggtcaaggtgtcctttacagggaagtattccagcttagtggccaacggctggcaagacggtgcagctgctggacagcccaacaaagaaccggcatatgagcgagatgcccagctgaccattcacagtggcacctttaccggcgggatcaacaccattaaaaacgacgattatggtgatttgacgattaccggaggcgtctttgaaaacgtggcacagtacgcggtgatgaactggaatatagccagcatcagtggcggcacgttccactcggatgagtgggctgtggtcaactgtggtaacagcagtttgccgatggacaagggagagctgaccatttccggcggcagcttctctggcacgaatggctctgtgggcagaacgacagacgctgcggcgccgcagattaccggcggtactttttccagtgatgtgagtgccttcgccggggatggctatgtgtgcgtgaaacaggaagatgacatgtacgcggtgactggcctgacagcggacaatgcagttgcagccattggagagacttactatcaaagcttggcggcggccattgacaaggtccaagcgggcgaaaccatcaccttgttgagagatgtgcccaatgccaatgggattgtggttccttccgagaaatcgtttaccgtggacttcaacggacacacttacacgctgactgggcctggtgccggctcaccgtctacggagagcaacggattccaactgttaaaggattccaccattacctttcaaaacggaacgattcggattggacagaaccccaataatattaagcgtatcattcagaactatgcaaacctgaccctggaggacatgcagatctatgcggaaaaccaggtggagggggaagactatgccctgagtttcaacaatggtacgattgtcattaaaggaaataccagcatttacacaacgagtgacgaggcgattgcctttgatgtttgcaagttttcatcgtaccctggggtaacggttacttttgacgagagctacacgggaaccatcaacgggataattctgtatgacagcacggatgcagggacgcatcggttggagatcaagggcaatggtcattttggaggggtgcaggccacttcgagtgcggccaatgctgcgaaaagtgcggttgctatctatggcggctattttaacagcgaccccagcagctatgtagcggatggttacattactgtgatcagtgataaggaagactattcttacatggtggaggagaaaacagagacagacgttcctgttgaacctgagattcaagaaccgtctgtcccggaagacttgcctgattcgatcccttctgatagtcaaggggcagtcaaggaggcagcgaagggaatcgaggttcctgaactggaagcagcggcggcaacggaagcaaatagcgttacaaaagatcaggcggctgcgataaaggctgaatccagcttaaaggacgatgagaatgcaaaagttgaagtacaagcttatttgaagattgaaccccaggggtatgacgtgggacaaacctatacgctggatattacacctgtttatgacttggtggtgacgtctaacacagcaggtgcacaaaatgatgtaattaagaaggaacagcccctatctattcacggaaagacgacagtttctattcctctgccggaggggtttgttaatgaggcgcaggatgtttatgttcagcacaaaggctatgagtatgaggcacaagtaagcgaagcgggcggaaagatgaccgccaccttcacgaacccccatggattcagtgcgtttactgtcacgacgaagtccgcagctgtggcggaggtgaatggtaaccggtacacttccttccaggctgcggtggatgcaactggagacaatgggacggtcaaagtgcttgatgctaacgctactctcaatgccaccatcagcggaagctccaagaccatctacgtagaaaacggtaccggcgagaacattaccgtcacgattaacggcacgacaaagacgattgaaaagaatgcaagcgaggacttcacctatacgcattcttcctcctccggcaccacccgctattccgtggaagtgcgcggcaccaccgggggcaccgtgacagccagcccaacccgggcagccaagggcgcgacggtgaccctgacggttcgggcggacgagggctaccagctggacgggctgacggtgaccgacagcaagggcggtacggtgaagctcacggacaagggcagcggaacctatacctttaccatgcccgcgtccaaggtgacagtccaggcttccttcacccaaaaccagtccgggacgcttcccttcaccgatgtgaagacaggggattggttctatgaggcagtccagtacgtctacgacaagggcatgatgaccggcgtgtcggcggaccggtttgcccctgcctccaccaccacccgtgggatgatcgtcaccatcctctaccggctggagaacgagcccgcggtgtccggcggcagcgccttcaccgacgtggagagcggcgcctggtatgccgatgccgttgcctgggcagcggccaacgacattgtcaacggcaccagcgccactacctttgcccccaacagtcccatcacccgggagcagatggcgaccatgctgtaccggtttgcccagtacaaggggatggacgcggttacccttcaggagaacctgacgggctatcccgacggggatcaggtcagtgactacgccattccggccatgaactgggcggttggtcagggcctgattgccgggatggagaacgggaccctggttccccagggcagcgccacccgcgcccaggtggccaccatcctcatgcgtttttgtgagaacgtcatgcagtaagggcgtgagagaaattgaaaatgaggagagagcctttgctctctcctcattttttgtagaataggaaaacaggagaaaaagagagcccctcccgcgaggggcgggaggggagatcagtagtccttgacatcagccagaaattgggtccaggcgtctgggtgatccacgaagtagagggggcagagcttgccggtgacgtcatagtggcggatgacgtggtcccggccaatgccgcagtagtcacatagccaggcggtgagcttcaccaaggcgtcgtaggaggcctgggtgaattggccggtggcgtccgggtgacagacctcgatggagagggtgtccaggttccggtcgttggtggcggaggacttctcatccatggggatacactggatgatctcaccatccagaccgatcaggaaatgggagctgaccgtggtgtcgggctggtcgtaatagtcgtggttctgctgggcggtggtgccgggattgcccacgtagtgaatggcgatgtcggtgacgccgctgagtttttccccccgccggccgctgccgttgatggcaatgatctgcttgtccacccaatggggggtacggtcccgggccagtttggacatttggtccccgccgcccaccaggttgacgacaatccccacaatcaccaccagggccagcacgggaatcaggaggcggaggaggcggggaaggtcccaggcgggccggggggctctgcgccggggcgtctgttttcggggggcggtgcggggacggggtgtggctgtgggcatgacgatgggcctccttttggggcaggattagggcagagggaccggacgggtggcggtttggagccaagcggcctcctctgggggaaggtggggggagagggcctcccggacgcgggcgtggtaggcattgagcagcgtccgctcccggggtgtgagctgggcggggcatacggcgtccagatcaaaaggcgtgagggtcagggtctcgaaccccaggaaggtgccgaagggggtgacagatttctccacgcacagcaggagattttccagacgaatcccataggcgccgtcaaagtaaacacccggctcatcggaagtaatcatgccgggggccagaggcgtttcccgtcccatggggagttggcggatgctctgggggccctcatggacgctgagcaggtagcccaccccgtggccggtgccgtggttaaagtccagacccaattcccacaggggctgccgggccgcgtagtccaggttgctgcccgtgcagccggccttgaaggttgcgtctgccagggccagatttccccggagaactgcggtgtaatgggttttttcctgttccgagaggggccccagggcgtaggtccgggtgcagtcagtggtcccggtgtagtagtgtccgccggtgtccgccagaagaaagccctggccggtgacggcgcggtcactctccggggtggcggagtagtggacaatggcgctgtggggaccggcggccagaatggggtcaaaactgggctggaggtacagggggcaggcccggcggaaggcctccagctgggctgcggcggaacgctcggtaatgggctggcttcccacttgggtcttgagccagtacataaaccgggtcagtgcgatcccgtcggccagatgggcctgcttcatgttggcgatctccacgggatttttgatggctttgcgcagagccgtggggttggggcggtccatcacggaaacatggctgggaatgctggtcaagagggtggtgttgatccgccgggtgtccagcatgacccgctggctgggggtgaggcggcctacataggaataaacactctcgtagggacgcagggagaccccgtcggcctccaactgctccaggaccgccggggagaacacggccggattggcaaagagaaccgcgctgtcctgggtaagggacagatagctcaggaccactgggttgcaggccacgtctccgccccgcaggttcagcagccaggcgatgtcctccagggaagtgagaaggagcacgtcggcaccctccgcggtcatggccccccggatttcccggagcttttcccggcggctcacgccggcgtattcctctgacagcagccaggccggctgggccgagagcggcgggcgctggggccagacctcgcccaccaaatccagctggtggttgatttttccgcccagctgccgggccagcgcgtggtaccgccggccggtccgggcatccacgcagcggccgtcaaagcccagggtctgctccggctgcaggctggcccggagaaaggcctctatggtggggaccccgggctccccctgcttcatgaggcggatgtcagagcccttgagctcctccgctgcctggagaaagtaccgcccgtcggtccacaggcccgcccagttggcaaagaccagcagggtgccggcggagccggtgaagccggagatgtattcccggcaggcaaagtgttcccccacgtactcgctgccgtgaaaatcagcggtggggatgagatacgcgtcgatttgatgttcagccatcacgtcccggagggcctgaagaggatgtgccatgggtactgctcctttatcctgtttctgtatcataggacaattttttgaagggattctgaagttttccttaagaattgataaaaaagggggaagaacgacagacaaattcagtatagcacgagaatgaaaaaatggaaagcccccgccgggccaacgggagggattccggtttgccaacggcgaaatttgtggtacaataccctcaaaccgaaccgggcggatcccaggaggccgtgccggagaaaccataggaaggtgattgggatgatagaacaggtgaccatcgtgggcatgggggcgctggggattctgtacggagaccggctgtccaggtatttgggagcggaccacgtccggttcctggcggcgggagagcggctggagcgataccggagggaaggggcctggtgcaacggaaagaagtgcgcgttccagttttccgacgggacagacggggaggcccagctgctgattttcgcggtcaaggcccccgcgctggaagaggccattgccctggccgccccctgtgtgggggaggagaccgtcgtcctgtctgtgctcaacggtgtgaccagcgaggagaccctcagccaggcttttggtccggagaaggtgctctatgcggtggcccagggcatggatgccgtgcgggaggacaaccggctcacctgtacccaagagggcaccctctttctgggggtgccggaggaggactattttgaccggggagacaagctggaggcggtctggtccctcttccgccaggcgggggtggacgcccggaaggaggcggacattctccaccggatgtggtgcaagttcatgctgaatgtgggggtcaaccaggtctgcatggcctatgcctgcggctatggcggcgtacaggcgcccggcccggctcgggataccatgatcgcggccatgaacgaggcccgcaaggtcggagcctgccagggggtgctggtcacccaaaaggacctgcgggagtatgtggccgttttggatagcttgaacccggaggccatgccctccatgcggcaggacgccctggcccaccgtcccagtgaggtggagctctttgccggtacggtaattcagctggcggaattctacggtatgcaggttccggtgaaccgggcgctgtaccaaacaatcaaagagatggaaacaaattggtgaaggtccggcgtaagcttgacaaaaaaacaaagggcgcggcggcgcggcagaacaaattcgcaaaaaacgaaaaaaatgattgacaggccacgggggaagtgctatcgtgaaaggcaaagaaggaatctaaccccaaagagatggaccgtgaggcgttgaaaatgaatctgtttttcgcggaactgaacatcctggctgtcagcattattggggtactactcgtcgtagtagtaccggaaataatgctaaatgttatgtccaggacaggaaagcgaaacgcaaacagcacgcaggtttgacggaatgatcccgcttgtgggggcccttacgaaccaagatttgcggagaacttacaagctcttgtggttttaacgtttagcacgtgaaagaccacggagcttttttgttgttccaaagacgaaagattcccgaaaaggaggagaaaacagcatggaaatgactggtgccaagatcttgatggaatgcctgctggagcagggggtcgacctggtgttcggctatcccggcggcaccatcctgaacgtctacgatgagctgtatcattacagggatcggatcacccacattctgaccgcccatgagcagggtgcgtcccacgcggcggacggctatgcccgttccacaggaaaggtgggggtgtgcctggccacctcgggcccgggcgcgaccaacctgaccacggggattgccacggcctacatggattcatccccggtggtgtttatcacctgcaacgtgacccaaaacctcatcggaagggatgccttccaggaggtggacattaccggcattgccatgcccatcaccaaatgcacctatctggtccgggatgtcaacaacctggccgacaccgtgcgggaggcctttgccatcgcccgcagcggccggcccggccctgtgctcattgatatcgtaaagaatgtcactgcggagaaggcggagtatgaaccccttccccgggaagaacacattcactccggacgtctggccaacctgatccgccgggcccggaccagcagcctgaaaatgccggagcccaaccaggaggatgtgaacaagctggtggagatgatcgctcagtccaagaagcccatgctcatctgcggcggcggcgtggtgcgcagccggtcccatgaggagttccgggaattcgcccggcggattgacgcccctgtggccattacccttatgggagcgggggggatcgccggccgggaccccttggccacgggcatgatcggcatgcacggctccaaggcctccaacatggcctgtgatggctgtgacctgctcattgccgtgggctgccgtttctcggaccgtgtggccctgaagccggcgacctttgcccggcaggccaagattgtccacatcgacattgaccgggcggagatcaacaagaatgtggagaccgaccaccacatcatcggcaacgccaagcaggtgctggcactgctgaaccagaaggtgccccagtatgaccacagcgagtggaaggagtatgtcttctccttccccacggagacggcctatgatgagaaccccaaccacctgacgcccaagcagattctgcacaccatcgcccggctctgtcccgacgacaccatcgtgtccaccgacgtgggccagcatcagatgtgggccatccagcatttccattttgactacccgggccagctgctcacctccgggggctttggcaccatgggcttcggcctgggggcggccatcggggccaagctgggcaacccggataagaccgtgatccatatcgccggggacggctgcttccggatgaacagcaatgagctgtccaccgaggagttctacaaaacccccgtcatcacctttgtcttcaacaaccaccggctgggcatggtccgccagtggcaggagctgatctatgagaaccgcttcagccagaccaccaccgagcggggccccgattttgtgaagctggcggatgccaacggcctgaagggccgccgggtcaccaccgtggaggagttggaggccgccatccaggaggcgctggaggaacagaagaagggcctgggctatgtggtggactgcaccattgaggagaccgagctggtccgtcccatggtcaacggcggaacccatatcaccgagttcctggtcaactaagaggaggcaagagacatggaagaagtgaaattgcgcacgttgtccgtcttggtggacaatgaatcgggcgttttgtcccaggtgtcccgtttgttctcccgcaaaggattcaacgtggaatccctggcggtggggaccaccgacaatcccgccatctcccgcatgaccatcgaggttctggccaatgagaaccagaccaacctcatgtgcaatcagctggcgaaaatggtgcccgtccactcggtcaagctgctggtgcccagccattccattcgccgggagctggttttgtataaggtgcgcgccaaaaccagtgaggataagaacgagatcattcagattgccaacattttccggggctccatcattgatgtgtccaaagaaaccctcaccctctccgtcatcggggacgagaaaaagaccgacgcggtgcaggagctgctggcggactttgggattgaggaactggtccgcaccggcatgatcgccctggaacgtggtaaatataccattgacgaagacaccaaggaaaaaggagagttcaactatggcaaagatgtattatgagaaggactgcgacctcaaccagctcaatggaaagaagatcgccattgtgggctatggctcccagggccatgcccacgccctgaacctgcgggactccggctgtgacgtcatcatcggcctgcgcaagggcggcaagtcctggcccgtggcggagaaggatggcttccaggtctatcccgttgccgaggccaccaaggccgcggacatcattatgatcctcatcaacgatgaaaaccaggcggagatgtaccagaaggacatcgcgccgtacctcactgccggcaaggccattgcctttgcccatggctttaacatccgctaccagcagatccagccccccgcagatgtggacgtgttcatggcggcccccaagggccccggccatacggtccgcagccaatatgtggccggcaagggcgtgccctgcctggtggccgtggaacagaatgccaccggcaaggcctatgacatcgccctggcctacatcgcgggcatcggcggcgcccgggccggcgtcatggagaccaccttccacgatgagacggagaccgacctcttcggggagcaggctgtcctctgcggcggcgtggtggagctcatgaagctgggcttcgagaccctggtggaagcgggctatgagccggaaaacgcctattttgagtgcatccatgagatgaagctcatcatcgacctgatcaacaagggcggcgtggccatgatgaactactccatttccgacacggcggagtatggcgagtatgtctccggcagccgcatcctgccctatgagcagaccaaggccaatatgaaagcggtgctgaacgacatccaggacggcaccttcgccggcaagtggatcgcggagaacaagaacggacgtaccttctttaactccaagcgggccctgctggccaagcacccgatggagaccgtgggtgcggaactgcggaagaacatgctctggggggacgacgcggaccccgacaccgcttccaactaaaattgaagaaccgccgcggcgcatgccatcagcggcgccaaggagaccggctctcccgtcgtcagacgggagagccggttttgggtttgtggaatatgcctgctgcgggggaaaagaaattgtcatggtgactaaaaataatgtttgcaaaacgggaaaaggtgtgctataataccaatagagatagggaggagctatttcaaaggatcggaaaccttttgccatgtgtgcagccccctatggactgcggaaaggagtcgtcatgatgaagattcaattttccaacaagaatatgactgtccccgatcgcgtctactcccatgcagagcagcgaatcaatgaattggatcatctgttccgcggagaacccgaagctgtcgttgtcttcagcgcggaggacggcaagcacgtcattgagctgacgattttctctggcaccaccattttccgggtggtggaaaaaacctccgatatgctggtctccatcgacgctgcggtctcctccattcggcgccagttgagagagcaccggtcgaagctgtccaacaacatcaacagcgatgcctttgagaaggatgccgatgagctcattttcattccggaggtggaccgctttgacgagccggcctatcaagtggtgcgctccaagcagttcgagtttggccccatgtccgtgcaggaagccattttgcagatgaacctgattggccactccttctttgctttccgaaatgaggagaaggatggcgcgttctccgtggtgtatcgccgcaatgacggcggatacggtatcctggtggataagacctgacagcgggccgcgctaaccggaatctttggatagaggacaaacgggctcccgaaattcgggagcccgttttttgtggaaacctatgggcggttttgctacgggacggggatgaacagcgcgtccactgtggtctccaactcccgtgccaggtggaacgccagggccagggaggggtcgtatttgttgttctcaatggcattgatggtttgacgggagaccccgcatcctttcgccagttcctcctgggacagacccagagacttccgcaaggcgcgaatccggttttccatggtcacccccccagcttccgctggtaccaggccaggctgcaggtgaaaagaatggcgacggtggaaagggtgattaggggattgagcaggacggtttgaccatggaagaacgcgcgcaggacagacaggagcagatagcccaccgtgcctgtgaaggaaaaggtacaggcttttcccacaatcatctgccgtctctcatcccccagacggaggaggcagaaaaacatgcggatgatgcagacaaggagaaagccaaggaagaggagaaaaaaggaaagcgtgatcagatcgaatgacatggggaaacctccaggaataaactcataatgtcaaaaactctttacattatgaggatagcatacttcgattaaaatgtcaaacattttttacagaatagagggagaaggcagcacccgattcgggtactgcctttccgtaagggttcccaaggggattgctgggggatcactgggtacccagccccatgacgtcaatggagtggtgcatgtgaatggccatggcatgccctgcgccggcggcgtcgcgctttcggaagaagtccatcagcagggcatggtccttgcgggtgtcctccgccagctggtccttgtgctggccagaggcaatggcggcggccaccgcctggttgatcatgggcagcaggcgcatcatgaagctgttgtgggtggcccggacaatggcggcatgaaattcccggtccgcctcggttcggtcctgccccaggcggatgcaccggtccacgtcctctccccgggccaggatgtccgccatctcctcctccgtggcccggaggcaggccagccgggcggcgctgggctcaaagatggcccgcagttcaaagaggtccttcagctccccccggacctgatccaggtgggaaaagccatagtcgttgacctgggctgcctggtcggtgacaaaggtgccccgcccccggcgggcctccaggattttttgggagaccaggacatggagggcctcccgcagggtggtgcggctgacccccagctcccgggccagctccacctcactgggcagcttctcgccgggggacaggcggtgctccaccacgatcatggtgtacagccggtcggcggtttgttgggatagactttttttctccatagggacctccttttggggaaaacctgcggatttcccttgacattgctctctctatcctataatataatgtcagacaattcaagagaggtcatacaattttgtatgagtttttataaggaggacagcctgatgcgttccgatcaaatcaaaaaaggcgtggaacgggcccccaaccggtccctgctctacgccctgggctataccgaggaggagctgaaccggcccctggtgggggtggtgagctcctggaatgagattgtacccggtcacatggacctggataaaattgtggaggcggtcaaggccggcatccgggcggcggggggaaccccggtgaccttccccgccatcgcggtctgtgacggcattgccatgggccatgtggggatgaagtattccctggtcacccgggacctcattgccgactccaccgaggccatggtgaccgcccaccagtttgacgggctggtcatggtgcccaactgcgacaagaatgtgccgggcctgctgatggcggccgcccggctgaatatccccaccatcttctgctccggcggtcccatgctggccggccggctgggggatggccggcgcacctgcctgagccatatgtttgaggcggtgggggcctaccacgccggcaccctggacgaggcgggggtgcgggagtacgaggagaacgcatgtcccagctgcggctcctgctcagggatgtataccgccaactccatgaactgcctgacagaggccattggcatggctctgcccggcaacgggaccattcccgcgcccctctctgcccgccgccgcctggccaagcaagcgggcatgcagatcatggagctgatccggcgggacatccggccccgggacatcatgacgccggcggccttccacaatgcggagaccgtggacatggccctgggctgctccaccaataccatgctccacctgcccgccatcgcccatgaggccggggtgaccattgacctggacgaggccaacgccatctccgcccggacgcccaacctgtgccatctggccccagcgggggacacctttatggaggacctggagcgggccggcggcgtttacgcggtgatgaaggagctgaccaagaaggacctgctggacaccagccttctcacctgcacgggaaagaccgtggcggagaacctggccccggtccagaatctggaccccaccgtcattcgtcccctggagaatccctactcccagagcggcggcatcgcggttctgaagggcaacctggctgcggatggctgcgtggtgaagcagtccgccgtggccccggagatgatggtccacaaaggccccgcccgggtgtacaattccgaggaggaagccattgccgatatttatgggaagaagatccatcccggcgatgtggtggtcatccgctacgaggggcccaagggcggcccgggcatgcgggagatgctcaaccccacctccgccatctgcggcatggggctgggggaatctgtggccctcatcaccgacggccggttttccggggccacccggggggcatccatcggtcatgtgagcccggaggccgccgccggcgggaccatcggtctggtggaggagggagatttgatctccattgatatccccaactgcaagattcagctggaggtctccgatgaggaactggcccggcggaaggccgcctgggtctgtccggaacccaaggtcaagacgggctacctggcccgctacgcaaagatggtgacttcggcggacaagggtgccattctggatttttaaaggaattggcggaggcagccctgtggggtgcttcgctgccgtattgtatttgtattgagaagggaagcgtttcaaatgttagacatcaagatcaccaaaaccacagcccccaaggaaaagcccaagggaaatctgggctttggccggatttttaccgaccacatgtttgtcatggactacacccagggagtgggttggcacgacccccgcattgtgccctatcaggacctcaccctgtctcccgccgccatggtgtttcactacggccaggagatgttcgagggcctgaaggcctacaagggggatgatggggccaactaccttttccgcccggacatgaatgccaagcggaccaacgacaccaacgaccgcctctgcatcccccgggttccggaggaggactacgtccaggcggtgaaggccattgtctccgtggaccaggactggattcccacggcccccggcacctccctgtacatccgcccctttatcattgccacggagcccttcctgggggtggatgtctcgcaaaccttccagtttatcatcattctctccccctcgggcgcctattatgaaagcggcctggagccggtgggcatctggattgaggacgactatgtccgggcggtccggggcggcatgggctttgccaagactggcggcaactacgctgcttccctggccgcccaggtgaaggcccatgacgacggctattcccaggtcctgtggctggacggggtggagcggaaatacattgaagaggtgggcgccatgaacatcttcttcaagattgacggcaaggtggtcactcccatgctcaatgggtccatcctgccggggatcacccggaactccgtgctccagctctgccgggactggggcctgcccacggaggagcggaaaatctccgtggaggagctcatccaggcccagaaggagggcaagctggaggaggtcttcggcaccggcaccgccgcggtgatctccccggtgggcaagctgcggtataaggacgatgtcatggtcatcggcaacggggagattggccctctgagccagaagctctatgacacggtgaccgggattcagctgggcagactggaggacaagtttggctggcgggtccgggtggactgaggcgcacccctggaaaaacgagaaaacacaccatttggccgcctgcgggcggccaaattgctgcggagaaaacgataggaggattgacaatggaccaactggtatcccgcttgctcctgtacggagacttgggagaagaggccattctgtccaaactggcggcgctgttccaggcttggaagggaagtagtatgccccggcagaccctggtgcggggcatttaccaccaggtcaaggggctgctggacctggcgacagagtatggctttgacgagaatctgtggcagaactacctgacctttctgctgatgaccaacgagaactccttcagcctgattaccgagcgggtgggcgcccaggacggctcggtgaaccactttgcccggaacgattttcgggtctttcgggccctgttccactacgatttttctgccgtggagggggatttgaacctggactgctttaccaccctcagccattacaaggccattgccaagcacgggcggcggtacaaccaaaacgtcagtgaaaaggtccgggacctgagccgccgtctggccgcggccccggatgacgagacgtttttccgtctggtcacggaacattaccggcagtatggcgtggggatgctgggcctgaataaggccttccgcatccagtcggggccggaggggattgggtttatccccatctacaacacggacaaggtcatgctgcgggacctggtgggttacgagagccagaaggcgcagctgcggcacaacacggaggccttcctggcggggcgaagcgccaacaacgccctgctctatggggacgccggcaccggcaagtcctccagcgtcaaggctctgatcaacgagtactatgaccagggcctgcggatgattgagatttataagcatcagttccgggacctgtcggcggtgattgccaaggtgaaaaaccggaattaccggttcattatttttattgatgacctctcctttgaggagaacgaggtggagtataagttcctcaaagcggtgattgagggcggggtggagaccaaaccggacaacatccttctctacgccacctccaaccggcgaaacctcatccgggagacctggaaggaccgggcggacatggagcatgagaacgacgtccaccactcggacaccttggaggaaaagctctccctctccgcccgctttggcgtgcggatcaactattccatccccaaccggacccagttccaggagatggttcggaccctggcccagcggcagggcctgacggtgccggcggaggtgctgctggcggaggccaacaagtgggaactgcgccacggcggcgtctccggccgcacggcccagcagtttatcaactatatgggtggggccagcgccccagcatttgctggttcggggaaccagatggaaaaaagagaatctccttccccgggagaagcatctatttgaagagggtctaaaagcgaggccgcttctctctgagaaacagggagaggtggccttgtaatttgggtgtgtcggatatgcgaatacgctacaccttgatgaaatcacatataaaagtgttttcaattattcattataccgtaattgaggaaaacaatttgaaatataatagataaaatgatgaaaatgcgttgcgaattttgcgaaattatgttatagataaactatgacatagaaaataaggggggaacttatgcggtatctattttacggaatgtttttgatgatgatactgggtttagcggcctgtacaccgcaggaaacagcttctatttcagcagagcctgtccaagacactgccgcagtggaaccaatcatgccagacaagccagttctcaccttaggagaaaacggccaaggtaccttagctactccggtgagcgtgggtgaggattatggggtcttagtgactctgtctttccaatacagcgataaggaagggaaaaagcagattaccggcatcggagaggccacggtagagaatgcgaaaggctggttccatgtaaaccgggttgcagagattgaccgagagcacatttacctcagtgacgatggttggcaagctacggtaccttttacttattatgtcagcttgggctctggatatgatgcttatgacagtgcggcggtcatctccctgaatgccgatatgcccatgtcacaaccctaaaggacaccagggtatgggagttctcccatgccctggttttatatttttcagaataggaaaagacgaatcggtgaatttcccctttagaagcaaagggatgagcagacagcctggtccaaagagcggcggatcaggctgtctcttttgtttcccggcgttctgccttgcccgggagagaaaagtgtgctatcattttaccgcaaaaatgacgcgggtgcagagaggagacgtaggatggaacggctgctgattttggaggacgatctggccttgggagagggggtccggctggcgctgcagggggatgaccggccggtgaccttgtgccggactttggcccaggcccggcaggcgctggaggaggccgggccctttgccctgctgatcttggatgtgaacctccccgacggcagcggcctgtccctgctggaagaggtcaaggggcgggtgccggtgatcctcctcaccgccaatgatctggagaccgacattgtggccgggctggagctgggggcggaggactacattacaaagcccttttccctggcggtcctccgggcccgggtgaatgcccagctgcgccggggaaaaggcgccgggaatgaggtggtggagaccggggaatttgtctttgactttggccggatggagtatcgaaagaaggggaagctggtggagctgagcaagacggagcaaaggctgttgaggctcctggtccagaaccgggggaccaccctcagccggggggacctggtggaccgggtgtggaccgatggtgcagaatatgtggaggagaatgccctgtctgtcacggtgaagcggctgcgggacaagctggaggaggtcccatccaagccccggtatctcaaaaccgtctatgggatcgggtatacctgggcggtgaagtgagatgggagtgaccgttgttctgtgcgcggtttccgccgtcctgggggccttggccggcgggctgtggtttcgccggcgggaaaagcgcaccctgcaaagcctggatgggatgctggaccaggccatctgtggggaattctccccgaccaagtttgacgagagcctcttttccgcggtggagagccggctggccgattacctggaggcctccgcggtgtcggcgcggaaccttcaggcggaaaaggacgccatcaaaaccctcattggggacatctcccaccagaccaagacgcccattgccaatcttttgttgtatgcccagctgctgggggagcagcctctgcccccccagggccgcgactgtgccgcggccctggagagacaggcggagaaattaaaaaccctcattgaagccctggtgaagacctcccgcctggagaacggcatcctgacctttcagcctgtggtggggcccctggcccctatgctggaacaggcggtggcgggactccagcccaaggcggacaggaaggggatcacactgaccctgctgcccacccaggcccaggcgcggtttgaccccaagtggacggaggaggcggtgtgcaacctgttggacaacggggtgaagtacacccccaccggcggggcggtcaccgtgtcggtgaccgcttatgagctgttctgccggattgacgtgaccgacacggggatgggcctggcggaggaggagcaggccaaggtgttccagcggttctaccgggctccggcggcccgggacggggaaggcgttgggatcggcctgtacctggtccggcagattgcggcggggcaggggggctatgtcaaggtatcctcccagcgagggcgggggagtaccttctccctgtttcttccccgggagggggctgccgcgtcggagagaatctttcgaaactgatagaattcagaaagaatgtggaaagaatcctctggtatagtctgtactgtcgaaggacgtacagactattttctgtttggaaccatggaggaatttgatatgacaatcttggagaccagagacctgcgaaaggtctacggcgcaggggatacggaggtccgtgccctggacggcgtccatctcacggtggaaaaaggagagtttgtggcggtggtggggacctcggggtccggcaagtccaccctgctgcacatgctgggaggcttagaccggcccacgtcggggtctgtaacggtggatggccgggagatttttcagcttaaggatgaggaactgaccattttccgccgccggaagatcggcttcgtctttcaaaactataatctggtgcctgtgctcaacgtttacgagaatattgtcctgcccattcgtctggacggcaaagtagaggaccgggcctatgtggagcagatcatcgccaccctggggctggagaagaagctccaaaatttgcccaacaacctctccgggggtcagcagcagcgggtggccatcgcccgggccttggcggccaagcccgccattattttggccgatgagcccacgggcaacctggactccaagaccagccaggacgtgatggggctgctcaaggtgacctcccagcggtttgcccagaccattgtgatgatcacccacaatgaggagattgcccaaatggccgaccggaccatccgcattgaggatggacagattaccagccgggggtgagagggacatgatccgcgtatccaacaaagcctgcgtccggcatttgggacgccagtccatgaaggcggccaaaacccgaaactgcatcgccgtgctggccatcgccctgaccacggtgctctttacctccctgtttaccatcgccctgtccatcaacgacggctttcagcagtccaatttccggcaggcggggggatataaccacgccaccttcaaatcattgacccaggaacaatttggggagatcaaggaggaccccctgattaaggagtggggcctgcgccggttcatagggatgcccacagaggccccctttcacaagagccatgtggagatcggctactccgacccaacccaggccaagtggatgttctgccagccccaggagggacgcctgccccaggagggcaccaatgaggcggccaccgacacccgggtactggagctgctgggggtggagcctgttttgggggcggagtttaccctgaccttcgggatcggggcgggctcggtggagaccacccagacctttaccctctgcggctggtgggaatatgacgaggccatcccggctgaccatgtgctcattcccgagagccggctggagtccatcctggcggagacgggatatgtccctggacaggacgcctccggcgcgggactctggggcctggatgtgatgctggacagctccctgcacattgaacaggatgtccagaccattctggccaaccacggctatcaggaccagaaccggcaggaggacaattatgtgaataccggcgtgaactggggctacaccggagccaagatggccgagaacatggacccggccacgctggcggcgctggcggcggtgctgctgctgattgtgttcaccggatacctgattatctataatgtcttccagatctccgtgaccaacgacatccgattctatggcctgctgaagaccatcgggaccaccgggcggcagatcaaagctctgctgcggcagcaggcgctgcttctgagctgtatcggcatccccatcgggcttgtgctgggctggatggtgggcggtctgctggcgcccatggtgatccagcggctggacggcgtagtgagtaccgtgtccgtgcatcccctgatctttgtgggctcggccctgtttgccctgttcaccgtgctgctgtcctgcgccaagccaggccggctggcggcgaaggtctcccccattgaggcggtacggtacacggagggcagccaaagcaagaagaaggcaaagcgaggcagcggaagggtgtcgcccttttccatggcccgagccaacctgggccgcagcaagggcaagaccgtggtgacggtgctctccctgtccctggcggtggtgctcaccaccataacggccacctttgtggggggctttgacatggacaagtatctctccaaaagcatctgcacggactttgtcctggcggacgcggggcattttcaggtgggggacaccttccacgccggtatggccctgccccaggaggtcattgaccaggtgaccagccagggcggcgtggccgaggggggaaaggtctatggaatgacgaccgcagtacaggagggcgtgacggaggactggttccgttctgccaaccagcagtggtataccgaggagcaaatggagagcttgattacgggcatggaacgggatgctgggaaccacctgctggacagagcacagctctatggcatggaaggctttgccttggatcagctggacgtgatggaaggggacctgtccaagctgtatgagccgggcgggcgctacattgccgccgtgtataacaaggatgactatggcaagtggaggccagactcccattgggccaaggtgggggaccaggtcaccctgcggtacgtgtcagaatttgaatattacagccccaccaccggggaggtcttcgggtccgaacccccggagaaagaggcatacttgtcccgggcggtggaataccaagaggttacctatgaggtggcggcgttggtagctgtgcccagctgtctgggttatggctactatggggcggatgaatttgtgctcaacgatgcaacattctgccaagatacgcagagtgacagcgtgatgctctatgccttcaacacccaggagggcggggcgacggccatggaggacttcctggccgactacacggaaaaccagaatccccaatacgactatgtgagcaaggtcacctaccaggcggagtttgagagcttccgcgccatgttcctgatgctgggcggggcgctgagcttcattgtggggctggtgggcgtgctgaacttcttcaacgccattttgacgggcatcctgacccggaagcgggagtttgccgtgctccagtccatcggcatgaccgggcggcagctgaagatcatgctggtctgggagggcctcttctacgcgctggggtctatcctcattgccctggtgctggccctggtgctggggccgctgtccgcacccaccctggagaacctgttctggttcttcacctatcatctgacggtgaccccggttctgattctgctgccgatctttctgctgctgggcggcctggtcccgctggcggtttaccggtcggtggcccgggtctccgtggtggagcggctgcgggaggcggagggctgaggcgctgccctgtcaaactgcataatcgttcggaacaaaccggccctatcccacaggatagggccggtttgttgatggcgttttggcagtctcgccgggaaggtgcaaagattgcacgaaaacggaagcagggggaacacaaaactatgaaaagtcctgaaagtgaaaagaagctcagatatttttttcggagtgcttgacattttgcaggggaagtgctacattagctttagcactcagggagaatgagtgctaaaatgatagaagaggccaaaggaggcctgagaatggaactgtcggagcgcaaaaaacagatccttcgcgcggtggtagaaaactacatacagaccgccgaacctgtgggctccaaagccattgtggtcagcgccggcctgaaggtctcctccgccaccatccgcaatgagatggcggagttggagaccctgggttacctggaacagccccatacctccgccggacggattccctctcccaagggataccggctgtatgtgaacgaactcatggaggagcaccggctgaccatgcaggaggcccaaaagatcaacgaagctctcaacctcaaaatccgggaaatggaccaggtgatgacggaggcggggaagatcatctcccagctgaccaagtatcccaccttttccctgaccaaggggaccagaaaagccaccatcgcccgctatgacctgctcatggtggaggaatcggcgttcatcgctgtgctgatgaccgatggccagatggtgaagaataagctcttccgcctgcctacccccctgtcggagacccagctgcagctgctgggcaccctgctgaatacctcgtttacgggcctgaccctggaggaactggggccggaactggcgcgggtggcctcccatgccgggggcgaggcctacggactgatcagtctggtggtctccttcgccatggaggtgctggaggagctggagaccaatgtgattcacaccgctggcatccccacgctgctggcccacccggagtaccagagcctggagcgggcggaacccctgatgaactttctctccgagatgggagagggggtcaacctgccggtggtgcagggagaaaacgtaaaaattctcattggcccggagaacgtggccgacgagttgaaagaatccagcgtgatcatggccagctatgatattggcggcggaatgcagggcgtcatcggcgtggtgggccccacccgcatggactatgcggacctggcggcccggttgtcctactttgcggaaggtctttcccgcatgtttggcaaaggcgagattccgccccccgccgggagcgaacctgaagaatgaggaggataccacatcccatgagcaagaaaaataacgatcagaatcaggtccccgaggaaaccaaggaggagaccccggaggaagtgaccgaagcctctcaggaaaagcaggaatccagccaggaggaagccctccagcaggccctgcgggagcaggaagacaaatacctccggctgctggcggagtacgacaactaccgcaagcgaagccagaaggaaaaggaaaacgcctggaccaccgccagggcggacaccatcaaggaactgctcccggtgtatgacaatctggagcgggcgctgaagcaggagaccgccgacgaggcctatgccaagggcgtgcagatgaccatgacccagctcaagactgtgctggaaaagctgggggtggaggagattcccgcccagggcgaatcctttgaccccaatgtccataacgcagtgatgcacatggaagacgaggctttgggagagaataccgtagtagaagtattccaggccggctttaagatgggagaaaaggtcattcgccacgccatggtcaaggtggccaactgaccggccctgtccgggcggacagccccgaaccatttccagatcaccatataaatttgataaacgtgtaaacaacagccatctgttcttgataaggaggaacaacattatgtctaagattattggtatcgacttaggaaccaccaactcctgcgtctccgtgatggagggcggcgaggccgtcgttatccccaacgcggagggcaaccgcaccaccccttccattgtggcattttccaaggacggcgagcggatggtgggccaggtggcaaagcgccaggccatcaccaaccccgaccggactgtgatttccattaagcgtgagatgggctccaactacaaggtgaacatcgacagcaaggcgtacactccccaggagatctccgccatgatcctgcagaagctgaaggcagacgccgaggcctatctgggccagaccgtcaccgaggcggtcatcaccgtccctgcctacttcaccgacgcccagcggcaggccaccaaggacgcgggcaagattgccggcctggaggtcaagcggatcatcaatgagcccacggcggcggccctggcctacggcgtggacaaggaatcggatcagaagatcatggtctatgacctgggcggcggcaccttcgacgtctccattctggagatcggtgacggggtcatcgaagtcctggccaccgccggcaacaaccggctgggcggcgacgacttcgacaagtgcatcatggactggatggtggcggagtttaagaaggccgagggcatcgacctgagcggcgacaaggttgccatgcagcgcctgaaggaggctgcggaaaaggccaagattgagctgtccggcgtcacctcctccaccattaacctcccctatatcaccgccgatgccaccggccccaagcatctggacctgaccctcacccgggcgaagttcaatgagctgaccgcccacctggtggaggccaccgccggaccggtgaagcaggccatgagcgacgcgggcctcaccggcaatgacatcgccaaggtcctcatggtgggcggctccagccggattcccgctgtgcaggatgtggtgaagaagctcaccggcaaagagggcttcaagggcatcaaccccgatgaatgcgtggccatgggcgcagcccttcagggcggcgtgctggtgggcgacgtgaagggcctgctgctgctggacgtgacccccctgtccctgggcattgagaccatgggcggcgtgaacaccaagctcatcgagcgcaacaccaccatccccgccaagaagagccagatcttcaccaccgcggccgacaatcagacccaggtggaggtccacgtcctccagggagagcgggagatggcccagtacaataagaccctgggccggttcagcctggacggcatcgcccccgcccgccggggtgtgccccagattgaggttaccttcgacatcgacgccaacggcatcgtgaacgtctcggccaaggatctgggcaccggtaaggagcagcatatcaccatcacctcctccaccaacatgtccaaggaggatgtggagaaggccgtgaaggaggccgagcagttcgccgccgaggacgccaagcgcaaggaggaagtggacacccggaaccaggccgaccagatggtctatcaaagtgagaaggccatggaggagatgaaggataagctggatgccagcgaggtcagcgagctggaggcggagatcaacaaggtgaaggaggccctgaagggcaccgatacccaggccatcaaaaccgccacagagagcctgacccaggccttctataaggtcagtgagaagatgtatcagcaggccaatccccagggcggccagcctggccccgatatgggcggcgcgggctttggcggccagcaggccggcggagcagccggcggcagcgggaacaagggccccgatgatgttgtggacgcggattacaccgtggttgacgaccagtaagaaagcgaatccaacgcagccagcgggggacaggatttcctgtccccctgcttgtgtgaaaaggaagcggcggggctgcgccggttccatagagcctattgtgaggtgagaaaccaatggcagaccagaagaaaagagattactatgaggtcctgggggtcaagaaaggcgcctcggacgatgaactgaaaaaagcttaccggaagctggccaaacagaatcacccggacctgaacccgggcgacaaagcggcggaagcccggttcaaagagatcaatgaggcctatgaggtgctctcggacaaggagaagcgggccaagtacgatcaatttggctttgcgggggtggaccccaattttggcgccggtggtcccggcggggctggcgggttcggcggatttgacgtgagcgacctgtttggctccttcttcggcggcggctttggcgggttcggcgggggcggacagtcccggacaggaccggccaaagggagcaccgtgcgggccagtttgaccctgaccctggaggaggcggccttcggctgtgagaaagatgtgaacatctcccatgtggagtcctgtgacgtatgcggcggcacaggctgtgagccgggcaccaccgcagaggtgtgcccggagtgccacggctccggccaagtgcggatgcagcagcggaccatgtttgggaccatgtccacctccaccgtctgccccaactgccggggagaagggaagatcatccaccagaagtgcaaggcctgcggcggcagcggcggcgtccgccggcagaagaaggttcacgtgaaagtgcccgccggcattgacaacggccaggccatttcggtccggggccagggggatatgggacgcaacggcggtcctgccggggatttgattgtgggaatcaatgtgatgccccatgcccggctccgccgggacggcgcccacatttacttggatcagacggtttccattctccaggctacgctggggggtgaagtggagattccctctctggatggcaagatgaagtgtaaggtggagccaggcacccagccgggcaccaccctccgcctgcggggcagaggcgtgccggccctcaacggcagaggccggggggaccagtatgtcaccatccgggtggagattccccggaacctgaacgaggaccagaaggaggctctgcggaagtttgccgaggccatgggagagcttcccgcctccagcagcgcaggggaaagcggggagcggtccgtgttccaccgtcggaagaaaaagtaaggctccgtagacagaaaggaaaacaatatgtttcttgccgattgccacacccactccctctgctccccggacagcaatgcccccatgctccagatggcccagaaggcctatgaatatggtctgcatacgctgtgcctgacagaccactgtgatctgctgagcctggagggggagcggactctggactatgattggacccctgtgcaccgggagcggaaggggatgctggacgccttcggtgcccggctggacctgcccatggggctggagtttggcatgggccatctgtttcccgaggcatctgagaaaattctcggggagcccgggctggattttgtcatcggctcctgccacaacctggacgaggcggcgggaggacgggacttttatctgctgccctatgacaccctggaggactgttatcgggctctggacaactacttccagtccatgctggccatggccgccagcccctgctatgatgtggtgggccatgtgatctatccgcttcgctacatgaacggcccctatgacacccccagcctggaccggtatcgggatcaaatccgggagatccttcgcctggccattcagtcgggccggggcattgagatcaatacctggaaggggcagacgctccgggaatggattcccattctgcgggattaccgggagttaggaggggagatcctcacagtgggctcggatgcccacgcgccggaacctctgggccgggggattcgggaggcctatggccttatggccgactgcggcttccgctatgtggccgtttaccatgcacgcaagccggagatgatccggctgaaataacggggcagggccccgccgaaaaaaacaaggaggagacgaccatgattgcattgggttctgaccacggcggctttgacctgaaggaacgggtgaaggcctatttagaccgggagggcatcccctatcaggactatggctgccacagcaaggagagctgtgattaccctgtgtttggcaaagccgcggcggaggccgtggcctcgggggtttgtgaaaagggcatcgtcatctgcaccaccggcatcggcatctccattgcggccaacaaggtgcggggcatccgctgcgctctgtgcagtgatcccctctccgcggaaatgacccgccggcacaacgacgccaatatgctggccatgggcgccggcatggtggggcccaacttggcagagcggattgtggaggtctttctccacacggacttcgagggtggacgccacgcccgacgggtggggctgattacggagatggaagaggcataaattatagaagacgggtacaccccccaggcggctatgaccgcctggggggtgtggcatggaaaagagaaagaggcacaccgtgtataaaaaaagacaagtccatctctgttttgatgccaatatcagagggctcctcatgcagacctatcatgcagagatgggcagaaccatggaccttctttttttggatgaggacctgtccgttgggcgattgaatcccttgaccccttcctttcgaaagcgaatgttggaggaacggggaattctgacagaagattctttttgtggggaataccgcacgtttcttcggagaatagagggactgtcgccggaggattcctgttatgtctggtgctccaaggacccctatgagctgacggggtttgcgctggccagtacatatctggcctccaaacgagaacaggttctcttttgcgacagtggtctgctgcaagacgttgaacccgcaagggcccgggcggtctgtgacgcgttactctcccgagctgccgtgacctctctgcgcccttgggcagccctttggaagcgattgcaggaggaaaacacgtctcttcggattgctgtggatgggctccctcgctccgttccagagaccttttttgatccatggattcaaagacttttggctcaagaggcgccacaggagagggacaatttttccattgccatccaggtggaggaagagtaccgtacccgtttccacgggaagatgaacattcattttctgcttcatcgtgtggacgttgtgagacggcgggagatgtaaaaaagaggaggagctcctactcggaggaggcctgccgttttgggactgacagcacccccctgcaccggaagaatcggagcagggggtgctgtcaataaaatatatacaaaaataatgggattatattgcgatttccacacgaaaatgatatattatagatagaagaagagggtacccacgccagaaggacatggcagacatcatgaccccggaaaggaggggacaatgatgaggatctactcgattcgggagagaccggaatacattccggccatgctggaaagcttggaaaaccattggccggcctgtatgccgtggattcagaagcacatggagcaggtgcgccagaccgacgccccccttcccgacgcctacattgcggtggagaagggcaaggtggtgggaggatacactctggccgtgaaagagattctctggagtgaggacaaaggcctttggattgccaccctctatgtggaccctgcgtttcggggcaggcatctcagcccggtcctgcttgctcatgcccgccggcagggcggccggctgggatttgagaagatctatctggccacagagcacagcaactactatgagaagtatggatttttccccattggccccgacgcctgtgcctggggagagcccacccggatgtttgaaaataccacactgccaccaaaagtgagacgaatcgcatagaaaagatccaaaaagccccggttcaccgaaccggggctttttggatctgctttctctgtatcgttaacagatgaaaacgggggagaccataaatggaattacagaaacagctcaggctctttccgcggccaggaatacaggtcctccaactctgttttgtgatagagataattggggtcatcaaaatacttggcctgtttgggacagaggcggacgcagcggttgcacttcatgcacttgccgggcaccaggtgggcgtcctcagggtcaatggcccccagaggacattcccgggcgcacaggccgcactgggtacaggcgtccgtggttttgggtttcacagggaggatattgatggggtttccgtggcggtcccggggggtgtagtagggacccacggggtcgttgcccttcacggcaaccggggaaaggctttccagggaggtaagggcctccactttgcggaagatttggtcggcaaatcccgaggcaatggtgagatcgctgcggtccggccggccggccgcctgggtgagggagaaggcgtgctggcaggagaatgccccgccggccaccgtatgaaacccgccggcctccagggtgtttcgcagttccatcagggcgtcgtcgtagtttcggttgccgtagcagaccacggggaccgccagagccccgttgccctggacggcggccacgaagcggatgagtaggttgggaacccggccggcatagactggcgttccgaataccaccagatctcccggcgcaaaggctttgggcgtttttcgggcctgcgggtgggtgaagtcatagatttccatggggcaggcagtctgctgagacagccgccgggcgatttgcgtgaccacttttttggtggtgttggtggcgctgaagtaggcggcccacacggttttggttgtcatggaggagttcccctttcctaaaatagagtgcgtggttggtatccattataaagatttcctataaaaagtaaatatcctgggggaaaaaggcgaaagggaaataacctcttccgccgtgttgatttttcccggtatattccatataatataacctaaccatagccttgtcgaagactgccgttttttcccagcggcgtgttttagtcccggggaagaacgtgttgcgtaagatagaagcaagcggcccccagagctctgtgggccgggaaaggggaggaaccatggaccaaacccatgcgacggaaacccatttggaggagacaaaaccgaatcccagaaaaaagattctcctgctgtgctgtctggtggcggccatccttgtggtggcatactgcgttctgtgcggcatggccggaagagggactatttatcccaatgttaccatcagcggggtgaacgtggggggactgacaaagcaggaggctcagaccgccttggagaaggcggtgcagaagcaggcgccggacgagagccgaggggtggttttcgcggtccgcaccgccgagggcgaggaaaaggttgtggaggtgcctttgtccagtgtggccacggactacgcggcctccatcgaccgggcctggcaggtgggaaataccctgtcctttggagcccggggcggtgtgtatctgaaatgcctggtgcagggggaaacggtgctgccggtgtaccaagacagtgaaaacctggataccatcctggatggggtggagcaggcactggggcgggacccggtggagccaacttgggagaccaacgacacccacttgatcctcaccaagggccagcccggcaaccaggtagatcgaaaggccattcaggaggcgatttttcaggccctggggaagaacgaaatggtagagctgaaaggggcaaagccccaatttaccatagatttgacccaaaccctgcccggggagctggacctcacagaggttttggggaaggtggagcggaaggtgcaaaacgcccgctttgacaaggccaaaaaggagtttcaggtggatcagccgggggtctccttcgacgcggcccaggcccagaccgtttttgatgggctggactggggacagagccaggagattcccctggagatcacccagccggagaccacggtggcggacctgacaccgcagctttatcaggatgtgctgggctcctgcaccacaaacatctccggcagtgccaaccgggtgaggaacattcagctggccgcccagtatttcagcggtaccgttttaatgcctggggaggaattctcctacaacggtgttgtgggacggcgcaccgcggcccggggctttttgcccgcccccgcctacgtgggcggagagacggtgcaggagacggggggcggtgtctgccagggctcttccacagtgtatctggccgcgctgcggtcaaacctggaaattgtggaacgatatccccacggctatatcacccgctatgtccccgatgggatggacgccacggtttactatggggcgaaggacttccgattccgaaacaatacgcccttccccattcaagtggtgggctctgtgtccggtcggtctttgacggtgagtatcctgggaaccaagagcgacaacatcactgtggagatgaccaaccagaccgtcgggaccaccggctacaagacggtctataaggtggacagcagcctgcctgcggggtccacccgggtcagtgtgaccccctacgccgggtacacggtgaaggtgtatcggaacctctatgagaacggcaagttaaaggacaccaagctggagagcaccagtgtgtatcgcagccgggataaggtggttctggtgagcccggaggatgccgcgcagtatggactctgattccagcggcagaaaggaaaaacgtatgaaacagaacttgcctactcgccgggagatgaaattcctggccaaacgtctgatgatgcacccgatctgcatgcgggtgaccctcttgctggtctgtgtgcagctggctttctatggcctgcgcgtcttctgcggcgggacgctgacctatggactggccaaactctctgagtatggggatacggccagcgggatttactttaacgcggagggcttcagcatcctctttcggatggatctgacccagacggtgctggccattcccgtgacctatcatcagatcctggtgtttttgctggtcaatgccctcttttttgtcctcctggcccctctgcgtctgggggcgatggagcagtattggggtgtgctgcggggcagcacacaactgagtgtgttccgggtgtttcagtggttccgccagcccaagcgcctgggaaaggctgtggcggtggagtttgtgctgagcattctggtgcggctggcggggattgtggccaccattcccagcctgtatctcttctatgtcttctataccaacaccccgtcggcagacgcctataccacactgagttccctgacgcagatgggggcaacccttttggcggtggcggcggcgctgtttaccttctggctccacagtgtctttctgccggtgcggtactgcctgtgcgcccatccagagtattccctggggcagaccttccgccggggactgcaaagcgccaagggggttcggggggctttcttccggttccggctgagttacattttgtggtttgcggcgtcccagctcacctatggggcgatggacctgtttgtgaccccttactcctccctgggcgggatggtgttcctccaggaggctgccagggccagacagggtggaacacagacaccccaggcaagctaagataaaaaacctccgcagcgaacatcgctgcggaggttttttatggggaagcatcctctttccggcggagagcgcggtaaaatccaatggcgacgatcagagagatggtgtctacgatgggctgtacccacatacagccgtagaggggaagccaagtgtccaggagaaacagcaaagggatgtccaggacccctttccgaagaatggagcagaccagggattcccgggctttgcccatggcctgaaactggatgatcatcggatagcacagggacatcatgggcatggcgatgaccattcgccgcagaaatcctgcgctgtaatgaatggtggccgggtcgtcgatgaagagagaggccaactgtggggcgaagagctcaaaggtcacaagacagagcagggcaaaggccagggagagggtacagcccagtcggaaggcggcccggcgcttttcctgctgtccggcggcatagtggtaggccagcaggggaagcagaccattggagacgccgatggaaaaatacaggggaagctgatccagctttttgacaatgccaagccccgccaccgcctcggtggcgtagcgggagacaaaccgggactgggcggccaccgccaccacggtaagggcatactgcagggcggaggggaatccgatggccaggatctcttttccatacttgcggataaacggcaggtggcgggggtggaggtcaacggcggtctctccctgacagcgcagcaaatggaccaggaagtaaagggtggagagaacgttggacagacaggtggccatgccggcgcccacggcgcccaaccccagaaactggggcagaataaacaacgggtccagcaccaggttggcggccccacccaaagaaaggccgaaggaggcttgccctgccttgccctccgcccggaccaggttggccaaaagggtgctgaggatggtggcggggccgccgatcaccaccacccattgggcgtagcccagggcgatgggaagggtgtcctgggtggcgccgcagagaacgagaatgggctgccggaagcaccagaagagaaggcagaaaagggccccgctgaaaaggccgaaccagaaggagatggaggcaatccgccgggcttcatcgggggccttccgccccagtgcccgggccaaggcgctggcgccgcccacgccaaacaggttggagatggcagtgagcatgagaaaggaggaatagactacggtgatggccgctgtctgactgggctggttgagcatgcccacaaaataggtgtccgccaggttgtaaatcaaagtaatcatctggctggcgatggcgggaaaggtctgccggaatacagcttgccgaatgggtaaggcgtcaaacgcgttggtagactgctgtaaagaggacataagggtcatctccttttaagaatgttctatcttaattcattcaatccaccatttgaaaaacaatacctaccactgcggcaactgcgatgaagaagacagagggaagctctttcagcttgggaagattcatcgcagtcagcatgattccgaacagcaggatagagggccagtggagaacaaggccctgttccgtgctgaacaatgagaccgcgcacacagaaaaagccgctgcgccaatcaggccgacggaggcggggcgcagggcgtaaaagagtcctttgaccttcgggttttgccaaagggtattgagaattttggagacaagaagaatgatgatcaccgcgggggtcacaaggcccaggggcgcgatgatgctgccggggattcccgcggagacatagcccacataggtggccatattcaccccgatggggccgggggtggcttcggagatggcgatcatggtggtcaggtccgccgtggtaaaccagccggttcgtgctgacaggtcaaacaggaagggaaccgtggccatcccgccgcccatggagaacaggcccaccagaaaaaactcccagtacaggcggagcagcaggacgatcatagagggcgctcctttcggatgcggtgatacgccagaccgaacagaccggcgcccaccaccagaatggcgggagagaggcccacaaaagcggccaggatcagcacagtgagaaagacaagaaaggtgggcagatccagaaccgccttacggtagaggcggatggtgctgttgatgatcagggcgcagacgcaggcccgcacccctgtcagcgcgtgctgcacccagggattttccgcgaaagaccagaagaaggcggagatgatggtgacaatgatcatggggggcaccagcacgccaagggttgccaggagagatcccgacagaccgtggacccggtacccgcagaaggtggcggtgttcacggcgatgacgccaggggtgcactgggcgacggcgttgaggtccagcagctcctcatcggtcagccagccctttttggataccagctcccgctgaaaaaacgggagcatggcgtagccaccgccgaaacagctggcgctgatccgggcaaaggtcagaaaaagatcccaattctcgcgcatgcggtctccttcccgcccatcaggcgcagagcgccaggatgacctgggcgtaaatcttggcggcggtgagcaggtcccccacatgcacccgttcgtcggggccgtggagattggagacgaagcccggcatactggccccaaaggccaccccgccggggatatcgtggacataggtgcctccgccgatggccaggcactggctcttccggccgctgtactgctcatagcatttggccaggacctggaggaagggagagtcggcgggaacatggtggggcgggtccagaggaccctggacagtgaacccggcctgggtcaaggcagcttgcgccgggcggcagatggtctcctcggttccgcacagcggggtgcggctgtcgaaccgcccctggcagccggtgtcgtgcagggtcagcatggtgaaggccagagtcaggggaccggagaggtcatcggcctgggcgatgcccagggcctgcccgtggtggtctccgtgggggaacagggcgtgaagggcccgaagagcccgggtggaggggcagtccgccaggggcagggcggccagcagggccaccagggcggtctgggcgttgtgcccctcttccggcgtggagccgtgggcgttttgcccgctgcagaggatgtggacccctggtcccttctcctgacaggagaaagagatggcctcctccagcgccaggtcccggatggcggcttccacggtgtccagagacagacccaaaaccgtggcctgggccttgggagggaccatattcagccgggtgccgccggtgaagtcagagacccggggcagagcctgctcctggggccaggcagcctgaaaggtgggctgatagtgccctttttcaatgttgatgatggggaaatcggcgtcgggagagatggtatagggggcataggggtgccggctgtaataccatttcacatcccggaacccggtttcctcgtccgtgccggcgatgagacggacattccggcgcagggggatgcccaggtctttgaccgctttcatcgccagcagggccgctgcgacaggccccttgtcgtcgtcggtgccgcggccatagagaagaccgtccaccagcttgggcacaaaggcctcggtgacggtccatccctctccagggtctaccacgtccaggtgtcctaagatgtggaggacggtttcctggtcgttcaggtccactgtgcccacatagccctccagattctgccctgacaggccccaggaccgggccagggccagcagctcctccagggcggcggccggcccttcgccgaagggcttgccaggcagggcggggcctaaggtgctgtcaattcgaaccagccgggagacggcctccaccagcatcggttccttgtctgcgaagtagtgttgaatggcttgctcgtgcatgtcaggtggcctcctcctcttgggttccgttgacctcgtccaggtacttgtaaatggtatagcgggacacgccaagatgggcggccacatagggcacggcccggcggtaggagaacgcgtccatgtttttgaggtactcaatcacccggagacggtctgccttattcatttcccgggcgggcttgcccacccggagaagcgcactgtcaaacagctcgctgatcccgttgtcccggggcttatagacggcgctgtgaaagtccacctcggtgtgcatcaggtccagcaggacccggttggcgtaggccagaggggtaaaatcgtagttgatgccaaagcccaggtggtaatcttcccctttgatggagaaggtggagcttttggtctgctgtccactgggcgtcacggccaacagattgaccacgtcgttgtccaggtagaggtcctgctccaccccggtgacgtcccgggtggaacccaccgagcggccggagacgtggccgttgtagatggccagcaccgggtgaagggggtcggccaagtcgtgaatgacggtttcgcagttggagccaaacatctcggcgatgcctttcgccatctggtccagcattgtgaaggcttcttgacgagtcatgggggatatcacctcttggaaaagtggaaaaataaacgcaaaatgcccctccggtatggaagggcattttggaaggaaacgattacaggaagttcaacaccagggtcagtacaataaagacaatggcgacccatttggtccagcgagctaacttggcatcagcggattttgccttgtttttggacaggaaagaatcgctggcaccggagatcatgcccaggccagagtgcttgccagactgacccagcacaaacagaatgaggacggcgcctgacagcacctgaatgatcgagaggattgttacagccatagtatatattcctttcccttgccttatcccatgaatgtaaaaaaatttctggaaaacggcatctctttcccattgaaagaagagtattaaaattgattacaaagcatgataccatactattctgtcatttgcaaggcttttttccaggaaaaatggggggttaccaaagggtgaagagcattttggccacctccgcccgggtgaccggggaactgggccgcagcttcccattggagccgcccaccacctccatgcccaccagcgtggccacgtgttccttggcccagctggggacagcggcggcgtcggagaaggcggacagagcggcttggggatagcccttttccgtcatccggcccagaatggtcatggcctcggcccgggtgatggaggcccgggcattggcccgcagggtcccgtcgttggcccggctgccctgcatgatgcccagctcgtaaagggcctttaccgcgttcagatcccaagaggggatgtctttggtatcggtgtagggaagggagaccgacgcataggcgttcaggtccagtcccagccagttggccgccatcagggcaaagtccccccgggtgatgttgcggttggggtagaaattggtgacgtctccgctggtgatcccggagatgatgcccagctcactcaggcgggcggtataggtccgggcccagtggttggtcatgtccgcaaaggggttggaggaggcgccggagagggtcacggaatcccgggccagattgccgcaggtgtcggcggcggtgacggtgacctgatggctgctcttgcccaggccggagagggtggcggagagggtgccggaggcggcgtcccactggaaggggacaggctgtccgtcaaccttcaaggtcatccgatccgcagccaagcccccctggagattgtcggtgatcttggcggttgccgaagtcccggagacggagagggagaccgtgggcgcggtggtgtcccaggtgttttcgttggacaggaccacctgatccagccacagggtgcccttttgggaagcggacagagagaggccgtcgaaggagaccgccccctccgggaccgcggcgctgacctgtttccagccggtaaagtttaaggtggccagggattgggtgacgggggtgccgtcctcataggagaaggcggcggagagaatgctgccggacccatccccgtagacccaaagggagacataacggtccgcctgggtcagggtgcgggaggcggtcagcttggcgtcgttctgataggcgacctggagactctggctgccatagcgcacctgggtatcgttcagggaaagggtggcgttctgggcggagaaaccagggtcgcttccttcaaagtccgagagaagggtgtacttggcgggggcggtcaccgagacggagatggtgaccgcgtagttgcccgaggccaccttgattttaccgctggcggtgttgcttcccgcggtgaataggccatccgaggtgatgg

SEQ ID NO: 2227 - DNA, 69330 bp, KLE1738
cgccgatggaggcggggacggagaaggtggcgtagcccgcctggttggccagggcccggagggttccctcccgtcggtccgtggtggcaaaaatccggtcccgggcgccctcccggccgtatttttcctccagcagccgccggaagaggaaaaaggcgatggaggactctgtggtgtcgccggatttggagatgacatttacggagaagtccttgtcccgcacgtagtccagcagctcggtcagggcatctgaggagagggtattgcctgtgaagaaaatctgaggggtctttttacgcagcaagttatagttgggggaggtcagtagctccagcatggcccgggcgcccagataggagccgccgatgccaatgacaatgagaacctccgactgcccccggatgatccgggcggtttggagaatccgctgcagctcctccgggtcgtaggaggccggaagatccacccagccggtgaaagccccccccagtccgttgccccgttccagcaggttccgggcctcggtcaggccgtccagccgggaggaaagccagttctccggcaggaaggggagggcgtgggtcacatcaaattgcagcaaatcaaacacctcctgatacaggcgcgacgttccgtcagactcagtttttcagactctgcatgggggccggaatgcggccgccccgctggatgaagggggcgctggagaagggatggacggggatcaccggggcggagcccagcaggccgccaaactccacggtgtcccccaccttcttgccgggggcggggatcaggcgcacggcggtggtcttggaattgaccatgccgatggcggcctcgtcggcgatgatggctgagagggtctcggcggaggtgtctccgggcacggcaatcatgtccagacccacggagcagacgcaggtcatggcctccagtttgtccagccccagggccccctgctgggcggcggcgatcatcccttcgtcctcgctgacggggatgaaggcaccggagaggccccccacgtggttggaggccatgacgcctcccttcttcaccgcgtcgttgagcagggccagggcggcggtggtgccgtgggtgccgcagacctccagccccatctcctccagaatccgggccaccgagtcccccacggcgggggtgggggccagggagaggtccacaatgccgaaggggacctccagccgggcggaggcctcccgggccaccagctggcccatgcgggtgatacggaaagcggtctttttaatggtctcggccaccacgtcaaagggttcgcccttcacctgctggagggcgtggtggaccaccccggggccggagatgcccacgttgatgacgcactccggttcccccgccccgtggaaggcgccggccatgaaggggttatcctccacggcgttggcgaagaccaccagcttggcgcagccgaagccccccgccgcggcggtgcggtcggcggtcattttgatgacccggcccatctccgccacggcatccatgttgatgcccgccttggtggaacccacgttcaccgaggagcacaccaggtcggtggtggccagggcctcggggatggaggcgatgagctttcggtcagactgggtgaaccccttctgcaccagggcggaaaagccgccgatgaagttgatgccgatggttttggcggccttgtccagggcggcggcaaagggagcgtagtccgctgtgtcactggcggaggccaccagggagatgggggtcaccgacacccgcttgttgacaatggggatgccaaactccttttcaatggtctggccggtggccaccaggttttgtgcccggcggcagatcttgtcatagaccttccggcaggcggccttggggtcggggtcggcgcagtccagcagggagatgcccatggtgatggtgcggatgtccagatgctgctggtcgaacatgtggatggtttgcagaatttccgaggaattgatcatgacaatggttctccttcctcagatccggtgcatggcctggaaggtgtcctcccgctgggcccggatgaccatgcccatctggtcgcccagagcggacatctggtcggccagttcgccaaaaggcaccttggcggcgccggcgtccaccagcatgaccatggtgaaaaagtcggggggaaggatggtctgggtgatatccagaacattgacattctgctgggccagggtctgggtgaccgaggcgatgatgcccacccggtctttcccggcgacggtgataactgcacgcatagtgaatgatacctctcttatccttagtttgatcttatggccgttctgggctgcctatgcctgggcgtcggcctggagttcgtccagggtgaggggaaaggcggggagaaactccgccaggaaatagtccagctccggcaggtggaaggcgtccagggccgcgcgggtttgctgggcggcggactggaactcccggttgcccgccttcagttcctccaggcacttgagatgggccgagagcttgtcggcggccttcaccaaaaccagcacctccgggtcggattcctccagcagggtggcgaaggcggggcgcatctcctgggggagcatggccaccagccgctgggcggcgtcggcctccaccgccttgtaagcggtctggatggcgggattggcgtacttcacaggggtgggaaggtcccctgtgaaaatctccggcgcgtcgtggtagagggccacggcggccacccggcccgggtccaccgttcccccaaacttgtcccgccggatgaccgccagggcgtgggccagcacggccaccatgtgggagtgctcctggatattttcctgcatggtgttgcgcatcaggccccagcggacaatatagcgcatgcgggcgatgtaggcgaaaaaaggatgggacatggcaaactcccctggaaacaaattgaccgacctgcggatttgtgttaagatcgatcatgagtgttctattataccaggtttttttccaaaagaaaagcatttttcccacacaggaggttccccatgcgcgttgccatccacaccctggggtgcaaagtgaatcagtacgagagccaggccatggaggagctcctccgggccaggggacacagcctggtgccctttgaggcccaggccgatgtctatctcatcaacagctgcaccgtgacggccaccagcgataagaaatcccggcaggcggtccggcaggcccggaagcgggcgcccggggcgctggtggcgctctgcggctgctatccccaggtctccccggaggctgcccggcagctggaggcagacctcatcggcggcagcggagaccggcggggatttttggacctgctggagcagctggcacgcacccgggagaaggcggtggccctggatgatcccttccgccgccgggtctttgaggccctccccgccggggggctggaggggcggacccgggccatgctcaaggtggaggacggctgcaccaacttctgcgcctactgcatcatcccctatgcccggggggcggtgcgctccctgccggtggagcaggcggcggcccaggcccgggacctggccgaagcgggctaccgggagctggtgctcacggggattgagctgtccgcctatggccgggacctgccggaacggcccggcctggccgcgctcattgctcaggtttgccgggcggtgcccgggatgcgggtgcggctggggtccctggagcccaggacggtgaccgaggacttctgtgcccagctggccggtctgcccaacctatgtccccactttcacctgtccctgcagagcggctgcgacgccaccctggcccgcatgaagcggcggtacaccaccgagcgctacctggagtcggtggggctgctgcgccggcattttgaccggcccgccctcaccacggacctgattgtgggctttccgggggagacggagggggagtttgcccagacgctgtcctttctccagacctgcgcctttgcccagatgcacattttcccctactcccgccggcagggcaccccggccgccgggatgcccgggcagattcccaacggggaaaaggcccgccgggcccatcagggggcggaactggcccgggccatggagaaaagctggctgagcagctggatgggacagcgggtcgctgtcctgtttgaagaggaaaaggacgggttctggcggggctataccccccaatacatagaagttcgggggaagggggagaacctgcacaaccgggtttgccccgtcacccttaccgctgtgggggagggcgtggccttcggcgttgtcacagaggaggaagcaccatgagcaaagcagaccaaatcttcctggccaactgccaggagattttgtcccggggcacctgggacacccatctgccggtccgcccccggtgggaggacggcacccccgcccatacggtcaaatgtttcggcctggtcaaccgctatgatctgcgggaggaatttcccatccagaccatccggcggatgtacctgaaaagcgcggtggaggagctgctgtggatctggcagaagaagtccaacaacgtccgggctctgtccacaggcatctgggatgcctgggcggatgaaaccgggtccatcggcaaggcctacggctatcagatgggggtgaagcaccgctacccggagggagagatggaccaggtggaccgggtgctgtatgacctgaagcataacccctcctcccggcgcattctcaccaacctgtacaaccaccatgatttgagtgagatggccctgtatccctgcgcctactccatgacctttaacgtcacaggaaacaccctcaacgccattctccaccagcggtcccaggacatgctcaccgccaacggctggaatgtgatgcagtatgctgtgctggttcacatgctggcccaggtgtccgggctggaggcgggcgagctggtccacgtgatcgcggacgcccacatttacgaccgccatgtgcccctggtggaggagctcctgggccgcacgccttacccggcccccaggctgcggctggacccggcggtgacggacttttatgcctttacccccgacagcgtccagttggagaattaccggtatcatcccctgaaggaaaagattcccgtggccatttgaggaggtgcgcccatgaagctcattgttgcggtggatgcctgctgggccattggaaaagacggggatcaactgtgctatatccccccggatctcaagcggtttcagcggctgaccaccggccatccggtgctgctgggacgaaagaccctggccacctttcccgggggacgccccctgaaaaaccggcggaatctcatcctctccaccgaccccgcctttgccccggcgggcggggaggtctttgctaccttgaaggccgccctggccgccgcgccggcggatacctttgtcattggcggggcctccgtataccggcaggccctggcctactgtgacacagcctatgtgacccagattcacagggccttcccggcggcggactgctattttcccaacctggcggcggaccccgcctgggaggctgtggagacggaggggccttaccggtatgaggacctggcctatacctatgtgacgtatcgaagacggtaacgccagatattttctggaaacgaagaaaaacggtcaagaagagaagaactcttcttgaccgttttttggcaggagaggagaacccatccagcataggctatccctgctgtaccgctgctttggcctggccctgccgcagcatgatccagaggatgcccataccggtcccgccggttacagtggaaaaggccaaggtgggtccggtgccggcggcatccaagagaaagccgcccagaaaactgctcagaacgatgcccagggtattggccatggtaaaataggtttgtccttggacccggtctgcgggcgctgtcatgtcgttgacccagtagacggaggccacagcgtacagggcatatcctgtggtctcaaagatctgaatgccatagaggaagaatacactgggggccagccaggtgagcagggcgtggaggaaaaaggaaagaccggccagacggacccagcgccagctggcagcccggcggagcaggagggagaagagcaccatggcggggatgtccataaggccctggagggtgagaagggttcccatttccccgctgccgccgcccagatattggacaatttgatagggaaaactcatgagaatattgtggctggtgtagagaagaaccaccccggccagtagggggaggaaccgggggtagcgccgccaaaaggactggggagacgatggcggggacgctgggggtggggccgcctgcttggctggggtaccgggccggaaggaaagggcggccgccagcagcaggagggtcgccccgcccagcagcacagggatacactttggaccaaaagcggcggctgcgctgccgcagagggtggaggccagcgcgtaggaccctgcccccacaccccgggcaaggccgaagttcagcggcataccctggttgacacagtccatccccagggcatagagcagggaggtcaggagctgaagcaggagcaacagggagagaaagagtcccccttggacggcctgtccaggaagcaggagcagaccgccggtgcacagcagcatggccaggatcagcagggcggcgaactgccccagggagagaacctttaggtggtccgccctggcccccacaaagggttgcagcagggcggtcaaaaggccggacaagccaagcagcaggccgatctgggtgttggagaatccttggtccagcagatatacgctggaaaaggaaagcaaaatgcagtaagccatccagtagcagccctgtatccaggcgtagtgggatgtgagaaagcgaggtttcatgggggcctcctttccaaaggggaaagatcaccccccgctgtttctgcgcagcggggggagagaaaaaagggagagaagtcacagagggatcaggcgttgcggcggcggaagctcggggctttcttcttgggttcggcggaagattccggcccggtcaggcggccgatgagcgcggcggccaggaaagcaaccaaggtgggcgggaggatggggagaaagatctgggcgggggtgccggagaggttggaaagcatcaggtaaaagatgaggcccacacagaagacatcgacgattcccagcaggatggcaaagaactttttcatgatgatcgctcctttttaaactttatttcacgaggagggctgtcaaaccgttctctcttgatctgtctgtatcataccgggaaaattgcttgatttcaatgactaaacccagtgaaaattccaacatagattaggtagtccttctgaaaaatgagtggacagcatacgaaagataagaagaaattatgaaaaataagtaggaatcatatggaagactctggcgggaatgcggaaggatgcggcttttggaaagagaaaagaacataaaaatcccggcgaagaggagcggggaggggcgcggcataaagtgcttgattttagctgggggagacgatagaatgaaaaggaatcggtgccttggatgtctgctctggaggaaatccccatggagaaaaacgactttctgctgtacaatgagatcatctatcatatccatacctgccaggatatggatgacctgaaacgctctattctggcccaggtgaagctgatgatcccttatacctatgccagcctgattgtggtggagattgaccccgagacccgggagatccgccacagcgatcccttctgcctgccggacagcttcaccgccctggaggaggcctggatcgaccgggatcaccaggacgagagcttttgggtcagccacgcccccgagtccatcgtggtccgcagcagtgacctgaccggggaggcccggctggagagccccatttttcaggagctctatcagcagtataacatttacgacaccatgagcatgaatctggcctacgatcaccaggtgatggccctgcttaccctgtaccggacccgggcggatggggtgtttaccgaccaggaggccttttatctccgggcactggcaggacatgtcaactatgcctattacaccatggcccagcgggaggccagcaagccccccaagacccggaccatggaggagctggtccaagactacgaactgacccgccgggagacggagattctgggcctggtcttccaggacctcaacaacgaagagattctggaccggctccatatctcccggcacaccctgctcaagcacttgcaaaacctgtaccgcaagtgcggggtttcctcccgctgggacctgctgaagctgcggccctaaaaggggaacgacgatgcacaaggagagatctgcccatggaaaccaatgactttctgctgtacaatgaggtgctctaccggctccacgcctgccggaccatggaggagctgaagccgacgctgctgggacagttgaagctgatgatcccctacacctatgccagctttctctccattcaggtggacccggagacccaggagcttgtccaccgggaccctttttgtcagccccggcagtttgaggcggcagagcgggcctggctggggcagattgaccaatcgtacagcatctggctcagccatgcgccagagtccatggtggtgcgggacagcgaaatcctgtcgggagacaaccggttttccgcccccagctaccggaaaatctatctggattatcacatctacgactgcatgcagatgaacatcacttacgcgggccaggccatgggccgcctggccttttaccgtacccaggcggacggcctgttcaccgaccgggaggcctttctcctgcgtaccctgtccaaccacattgatctggcctgctatcactgtacccaacgccaggcccaggcggcacagccggcccggaccctggaggaactgacccaggtctatgggctgacccgtcgggagacggagatcctggggctggtgtttcaggaccggaacaatgaggagattttagagcagcttcatatctccaaaaacaccctgctgaaacatctgcagaacctgtaccgcaaatgcggggtctcctcccgctgggacctgctgaagctgcgataacggacaaaaagaaggtcgtttccctcttcgaggaaacgacctctttttttcaaaatttttgtaacgtttgttctcttccggcgttattggagagaaaggagggggagttgtgtggacttcgaggggatttatcagtcctactgcaaggacgtgtttcggtatctgcggagcctgtcggccggggaggacctggccgaggagatcacccaggagacctttgctaaggccctcaaggccattgaccggttccaaggggacaaggacatccgcgcctggctgtttaccattgccaaacacacgtactatacccactgcaagcgggagaagcggaccacgggggaggaatttcccccgtccatccccggaccggagaaacctctggtggagcagatcatcgaccgggagcgggcctttcaggtccaccggtttctgcacgggatgcgggagccgtacaaggaggtgtttaccctgcgggtgtttggggagcttccctttgaaaaaatcggcctgctgttcgggaaaacgcccagctgggcccgggtgaccttttaccgggcgaagaaacaaatcatcgaatatatggaggggattgagaatgaacaccatccgttgtagcattgtggaggacctgctgcccctgtacatcgacggggcgctgcgggaggagactgcccaggcggtgcgggaacacctcagcgcctgccccgcctgccggaacgagtatgagaagctggcccagaccctgacgctgccctccgcccccgacctgcaggaggaggaccggcgggcgttccaggcctttcgccggcactggaagcggaagaagcttcaggtggcgctgctctgcgttgttttgaccgcggcggtggtgatcgccggctgtgtggtctatcaggaggtggaggtagtgcacgatttattttcccccaccaccacggtggtcctgcgggaggctcagacccacggtacatgggcacctgtcccgtgggaggagggagaccggctgcggtttgagggcctatttgcagagagagcggtcaccctggatgccaacagcgacagcgcggtcacactccgggtgtgggatgaccagcacaaccttgtggtggacgagctgaccgtggcgccgggggaagaggtctccctgaaaacgctggagcgaaacaccgactatcaggtggagatgcagacagaggcggagtttgcctgccttcgctttcactgacaggggcggtcagggccgggcggcgcggagcgccctgccgtagttccggccaaagaggaggccggccagcagcagggcggcccccagaccagagtaaaacacggccaggaaggggtccggcgccagaccggagacacggagaaacatgcccaggctcatcatcccggccatgaggagaaaggacttcttgtcaaaaaagcggaggaagaactgtctgtcctcccaatatcccaggatccgtctggtgtgttttcccaccaggcggccgaagacaaagacctgaaagagaaaaaagaccaaaagggagagcaagatgtgggggagagagacttgggtggcataggccagcaggccgatgcggaggatgttgacccccgccgcggtccagaccaggcaggccaggagcagcagggtgttctttttcacttgcatctgaaaaactcctttctgaacaatgttcaagttggcgtttgaaaaattcccacgattttgtgggaatttttcaataaatggttctgcggatcagggcaaggatgggggcgcagggcgcgtctttccgcagcagggcggccaacagcagggagaacagcaggtcgacaaagtcctcggcggaaaacccctcgtgaaatgtcccggggcgcacctgggggtcctgggccagcacagcgaggaggaactgcttgatgtgcgcccaggaccgctccattctacgctggccggcgtccagttcctcctgggaaaagcagagagcgtggacggagagaaagcccgggtaggtttggcggctctcctccagccgctgaaacagccatgccacgcaggagagcaggtccgcaaaggccccggggtcctggggaaggcagaagatctcctgccaaatgctctccaccgtggcggccaccagctgggacttggagccgaaacggttatagatcgaccccaccgagaccccgcaggccgcggcgaccgagcggatgttgagagcggtccagccctgctcctggaggagggttctgctggcctgcaggatggccttgtcagaggtgacggagggatacatggaaggactcctttcaagttgaacaatgttcagcatacagaaaaacccgccccctgtcaaggcatgcccggagaaagccgcgcgccgggacagggggcgggggatcagaaagcgccggccagctgtttccagaaggccgcgccttttgctaaaatggactcgtcaaaggcaaagttgtccgcgtgaagggccggggaggggccgcagcccaaaaagaaaaagagggcgggcagatggcgctggtaccaggagaagtcctctgagatcatgacaggcttctccagctccaggaagggaaggcccaggtttttgacccggtcgtacagggcgtcggggttccatacggcgggatacccgtcgttggtgtggaccgccacctgacagccggtgtccgcctggacctgctggccaatctcccgcagcccctgctggaggtccagaaagacctcgtcctgaaacgcccggagactgcccagcagaaccgttttgccgctgaccgcgttgcggacggtgccgctctccatccggccgaatttcagcaggcggaagaggtgggggggcagggcggcctccagggccgcagcccggcggtagaattccaccccggcggccagggcgtccaggccctcctcggccttggcgatgtggctggagcggccggtgatggtgacggaaacctcacaggaccggctcatcatctcccgctttcgggaggcgatgacaccggcggggagctccggccacaggtgcatgccaaagacgcactggaccttatgggcctccagcacgccgctctggcacaggtccttggcgccgccggtggtctcctccgccggctgaaacaggagcaggacgttgtggggcagggcggtctgctggtccagccataccgccaggtccaggaccatggccatgtggccgtcgtggccgcaggcgtgcatgcgccctggatggacagaggcaaagggcagcccggtccgctcggtgatgggcagggcgtcggcgtcgctgcggaaggcgatggcgtcgggccggccaaagtcgaaaaaggcgcacagagcgccggggatgggagaggagagggtgcaggagaggggggagagaatcccccgaaggtaggacagggtctccggcaggtcccggtccagctctggaatccggtgcagggcccggcggtattggatgacttgcataaaaaacctcctgcgccgggaaagggcgcgtcaaagtgtggggcggggcggtggtccgggggcgcctgggaaaggtgcttgcacagcgggggaaaagatggtatactgcccccatcttactgtcccaaaggaggcgctcagatgaacgcacaggaaatcattgaacgaatccgcaccgcggagaaaaaaaccccggtccgggtgttcctgaaggcccgggagccggtggaatttccccatgccaccgtgtttccctgcggggagaccaccctggtctttggggactggaaggacatcggcccggtgctggaggagcacaagggggacatccaggaactggtggtggagaacgacagccggaactcggccatcccgctgctggacaagcggacggtcaacgcccggattgagcccggcgccattctccgggagcaggtggagatcggggacaacgcggtgattatgatgggcgccattttgaacattggcgctgtggtgggcgcgggtaccatgattgatatgggcgcggttctggggggccgggccacggtgggcaagaactgccacatcggggccgggacggttctggccggggtcattgagccggccagcgcggtgccggtggtgattgaggacgatgtggtcatcggcgccaacgcggtggtgctggagggctgccgggtgggcaagggcgccgtggtggccgccggtgccgtggtggtcagcgacgtggcccccaacaccgtggtggccggcgtccccgcccgggtgctgaaggacaaggacggaaaaactgcggagaaaaccgccctgattgacgccctgcgggcgttgtaatagtcggcgcggaagcaaagaaaatgggccgttcggggatgacccgaagggccttttttctgatgttttccacagcccggcccagatttgaccccggttcatccccggtcacaccggggccaaatccgggcgggggtggggtcggatttgggccacaagtaaaataaatagtcaaacaaagagtcaatcaaatcctattatgagaagcggggaaacacgaccaccggggccagttatccacagggggaaaaagatgggggcagttcctcgtcaaagacctctcccttggccacaaggttggtggggccggtgagccagaggccggtgatccggtcccctgtccgggccacgtcaatggtgagcacgccgcccgccatggagacctgcaccccctggccgctgacctgtcccaacagggtgaggaccgccaccacgctgccggttcccgtgccgcaggccagggtgaaatcttccaccccccgctcaaaggtcttctccaggacctggtccggcccggtgggttcatagaagtttacgttggcccccttggggaaggcggggtgcgaccgcatggccttgcccagctggaagagggcctggggatcggcgtcggccagaccggggtaggggaccaccgcgtggggcaggccggggctgcccagctccacataggcgcagggccaagctttgccctccaccaccggggcctcgtggaggcggattacggtgggggaattcagctggacccgatactgccgccggtcgatccgggttccggtgaccagaccggcggtggtctccaccgtctgggtcgggccggacagccctgtctcgtagccgtagcggcagatacagcgggcgccgttgccgcacatctctcccagggaaccgtcgctgttgaaaaagagcatcttgaagtccgctccttcctgggcctgctccaccaccatcaggccgtcggcgcccagggagcggtggggggtacagagggtacgggccagcagaggaaaggcggagggggggagcctctcttccaggttgttcaggatgataaaatcattgcccgcgccgttcattttccaaaattgcatggggggtctcctttcccggaattgctgtgttctatttcaacataaacccgtggaaaaatcaaggccggaaaagacatggttcgctcttgacaaaaatttcttccagtgttactatatttttgtacaaactgtttcgctgttttgaatggaggagggcggtttcccccgctctcacaatctatttgaaagccggcaaatggcgtgcgctgacgctcccattgccggtttttttgcgtctttggggaagagagaaggagagattgtcatgcacttaggtccgctgcacgtggtgggaatgcttgccaccattgggcttatcgttggaattggcgtatattccggccggaaggtggcctccgctgcggatttttccagcggcggcgggaaggccggggcctggattgtctgcggggccattatgggtaccttggtcagcggccaggccaccatcggcacggcacagctggcgttttcctttggaatgtccgcctggtggtttactctgggctcggggattggctgtctgattctggccattggctacgccgcgcccttccggcgcagcggctgcaccaccctgcttcaagtggtttcccaggagtacggtccccgggcggagacggcgggaagcatcttctgctccgtgggcattttcatcagcgtggtggcccaggtgctgtcggccacggcgctgctgaccaccatttttcccctcagccacttggccgcggcccttatctccatcctactgatggggttttacgtgatcttcgggggaatgtggggggccggcatgggcggggtcgccaagctgatcctcctctacgcctctgccattgtggggggaattctggtttacggcctggccaatggattcggcggactgctggagaccctggagcagctgctgacctcctcccccctgggggcggtcagcggcctggccacggaggaggcggtccaccagcggtttacctccctggtggcccggggcgcctccaaggacattggatcggcgctgtccctggtgctgggagtgctgtccacccagacctatgcccaggccatctggtcaggcaagagcgacagcgcggcccggaagggggccctgctcagcgccctgctgatcccgcccatcggcgttgcctgcattctcatcggcctgtacatgcggggccactgcatcaccgccgaggaggtggcggcgctccaggccctgggccaaaccgtgcctggggatctcatccccctggattccacctcccaggtgttcccggtgtttgtggcccggtttatgccccaactcctgggcggggtggtgctgggcaccctgtttatcacggtggtgggcgggggctccgggctggccttggggatggcctccattctggtcaccgacctgtttgcccggaagagtagccggatgaagcagtcccgcaccaatcttctggtcacccggggtaccatcctggtgattctgatggcggcggctgtggtggccattttggtgcccggcgccatgatcaacgactttggttttctgtccatggggctccggggcgctgtggttttcctgcccatgtgcggggggctgtggctcaaggggaagattccccgggggtttgccctggcctccattttcgccggccccatcgcggtgctggcggggaactttatggacctgccttttgatccgcttttcctggggatggcggtctgcctgagcattctggcggtagggctggccgtgaggacccatcgaaacgcttctttgtccatacactgacttgcaatagacgccgcctccggccgggaacagcagcccgccggaggcggcgccgcgcggagaaaagaccgctggttgggacggacgccggcaaaattacctggggagccgatgacaggagggaagccgtgtgctataataaaaacagagacatgaagtgcggagagaatggagaggggtgcgttttggatgctgggtgcgttgattggggatattgtgggctcggtctatgagtggcggaatcgaaaggacaaggggtttcccctctttcagccggactgccggatgacggatgacagcgtgatgaccgcagcggtggcgtcggcggtgctgatggggggcttggaggagctggagctctttcaggcccacgtgattacggagatgcgccggctggggcggaaatatccggccctggggtacggcccccggtttgaggcctggattctgtcccaggagcccaagccctaccgcagtctgggcaacggcagcgccatgcgggtttccccggtggcctgggcggcggagagcctatcccagtgcctggcgctggccaaggcctcggcggaggtgacccatgaccatcccgacggcattgccggggcctgcgcggtggccggggcggtctacctggcccggatgggggagagcaaggaggccattgtggaccacgtgacccggtattaccccctggactttaccctggacgagattcgagagggctacgcctttgacgtctcctgcgccggcagcgtcccccaggccatggaggcctttttggaggcggaggattttgaggacgcgctgcgcaacgccgtctccatcggcggcgacagcgacaccatcgcctccatggccggggcggtggccgccgccttttacggcattccccggtccatccgggatcaggccctccccttcatcgacggggaggtacggaacatctatgaccggtttattcggcgatattgaggaggcgtggctatgtggaacaccaccttgtgttacatcgagcgggaagggcagtatctgatgctccaccgggtgaagaaagaaaacgatgtcaaccaggacaaatgggtgggcatcggaggaaaatttgaggacaaggagagccccgaggagtgcctggttcgggaggtccgggaggagaccggcctgaccctcaccgactatgcctatcgggggctggtgacctttgtctcggaccggtgggagaccgaatacatgcacctgttcaccgggcacacccagcaggacccctgtgtggtctgtgatgagggggacctggagtgggtggatcaggacaaggtgaaggacctgcccatctggacaggagacaaaatctttctggacttgctggcccgggaggttcccttcttctacctcaaactctcctatgagggggatactctggtccaggcggtgctgaacggcaaggagctttccactgaaatctaaaaccaacggcctgccgcatgtgttgcggcaggccgttggtcaaatgctgaagaaaaagggacgggacccaatgagttcctcaatttgggactctccatagaccgtgatgccgtgttttttcagcatctgggcggtcagaccatcccctagggtcagggttttggtgaaggtaccgtcgtagatctgcccgctgccgcaggaggggctgcgctccttgagcagggcggccctgcagtggtagaggtctgccaggcggaggacttcggcggttccccggacgaaggcctcggtgacatcgtcaccgtcccgggtgactacccggttcccctggcgctccgccgggacccggggggtggggaggccgccaaagagctcggcgcagacggggatgcaggtgtgctgcttcagcagctgctccagctgcggaagctggttgctctgcccgtcgtaccggcagcccacccccaaaaggcaggcgctgaccagaagtctcataggaccggccctcagcccagggcttcggcccactggtcctgctgaaagcccaccaggacccggccatcgtccagcaccagaatggggcgcttgaccagcatgccatcggaggccagcagggcgtactgctccgcctgggtcatgtccggcagctttttcgacagggacagggcgcggtagagctggccgctggtgttgaagaattttttcaggggcagggcgctggcctggtgccaggtttccagctcctgcagggtggggttgtcctccttgatgtcccgctgggtgtaggcgatgccctgttcatccagccatttctgggcctttttgcaggtggaacaccgggaataacagagaaacagcatggttttatcctcctatgaacgtgaatggtctcttctgagattcttgagattctatcatatcgaagtgcggccggaattgcaagaccgggcggacgggaaggggccgccccataggaggtcgtcacagagcaaacgaaaggagagcgcgtgcaatgcaggtagaacagtatgtcatggcctatgaggtggaacaggaccggctccgtgccctgctgccggcgggatttgtctccctgcggcctgtgctgcggatcaacggtgaaatccggcggggaccggaagagacagcctatctggagctgaatacccctgtggaggggcatgggaaacggggctggctgaatgtggggcactgggacagccggacggcggagctgtcctatgcccgagagggaaaaaccgtcaccttcgccgccccctttctcactatctcctttgcggcggttggggtggagggcgggtgccctgcggaacgggacaacgaggggtgcttctttctgggggagaccctgtcttttcggcccagccagcctggaaacagccacaaggaattttgtgactgtgtctttgcttggcagttttctccgggggacgcccagggcgccagccaggggaaaaccctacccgcctttgcaacagctccccggaagacgtatgaaaagcgcgccctctccccggaaaacgcggcggccattccctgccggcaggtgctggggtcctatgtggttcggtgggagcggggggaggacccgtcggagcaggggtcctgaacggggatctcgatttgggtgatatagtcctcgtcctgctggatcaccagctcattgacgcccttttcataggcgaaaccggtcagggtcagctcgtggtcccgggcataggccagaatggcctcgtacttggcgggaagtccctgccagggtccctggtaataggccagaagataccgccctttgggacgccggtgcagccccgtccggcgggtgggggcggggacctccaggaagaggtgggtgtagtcggtgaaccgcccctgccgcaggtgctccacggggagcatggcgccataaaccccttcgtgaaggtggcccagctgatgggccttggcctggtcgatgaccgcggcaatctcccggtccgtgggggtgtccccgggcaggggcactgtggccaggtagcaggtctcccggcggaccagggagatttgtgtcaggggcagggtttccagccgggccagggaggcctgctgccggaccagggcgtggcggatttcctccaggcggcggatctgcccctccactccggcaattttttccgtgagcaggcgccgcagctccccggcggaacggtgggacagaaaggttttgatctccgggatggagacctccagagcccgcagcatcaggatggtttccagccgggcgctctggcggtagctgtaatatcggtagccgttctcccccacaaaggcgggggagagcagtcccacctggtcgtaccacatcagtgtttttttgtggatgccgtggatggcggcaaactgtccgatggtgaatgttgtctcttgtggtatcaatgtaaaaactcctcttgactgtccagttacagtacggtttattgtactggatacagcggggaaaggcaaggggaaccgtcgcctccccggctgaattgcacaacaaggagaggcaagaagcaatggagtaccaaatagacatccgcccgttccagccggaggaccaggaggccttggccggggtgatccgccggacctggcagtatgatcgtttctgtgggccgaagacggcccagcggctgggacgggtctacctgcgccagtgcctaacgcaacagaccttcacccgggtggcggtggtggacggtgtgcctgtggggatcatcatggggaagaacgagaggacccaccgctgcccctggtccctgcgctggcgggcggcccgggcagtcctggcgctgctggcgacccgggaggggcggaaggtggcccggctcttttccggggtggaaaggatcaaccaggcgctgctgtcccggtgcccccaatcctaccccggccaggtggcgtttttcgccgtggaccagccccgccggggcatgggactgggcaaacgtctgtttcaggcggtgatggacaacatgcggcaggagggcatcgggaccgttttcctgttcacagataccagctgcaactatggcttttatgaacaccaggggatggtccgccgggccgagcagacccagcgtatctggctgggacaggaatctggagagatgacctttttcgtctatgactacaccctggccggctgagaccgggggttgcggcggggccgggactgtggtatgataaaaaagccgggagaaccggcgtgagaacagaagaaaggacgatgttttttgagaaactggtgtgattcggtgcttgtggcctgaccgggaggttggtgccagaccatcatcgccaagcctccccagataaagaaagtatggaggaggaccttcccaatgaatcgggaaaacaaacgaaaaacctttgaaaagggttactataaaacccatcgctgcaacgataccttttcctgccgggtctgcgaccggctggtctttcccacccccacggggggcgaccaccgcaaccactgccccaactgcctgagcagcctccacgtggaccaggagccgggagaccgcgccgcggattgcggcggcatcatggaccccatcggggtgtgggtgcggaaaaaagaggagtgggcggtgattcaccggtgccgccggtgcggcaagctcagctccaaccgggtggcgggggatgacaaccccatgaagctgatgtccattgccctcaaacccctctctctgcctccctttcccctggagcggatcgagcagctcacagacgccatgggcggcagcggcagcctggggataggcggcaggaccccttaaagcgtgatacagaggacgttcccccgggagcgtcctctgtttttctggaagaaggagggttgaccgttgaaaaatgacgcggtccatggtacaataaactcctaccaagcaagacagaacccagattccgtcctgaaaggagggagcgtatgaaacgaatcaagaccattgtgtcctttctctgcgccgcggcgctggcactgaccctgctggtgatgccctcttcggcctctggaggactgtttttcctgtccctcaacgacacgctgcccgcccagtctgtgcagatgaccccggtccagtacagcggctgggtgtacgtgccggtgaatgtcttcaacagccagagcaccggggtcaatttcggtctatactatgggctgacggagaacaacaccaagctcgttctctataacctctccgggaagaccatgacctttgatcttcagaatgggaccgccacggcggtggggggagaggcccctgtcccagggaaggttctgcggcagaacggggtgtactacgtccccgcctatgcggtctgccggtattttggcctgagttattccttttacagcaccgactacggtccgctgctgcggctgaaggacggaaacgccatgctcagcgattccctgttcctcagttccgcggcctcgattatgcgaagccggatcaacagctattaccagagccaaagccccaatggcggcggggacgggggcggcaacagcaccattgttatccccaatgatcccgattccggcacccccagccagcccaatcagccggggaacccggatactccggtggccccggacattccggcggatgcggagccggcccccacattctccctgtatgtaggggtccaggcctcggcggaccgggagattaccgcgaccctgaatgccatgagcacggtgggagtccgcggcgtggtgttcttcccggcggaagaggtgaaccagtgtgccgaccagattcggcaggcagccggacgggggcataaggtgggcctgattcccacggggaacaccccggcgcagcgcctggagagcgtggaggccggcagccggcagctggcgggcatcctgcgccaggagacatggtttgttctgagcaaggaatccaccctggcggaggcaggctatctctgctggacccccagcctgaccttctcctccgtcaccgacccgacccggacctatgagaccctggtgcgggcgggagaacagcaggggtcggccctccgggtcttggtccacagccagtccgcaggcggggccctggccggcgtgctgggccagctggcccaggatggagacaccttcctaccggcccgggaaaccagctattgaaaaaggaactgccagaatccctgatcccccggcatttgccgggggatttttcatggaaaacaggggagaaatccccccaggcccccaggctgattttggtgaaaacgacaaaaatgcaccgcagagcaaaaaaaacgcagcaagggcttgcaatctgtctctggtgtggtattatgttaatactttatcacgatagagtgctaaaaaatcgtgagaaaagaaggaagaagtttgattgagaatggagcgttagaacatgaaaaaagcacttgcagtcttgctggcagccgtgatgtgctgcaccctcctgtccgcctgcgggcagcccgaaaccacggaccccaccgagggaaccgaaggtacccaaacagagaccaatgccgccgacctggtttacgcggtggaggccggcagcgccggtgaagccattgccaaggagaagggctggcagaccaacccggtgaccgcccaggcggacaccctgatggaggtctccgccggcacctccgacgcggccatcatcgacctgctcatggcggcggctatgaccggggaaggcaccagctatcccgatctcacctatgacagccagggtctgaccaccgaggagtacggcatcggctgccgcaagggctctgacctggcccagtacatcaacaatgtcctggctgaggcctatgccgacggcaccatgaaggagatcgctaccacttataagctccaggacgccctggtggagcagcccgccgcagaggagttcacccctgccgcagacggggatgtggcctatatccaggacaagggtaccctgattgtgggcatcaccgagtttgagcccatggactacaaggatgaaaacggccagtggatcggctttgacgcagacatggccaaggtcgtggcggaaaagctgggcgtggaggtccagtttgtggtgatcgactgggacaacaagatcatggagctggactccaagaatgtggatgtgctgtggaacggcatgaccctcaccgatgaggtgaaaaactccatggagtgcaccaacccctatttcaacaacgcccaggtggtggtcaccgccgggaagtgacgggggctatcccagagaaagcaatcaaccgcaaaggcagagagcggccgctctctgcctttgcctggcctattgaacatcagacgaggagttcaccatgttttggaacgtaaccttaaccctgctgagcggcttggggaccacaatacaaatctttttcttgacgctgctgtttgccctgcccttggggctggtgattgccttcggctccatgagccggctgacccccctgcgctggctgtgcaacaccttggtctggattgtccggggaacccccctgatgctccagctcatcggtttcatgtacatccctgggattttgggcaacaacatttgggacggagaggccggccggatgacagccacagtggtggccttttccatcaactacgcctgctacttctctgtcatttaccggggcggaatccagggggtcccggcgggccagcgggaggccgcggaggtcctgggactgaccaagcagcagatcttctttaaggtcaccctgctccagatgattaagcgcattgtgccccccatgtccaacgagatcatcaccctggtcaaggatacctccctggcccggatcatctccgtgtatgagctgaccttcaccggttactccttcatgaaaagcagcggcctggtgtggccattcttctataccggcgtgttttacctcctttttgtgggcatcctcaccatccttttcaatctcatcgagcggaagctcagctacttccggtaaggaggcactctatggcgattttagacgtacaacatattgagaagagttttggcgccaccaaggtgctcaaggacatcaatttctccctgccggagggacaggttttggccatcatcggctcctctggcagcggcaagaccaccttgctgcgctgcctgaactttttggagaccccggacaaggggagcatttccgtgcggggcgagaccctgttcgacgcaggggaccccgccacccagcgggagagtgagattcgccgaaagcggctccattttggcctggtgttccagaatttcaacctttttccccagtatacggccctggaaaatgtcaccctggcccgggaactgatggcaaagggagagaaaaccggagaatccctggaggatatccgggcggaggggagagacctgctgacccagatgggactccaggaccggatggggaactatccccaccagctctccggtggccagcagcagcgggtggccattgcccgggccctggccatgaagccggacatcctctgctttgacgagcccacctccgccctggacccggagctcaccggtgaggtgctgaaggtcatccgaagcctggcggaccagcacaccacgatgattattgtcacccatgagatgagctttgcccgggatgtggccgatcacgttctgttcatggacggcggcgtggtggtggaggaagggacgccggaagaggttttcggccatccccagcaggcgcgtacccggcagtttttggagaaatacaagggggactgatccccggcatagagaaagagcggccgtatcggccgctctttttttcctgtaaagatgcggaagggggattaaaaggcgatttcatacgctgggcccagggtcacgggcccgccgacggacagacgacggagactgccgccttgaatggccacggtggtttgaagggtgccccccggctgccggatggttcgcttatgcagtccctcctgccggcgtgcgtgccaggcggccatagcggccgcagcagtggagcagcacgggggctggagaagggtgtcggtttttggcaggtaaaccgcagaacgcatgaagtcctcctgggggttccaaaacagaacgcctgcgccgggaatctcccattcccgggccagctgggagaggagagtccgcagttccgggtcaggggggagggcgcttccctggcagatgacataggagaggcccgggaagtggagtacggaggcctgctggccgaacagggaacgagtgccttgggcctggggtgggggcaggtccacggtcacctggccggtgagggggttggcgtggaccagaagaggggcggggacactctgggcctccaccgggaattttttctcccgccggatgccccggctcacggcgaaggccaggccggcttggcggagtaggtccccgctcaacgcgcctgccgcggtctccagccgaaccacaccgtccccttgagggggggtaagaaaggccacctgttgagcttggagttcttggacagacagcaggcgctgggtcaggtcctggtaggcatctggagagactgaagttttgaccaatagggtccgcgcgccatccgggccggcggtttgaaaggatagcttcatggagcacgctcttttccttgtgaagtgggagcggcgctccaggcaggagggccgccggaaaaacatggtatttgtgattattgtagcataatgcccccctttcgtaaaggggaagctgggattccgcccaaaatgaatgacaatattttgcggaatctttacaaattgggtgttttcagggcgaaagagatatgatataatatcctgaactatgtagaattaaaatgaacccgatgacttttctgtttcagaacaatcgtcaggaggatgatagcatgcgttacgatgattatgacgattacagcagccggtcctctcgagggagctcccgccggggctcctcctcttattccagtggacgggactatgaccgggactattatcgcgaccgggattaccgcagtgactttgggcgggactatgaccgtggatactatgaccgggaccgctattcggaccgatacagcacccggagcagccgggattggtatgatgactttgaccgctcggactgggagcgcacagcccccaactgggaggaccatggcgccgcccggaagaaacggcccgccggcggcagcacccgaagcagccggcccgcccccagcggacggagtggttcccgcagcggttcctcttccagccggaacacctcccgctctgggcagggcagccggaacggaaaccgccggcccccggaggaccccaggagaagaccgtccagccagagccagcgccggccccccgcgtcctccagccggagaagcgcggtgcagctggtgcccattatcctgggcctggtggtgattgtgctggcggcgctggtgatccgctccatgctgggcggcaagagcggctatgagctggaattctccacgaagaacattgtggtgggagagacggccaccgcgacccttaagggcgtggacagcaacgccgcagaaccagaggttctctggaccagcagtgagaacaacgtggtctccgtggagggcgaggggctggagtgtaccttgaccgccaagagcctgggcagcgccaccatcatcgccaccgtggagggggagaaggtggccagcgggacggtcaccgtggtggacaccgcccctggggttgtctccatccgggtgagccaggacgaggtgaccatttcctccggggagacctacaccatcaacgccactgtggagatggagaaggcggatatgacccctgccaccatcaagtggagcagcaacaacacctccgtggctgaggtggacagtgagggtgtcatcacagctcgggaagtgggcaacgcgattatcaagggcgtggcgggagagaaaaccgtggaaatcgccgtggaagtggtggagaaccccaattccaccccccatgactccacccaggatgcaggacgggagccggaagagggacaggacgccacaaataacaataacaacagcaataacaacagtaacagcaataacagcagcaacaaccagaacaacagcagcaacggtggcggtaccaccagcggcaacagcgggaccggcggcacgggggatggaaaccagaccaacggcggcacagggaataccaccaccggcgggacgggcggcacagccgatggcggcgccaccggcggccagggaaccggcggcacagacgccgggaccggacaataagccatgcagagcgcggacaggtccaaccggacctgtccgcgttttgtaaaggggcggacaaacaggagggaaccagatgaaaagcattggatggattggcgtgggcatcatgggaaaaccaatggtgcggaatttgcagaaggcggggtatacactccatatttatgcccggaaccgggagaaggtggcggacgtaatccaagagggggccatatttcacgacaccattggggactgtgcccagggacgggacgcggtgatcaccatggtgggctttcccaaggatgtggaagaggtctattttgccccgggaaatatcctggaccgggcagacccggggacctatctcatcgacatgaccaccaccagccctgccttggcccagcggattttccagcagggccggcagcggggcctgcgggttttggatgccccggtgaccggcggggacatcggggcccgggcgggcaccctctccattttggtgggcggggaggcggcggactaccaggcctgccggcccctgctggcggccatggggaccaacctcagccaccagggccccgcaggctgcggacagcatgccaaactggccaaccaaatcatgattgccgggaccttgtccggtctctgcgagggactgcgctatgcccaggccaaggggctggacggcagaaaactcctgggggcgctggccacgggggcggcggggagcaagcagatggacgctttggggggaaaaattctcgccggagaccatgccccggggtttttcctcaaacattttgtcaaggatatgaccctggccctgggggagtcccgggacagcggcctgtccctggaggtgctggggcaggtgctggaaaactgccgggatttggaggaacgggggctgggggacctgggaacccaggcccttatggttcattaccgtccggaggagtgaccggcctgcttcggcggagagaggacggagagaaaaggaggcgggccccatggcgcggcggcgggcgtttgatatgtgccaccccagtgtgaatttactgtatttcctgctggtgctggtctgctccgtgggctgcatgcaccctgcctgcctggggatttccctgggcggtgccctggcctgcgggcttctgttccgggggcggcgggccgtgggacggctgctgggcctgctggggccggtggccctgctggcggcggggggaaacctccttttggtccgccagggggagacggtgctggcccggctgcccggcgggcggccgctgacgctggaaagtaccctctatggcctggcggctgcctgcctgctgggggcggtggtgctctggtttgccagctggcaggcggtgctcacggcggataagatcacctatctctttggacggattgcccctgcgctggctctgctgctctccctgaccctctcctttgtgccccggctgcgccgccggctggaggagacggaccgggcccagcggggcctgctgggtcagccccggcggcgcttggacaaggtgggctggggcgcggccctgctctccagtctgctgggctggagcctggagaacgccatagagacagcggacaccatgagaagccgggggtacggcctgccgggccgcacctgcttctccatctaccggctggaccgccgggacaagggactgctggggtggctggccctcagcggcggttatgtggtggccggctgggcggcggggggcctgtcgtatacctattatccggcctgccaggccgctgggggcccagggagcctcagcctgctcaccgtgtatctggccctgtgcctgaccccgctggcactggaggcatgggaggagagacaatggaagagaacaaccaaaaacactggtcggtaagggagagcctgtccttccagcggcaggtttccgagaccatgcgcctgggcattctattggcattgtctggagggctgatggacgcttattcctatctctttcgaggggaggtctttgccaacgcccagacaggaaatatcctgctgtgcagcgtggccctgtcccagggggagtggggggtggcggtgcagtacgcctttcccgtgctggcctttggcctggggattttgatgacctttctgattcgccagcggttccgcaaccgcaccaaccggattcactggcggcagctgggggtgctggcggagattttgctgctgactttggtggcctttctgccgcagcaggccaatctgttggccaacagtctcatctccctggcctgcggctttcaggtggaggcgttccgaaaaattcacggcaacgccatcgccaccaccatgtgcatcggaaacctgcgggcggggattcatgccgcagcggaattcggcttttccaggaagcgggaggaccgcaaccgggccatcacctattttacggtgattctggcctttgccctgggggcggttttggggaacctggccattgcccagtgggggacctgggccattctgggcagcagcgcccttctgctggtttgctttggcctgatgtttttccagggaaaggaaggggaaggtcatggcacagcttgagctccacgacctgaccgtgttctaccccgggcaggagacccccgcgttgagaggggtgacagcttccctggaggcgggagagtttgtgaccttgtgcggccggtcgggcagcggaaagtctacccttctgcgctgctgcaagcctgccctggcgccccaggggacccggcggggggagattttctgggcggggaggcccctgtcggggctgtcggaccgagcccagagcgccagcatcggatatgtggggcagtctcccgagaaccagatggtcacggaccgggtttggcaggagctggcctttggcccggagaatctgggctgggacccggcggtgatccgccgccgggtggcggagatggcctctttctttggcatccagacctggtttcaccgggagatatccaccctctccgggggacagagacagctgctggccctggcggcggtgatggtgctggagccagccttgctgctgctggatgagcccaccagccagctggaccccattgccgccggggattttttggagatggtccagcggatcaaccgggaactggggaccacaattcttttggcggagcaccgcttggcagaggcggtcccccggtcggaccggctgctggtgctggagggcggccagctcctgtgccagggaaccccgcgggaggtgggggcgtggctgcgccggcagaaccaccctctggccgccgccctgcctgcccccatggagatttgggcccgggtctctcagtcagggccctgcccggtgacggtgggggagggacagatctggctggccgagtatgcccggtcacaccctctgggtgacctgcccccggtgtgtctcccgtccccgggagagacgctgctgcaggcggagagcctctggttccgctatgaccgaaacgggcctgatgtggtcaaggatttctccctgtcggtgggacggggggaattgctggcccttctgggagggaatggaacggggaaaaccacggtgctgcacttgctggccgggctccgggccccccagagggggaggctgcggaggcaggggcgggtggcgatgctgccccagaacctccagaccctcttttggaagaaaaccctccgggaggacctgctggaccagacagcgcggatggacctgccgccggcggagggggccgcggcggtggcggagatcgcggcactgtgcggcctggaggggctgctggaccgtcatccctacgatctgtctgggggagagcagcagcgggccgccctggcaaaggtcttgctgacccggccggaggtcctgctcctggacgagcccaccaaggggctggactggcggtggcaggaggaactggccgccctgctgcaaaggctcctctcccaaggggcggcggtgattctggtcagccatgatttggagttctgcgcccggcacgcccaccgctgtgccctgttttttgacggtgctgttgtggctcaggaccaaccccgggcctttttttccgggaaccggttctataccaccgccaccaaccggatggtccgggcatacctgccccaggggatcacgccggaggaggtcatctccgcctgcggcggggaacccagtggggagaggaaaccgctggcccgccctcctgagaaccaggcggcgccggaagaggcaggggaaccaagggagcctgccgccataccggccccgccccgggacagagcgccccggcgtaagctgacggtggtgggggtaccccttgttctgggcgctttgaccctgctggccggggagcttctgtttcaggggaagcagtatcattggatcagcctgctgcttctgatggagggcctgctgcccagctttttctggtttgagcagcggcggcccggggcccgggagctggtgctgctggcctgcctgtgcgggctgggggttgcggggcggggggccttcttttgggcgccccagtgtaagccagtgaccgcgttgaccattctcaccggcgtcagcctggggggacaggcggggtttttggtgggcgcggtgaccatgctggtctccaacctgttttttggacagggcccctggaccccctggcagatgtttgccatggggtgcattggcggcttggccggcagcctgttttcccggcgggggcgccgtcccaggaaggggatgctgtgcctgtttggctttttggcggctgtggtgctctatggggccgtgatgaacaccgcctccgtactgctctggtcccattccctccagtgggagctgatcgcggccgcctgcgcggcgggtctgcccatggatttgctccacggggggagcacagccctgctcctgtacctgctggcagacccggtgcaaggcaagctggaccggatgcgggagaagtatggatggggccgagggtgaacggggaatgggccatggaaacaaaaacagaccaccggccggacatgcggtcggtggtctgtttgtttggaaggggcgctatccccggaagaagcccacagaggggttcatcagatcgaagatcacaaggaaaatgagcaccagggtcagcacgcagcagcagacaaacagcctgtgcagccatttgtttttggactctatcatggcttcgtagagggataggatctcctggctggcccgggcctttttctctgcctggggaatctcttgctggatgcccaccagctcgtccagggagccgtccatggccatcaccatgtcgcagacagtctgaaagctggggttgtccgtctgcccggacagaatgcggttgatggtccccacggggaccccggagaggtcggagagctgctggttggtgagttttcgtttttctttcagaagctttaattgggtggaaagcatcattttatcacctatgataacggattttatcaaataagggtggagatttgaggggacatctatccctgccattgacgaattctgtcgaattggctaccatatagccagtttttgtcgaaccatagcgaaggaagcgggggagatgtccccaggaagggcccggcgagtcagggcaggcagtgcgctgcccccatgccgcggaacccgccttagtatatcattttgcttcccggcctgtaaagcacaattttcgagaaaggagcaggcggcatgacggaatacgtggaaaagcaggaggattggatggcccccaacggatgggggcagcggctttcggttcagggggtgcggtatcagacggtctgttcccggcggcaggatgccccggaggcctactgcacctatggcctggaatgtttgggagagtgcaggggaacctgggtccagatggatgtgattgaggatgtctctcccagccgggagaatgttctcttcctggccgagcggttcaataccttgggcctgtcccccctccattttcgggatgcggtgctggacagcctcaatggataacaggggaaacaggcagactacggcgtatgcctcagaaaggtctctcggggagaggcctttctttttttgccggaaaaggccggaacaaactggtccatcctctcccccttctgaccttttttgaggggggcgggccgtataatgggagacaagcttgacggggaatgagaggaggggatgctgtgacggtggtctatctggatgccttcctggtgctgaattttgtggtgaactatctgctgctggcctgtgccggcaagctggatggggagccggtgggccgggggcggaccgcgctggccgccgccctgggagcggcctatggaggattggccctgctgccggactggggctttttggagcacccggtctgcaaggccggcgcggcggtgcttatgctcctggcggcctttggtcggtcggagcggctgctgcggacaggggcgctgttcctggtgctctcctgtgccttcgggggggcgctgctgctggtggccatggtccgggggggtgacccggggacaggggggctgctggggccctctctggggatgcggggcatcctcattgcggcggctttgagctatggaatgctctccctgctgctgcgggggcagtttgcccacaccaggacggggggagagcttcaggagctgaccctctcccggcaggggcgctctgtgacggtgctggccctgcgggacacgggcaacaccctgcaggatcctgtcacaggccggccggtggtggtcattgagggggaaaaactccagaccctggtgccggaactgcccgtgctggaccggcagagcctgtcccacccggtggacctgctgcgggacctggagggggaactgggcggtctgcgcctgcagcttctgccctaccgggcggtgggggtggagtgcggtatgctgctggccctgcgggtggaccgggcccgctatggcccctgggagtaccggaactgtttgaccgccctctctcccaccccgctgtccgatgggggcggatactgcgccctcatcggcggacgggagggagcctgagcgggcggatcggaaacgaatgggaggaagcgcacatgaagggacgttttggcgtgtggtatctgcggctgtgccagtggctggcccggcaccggctgtggcggccgggaaaaattatgtacattgggggcagcgacgtgctgcccgctcctttgagccgggaggaggagggggagctcatcgcccggctggcggagggggatcaggcggcctcctccaccctaattgagcacaacctccggctggtggtctacattgcccggaggtttgagaacacggggatcaacattgaggacctgatctctattgggaccatcgggctgatcaaggcggtgggcacctatcagccggccaagaacatcaagctggccacctatgcctcccggtgcatcgagaatgaaatcctgatgcacctgcgcaagacggccagcctgaaaagcgaggtgccctttgacgagcccttgagtaccgattggaatggcaatgagctcctgctctccgacatcctggggacggagagcgacctggtgatgaggcccatggaggaggatgcggaccgccagctcctggccgacgccctggaaaagctcacccagcgggaacgggagatcatcaccctccggtttgggctgggcggccgccgggagcatacccagaaggaggtggcggatcgaatgggaatctcgcaatcctatatctcccggttggaaaagcgcatcatcggccgcttgaagcgggagatcctaaaggtcacggagattccgtgacaggggtaaacaggggaggaccccacagacaaaggactgggtgagacgtgtgaggtctcatccagtctttttgtgtaagggcaccggtttggcaggacagatcaaaaaggactgttatcgaatataagaaatcaacaaatgatagaatttaataaatagtatttgaaaagggatgaatttcaaaaggaattttgatataaacagatatctaatccaatgattcaatggaaaagagaggggaatgggggtattataaaagaaaaaacctgtcaaatatcataaaaagcttgattttcgatgggaaaattagtaaactaatgccaaaggaggcggggagatggatcggcggtcgaaagggtatctcatggtggcggcggccattgccctggtggcggtgggggtggctgtgtgggccctgtttttccgagacccttccccggccccagccccggatatcgcccctccggtggaagacaacgccctgcccacgggagaggatgacggggacaaactgccccaggcccagggaggcggggcggtgaacatcacctattctgaccaggtggcggtctgtctggagacaaggacggtatccattcggtttgccaaccccgcccgctcgaaccagagtatggtggtgcgtctcgtcctgggggagctggtggcggcggaatccggcactctgcccccaggcagcgccctggagtccctgccgctgctggccgatgtgacgctgccggccggcgagtatgcgggggcgtttcacgttctgttctacgacagccaggatggcggccgggcgggggtcagtaccaagctcccggtgtctgtgacggtggcgtagaaccccgcgccgtgtgtctgcggcctgctgcaaaggagttggatgggatgaaaaaatggttgacactgcccctggcggccgggtgcctggttctcctggccatgcccgcgctggccaatgagggccacatgaatcggccctctgacctctccacgattccggttaaggggtcctatcaggaaaagctggagacggagacggtatacagcgtggatatctcctggggcagcatggagtttgtctatgccaaggaggggacaggggtctggaacccggagacccatagctatgacaacgtaagcggcgcgggctggcagtatcccgctggaggaccaggggggctggcgggcaatgaggttcaaattaccaaccactccaacacgaagattgtctgttccctggactttaccacggaggaggcattcccggagatcgtcggaacctttgaccggccggagatttccatttccagcgcggaggggaaagccgtggacgacgagacgctgacccagaaaagcaagctgaacatgcagggcgccctggcagagcaggtggtgacacccacgcccattggagaaattttggtgacgctccaggagtgacggcctggttgagaggaaaaaagaggaagcatcggcgggatgcttcctctttttgttgggttacgtctccgccacctccgcgagcatggaccgaaagaggcggacgtggtgttcctcatcctggatgattcgttggagattggccacgatgttggcgtcctggatggtttccgcctgccggcggtattttccaatggccgccagctcgccctggatggcgttttgaagaagggccggcagctgctggggatagcgattgtaggcgggggtccagtagtgggaccggctcccctggacgctccacaggcgggggtccagccccatctggtgggcgaaggaggcgaagatgtccagatggtgcatctccacaatgctgatctggtgaaagcaccgggcgaacgccgcgtgctggggggagaggagaatgctgttgtagaagtagagactgacagcggacatctcggagttgtcgctgcccacgttgctcagcatggcgtaggcgtactctttccgatgggtttccggctggacggggggataaggcaggtcgagatcgacggaaaatttgccgttttgattggtttccatggggcgccctccttttgggatgatggtctcggaatactttacgagagcgggcccaaaagtatgacggaggggcttttccgatgaggacaccggggctactttagccggcggcgttatgaggcgtcgggcgtttccttttgccggagcatccgatatcccacgccgatgtgggtctggatgtactgggggtggctggggtcggtttccagctttttccggagagtggccataaagacccggagagagggggtgtccgaggcggtggagttgccccagacctggctgaggatatagttgtgggtgaggaccttcccggtgtttttggccagcagacacagcagtttatattcaatgggggtcagatggatttcctgctccccccgataggcgcagccgccagcgtagtcaattttcagcgcgccgttttggtagacgctggcctcctggtcggttttttgggtgtcatagcggacccgccgcagggcgacccgaagccgggccagcagctcctccacggagaagggcttggtgagatagtcatcggcgccggcgtccagggcggagaccttgtcgctgtcctcgctgcgggcggagatgacaatgatgggcagattgctccaggagcggattttttgaatgagggtgacgccgtccatatcgggcaggcccaagtccagcaggatcacgtcggggcggtaggacagggcgtccatcagagcgcccgcgccggttttcgcccggtggaagagatagttttgggtctccagggtggtggtgatgaggttgccgacagcggtgtcgtcctccaccactaagatctggggtttgttcatggatggttacctccaagggattgtaaagtcgcggatgggtccgctgaggggaagaacagcggataaaggcgccataaagagaaggaaaagcggagcagtctggaaaagggacaaatggcggaaaaaatggccaaaaaagagggggagagcgccgtttctccccagtataccacaagcttgccggttttcctatttttatttccaccaaaaatgcgacatttcttaatgccgccttaataccttgacgttttctttaatgggacgctaattcggcccgtgctataatacaaccagataggacgaccccagactggcgtgcagttccggggggaaagttcggaggttctccatgccttttttgaaacatgatcgcatcaccccggcccaggtggtgattttgggctttctctttcagattctgatcggcgcctgcctgctgagtctgccggtggccacccaatccggggagcgcgtcccctttctggacgcgctgtttaccgccacctccgccacctgcgtcaccggcctggtgatccatgacaccgcgctgttctggtcacctttcggacagggggtgatccttctgctgatccaggtggggggcatgggggtggtgaccatggcggtggccatctttatgttttccggccggaagatcggtctgaagcagcgctgggtgatgcaggagtccatctccgccccgcaggtgggcggaatcgtgcggatgacgggattcattctcaagaccgcttttctcatagaagccattggggccctgctgctggcgctgcggttctgtccccagtttgggttggggaagggcatttggtatggtatttttcacgcggtctccgccttctgcaacgcgggctttgacctgatgggggagacaggggccttctcctccctgacagggtatgtgggggaccctctggtgaaccttgtgatctgcctgctcattgtggtgggggggctgggctttctcacttggcacgatgtggcggcccatggccggcacgtgagccagtaccgtctccagagcaagctgatcctcctcacgaccctggccctgctggtgggaggctttctgttcttccggttttatgagttttcccgtccgcagtgggcggcactgaccggcggagagcgggggctggcggccctgtttcagtcggtctccccccggacagcgggctttaacaccgtggatttgacccagctcagcgcctgcagccagcttatgaccatcctgctcatgctggcagggggctctcccggctccaccgccgggggatttaagaccacaacgctggcggtgctgctgctcagtgtgggggcggtgatccgccggcagggcagtgcccggtgctttgggcggcgcctgccggaccaggtgctccgcaacgcgtgcgccatcttcttgctctatctggtgctgtttttggcgggcgggatgctgatctgctgcatggatgagatcccgctgatgcaggcgctgtttgaggcggcctccgccattgggactgtgggcctgtccctgggcgccaccgcggaggcttcggaggcgtctcggctgattttgatttttttgatgtattttggacgggtgggcggcctgaccatgatttacgccatggcggccggctccaacggcgcctcctcccagtatccccaggaacaggtgacggtgggatgaggacgtgcccggaataaaagagaaaggacgatggtatgaaatctgtcttgctgattgggctgggccggtttggccggcagatggcggagaagctgcgggagctgcgccaccagattctggcggtggaccgggatgagggccgggtcaatgacattctgcccctggtgaccaacgcgcagattggggatggcaccaacgaggccttcattgcctccctgggggtgcggaactttgacctgtgcgtggtggccattggggataactttcaaagctccctggagaccacggccctcttgaaggaatatggcgccccctttgtgctctcccgggcctccagtgaggtgcacgccaagtttctccggcgcaacggggcggatgatgtggtgtacccggagaagcagatggcccagtgggccgcggtacggtacagtgccgaccatgtgtttgactatgtggagatgacccgggaccactctatttttgagacccaggtgcctgcggcctggatcggaaagaccattgtggaactggcggtgcggcagaaataccgcatcaatgttctggccacccggacaggggaccagctggagttcctaccagggcccatgcatcgcttccgcagggaggagaccatgttcatcctgggggccaaccgggatgtgcagaaattcctgaatctttgactggacagcagaacgccctgggctcgaaaccgtgaggaatcgtgtgcccagggcgttttctatcgtcttttgttttggaccggtcagcgggtgtccaggggaaagagcagcttgagaaagagcttttccgccggtccgcctcgggtgaagtcaaaccgccgctcccgccccgttccgtccaggaggcagaagctgttggtatcccggttgacctgaaaggacagctggtccagcaccatgtccagggccagctcccactccagaagccagcgggtctggtcggtgtaatagatctcccacagccaggcaaactccaggggctgctggccgtcggccaggaaggactcccagagaagggccttgtgctccgcggtcagtgcggtgaggagctgttggggacgggcgttttcccaggcaaagtaggagaagaggcttccctgggtgggctgaagcaggccgcatttgtggacaaaggcctcatgctgtcgggagaccaccccccaaggtcctccgctggccgccagcgcccgggccatcacggtgagatggtcggcggcgtcccggtcgcccaggtccagacggacccccagcccttgcaggcgccggatggggcggccggagagggaacgggtcaaaacccgccctttcttgggggagctgccgggacggacggtcatttccgcggtttcccggtgttcggtggtgccgtaaaaggtcagggagcaggtctcgctgatatggcaggccaagccgcctacgctgttcaaaatatcctggtcactgtacaccacgtcccggtacagcagggtgagggcggtgccctcgggcaggcgcagcacagcggggaactcgtcaaagagctcgtccagcgtgaccatcaactccagaaaggctgcggtggcgggataggttttgggcagtggggttaaaggaatctgccactctttgatgacttgaaagggatatctcatggggatcttgctccttccctgggctgggcgcggacggccctgtgtcaaggattccgtgcctattgtaccccgaaaaaaattaggatgcggtttagaatcctgcctgggcgttaaactctcattaagaagggacggtgacggagggccctttataaaaccttaacagggggcggaaaatacaaatctcacccatatctctttgggggtataatggggagtaagaaaaggaatcccctgttcaaatcccattccccgtcgtatgatggaaagggaaagcacaccagaggcggggatttcgaaaccgcaagggagagaaggggcgcgtatggaatcggtgctgctggcagtggctttgctggggttcggcatagggggctatttcgtggtggggcgcgtcgcgcgtttctttgccatagggacctccggccggtccgccgggagaggggcaagatcgaaggagcgggaggacatgccctggctgtcccgccagtggcccacccccccggagcaggagaagccccgggagaagggcggaaagtcatcccggctggcggggtgagagcgggctgccagtgcagcctggagacaagaaggagggagttctgtgaaggaagaagacagacggccggattcggagcagctgctgcgcagcatccagaatgcggacggcccccctgggggaagattaaaaatcttttttggctatgccgccggcgtggggaagacctacgccatgctggaggccgcccaccgtgccaaggaggcgggggttgacgtggtggccggctatattgagccccacacccggcctgagaccatggcgctgctggaggggctggaggtcctgcccaccaaaaccgtgacgtacaagggcatctccctgaaggagtttgacttggacggtgccctggcccgccacccccagctgctgctggtggatgagctggcccacaccaacgccgccggcagccgccacaccaagcggtatcaggacatccaggagctgctgcgggcggggatcaatgtgtacaccacggtgaacgtccagcatctggagagcctcaacgacgtggtggcctccatcacgggcatttccgtgtccgagcgggtgcccgacaatgtgtttgactcggcctaccaggtggaggtggtggacctggagccggcggacctgctggaacgcctccgggaggggaaaatctatcgggggccccaggcggcccaggccctggatcattttttcagcctgaaaaatctggcctccctccgggagattgccctccggcgcaccgcggaccagttggagagctccccccggtttcagggggaggtgaagcccaaggcgggggagcatattttgatctgcctgtccggcgcgccctccaacgccaaggtcatccgcaccgcggcccggatggccaaggcctttcacggggcgtttacagcactgtttgtggagacgtcggactttgcctcccaatcggagcaggacaggaaacgcctgcgggatcatgtccacctggccgaggagctgggcgcccgcattgccacggcctatggggatgacccggcggtacagatcgcggagtacgcccggatcagtggtatctccaaggtggttctgggccggagcccccggaagcggggcttcacctcccccaaaaacctggtggaccggctcaatgagctggcgcccgacctggacctctatatcatcccggaccagacggcccggcagagcaagcggctgcggcggctgcggcagtcccaggaaaagttctcccccaaggacctggccaagatgttgggaattttgctgctgtgtaccctgggcggtgccctgttcagccattgggggtttgccaactccaatgtcatcatgctctatattttgggggttttgggcatcgccatggttaccacaggccggagttacagtgtggcggcctcggtgctgtcggtgctgatctttaatttcttttttacccacccctattttacctttatgagcgaccccagctatatcgccaccttcggtgtgatgttcgtggtggcctttctgggcagctctttgaccacccgaatgaagcggcaggccaggctcaacgcggagaaggcctaccgcaccgccatcctcctggagaccagccaaaagctccagaaggcggaggggagccaggccatcctggccctgaccgcccaccagctgaacaagcttttggaccgggacctggtgatctaccagcgggaggaaaacggggagctgagccccaccctctttcccgtctctccagagacaaattgtcaaggactttttaatcaaattcacaaaaaatctacaaaaaaggtgccagaagcattgtatggctcctgacacctcgtttgatagattacatttttccgttcagcaggtctttgcagagatacgcgtagtctggcagctggttgatatatgactcccagcgccgcttgatttcggccaattccagcgggtcggctgcttccagtgcatgatcgttgcccgtcatatacaaaacatccgtagcaacatcgtccaaacacctgccgcagagatcggcggctgattctatcctgataccggtatccacataaagcggatttacgccaatcgtcagccagacatagcccaccttgtccgaccagagcagttcaaaatcggggctttgccgcagatgttccgcaaagacttcctttactcgctcaatttcatgtttctctttttctgtgtaaagcatttttgtgtcctccttgacaaaaattttggtgcataccatcatcagtttagcacaaggcggcttcgtttatcagtctgtcacatctgctgaatttcatttttgagcatacgcttgattttatcgctcatggtttctgtgctggtattgctgaaatggacatgaaccttgtaggtcgtcttaccgattttctttaccatcgccggcgtgttttccggcgctctggacgcagtaacggcgtctgccacctgcatagtacggggttctttgttcatggcgctcctttctccgaacgggtctgtgccgcccggtaaaaaatcagtcgtgcttactgtttacaatgtcttttgctgtctgtcgggtagcaccggcattttcttcccgaaaattcttcccgtcaaagaggatcggcgcacaccgttccaaaatacggtcatagatacgggcgtgggccagatcaggcgggtttttcagctcggacagtttcaagtttgttgtgataatcatgggtctgcggctgcgatagcggctgtcaatgacgaaaaacatctgctccatagcatattcggtactgcgctctacacccaaatcgtcaatgataagcaagtcatactcatcaaagctggcaataaactccgacctgtcctcagcgaacatcccggtcaggcggttcagaatggtgggaaagttcgtcatcagcaccggcacatcctggtcaagtagagcgttggcaatacatccggcgaaaaaagacttgccggttcccacatctccaaacagcaaaagcccgatattgctcttatatgcctctttccagttctccacataggcatgagccttgtccatcaatgggttttgcccgttatcattggaaaatgtgtagtcgtacagataacggtcttgcaagccctgtgcctttcggcgtttgatacgctccatacggcgctgccgttcttcagcagccttgcgctgctcctcagcttcccgctggcactggcagatgcaacgcggcataaagtagccggatttcccaaagcatggcacaacggtctgcctctggccgccgcatttcttacagtgaatgagcccgtctgacaagtctatatactcgtcctcagccaattccacaccggcagctgccttgtcgatgaacgcccggatttctgcggtaatctcaatcatacggtttcatcctcctttacgctgtaatcccggttgcgtgagggtatgacagtttttttagcgtcctcaccggcccagcgccggatggtcgctgcatggctctgataatgcttgccagtagaagccatgtactcggacagcttttcgatgtactggccccatacagtgggaaagctggcctgtaagtctgccagttccccgtccgtcaggaaaacattctggtaacggccataggcgggggcggggtgtcccttctctatctctctctttatctctatctctttctctaactctatctctatctctggtggacgaatgtcggacaaatgtccgccgtttgtccggggcgcagaaagagccttattttggagcctcgcagcccgctttcgctcggcctcggtggaggactggccgatcagcagttcaatattgctcatgtagaaggtgccgctgtccagcacttccacaagacccagcttcaaaaagatctgcaaggctctctccacagtgccgatctgctggcgggtaatggtggcgatcatctgcgccgtgtaggggatgtcctcgtcaagctggagccgcccgccatgtttcagcgatttcagatacagcttgagcagaatgttggaatacagcacaccatcctgcatactttccagcagcacgatggaatcatcgtcaaaatagttttctttgagtttcaggtaataatattttcggttgtctgacatagggttcctccttggggtttctcttgggattctgtacgcattttaaggccattttaggggtcagaggataaatctatcagcctgcctttgacaccctcgaaaaaatccttgatttacaagggtttttcagcccctaacgcgtgacatttctcccgttgtttccgcttgcgctttgcggcgttgatccgcttcatgcgtgcggcacattccaggcagtatttggcccggttggaaccgggggtaaacagcgccccacatacggcgcatttctttgcattcagccggtggaacagcgccgtttccagttccttatcctgcggcaataccgccgcccgaaaccacctgcacaacagggagtaggaaatagactggacacagacacattcctccccatcgtccagggcgatacagtttccgtcgatgtagttacagcactcatgcaccagcctccgcgctctgcggtactggcggtaatccatgacagggataggttcagacttattgttcttcataaatgatttctttcatagtgtagctaacctccttgaatgaatttatttttaaatattcgtgcaaagtattgttttcttcgtgcaaatggcatatactataattgccagcagaaaggggttgatcgtatggctggaaataccacaaacatcagtatccgcatggacgcagatttgaaagcacaggcggacgcactgtttactgaacttggcatgaacctgactacggcgtttaacatctttgtgcgccagtcgcttcgtgaaggcggcattccctttgaagtaaggctggaacagccgaacaaggaaacgattgctgccatgctggaagcggaaagaattgcaaaagacccgtctgtaaagggatacaatgaccttgacgagttgtttgccgacctgaaaaaatgaggaaaacaaagtacaccgtcaagtacacgaccagtttcaaaaaagactacaaacgagccatcaagcgtggcttgaagatcgaattgctggagcaggtcgtagcgttgctggcgatgggcgaaccgctgccggataagaaccgtgaccatgacctgtccggcgattgggcaggccatcgggaatgtcacattctcccggactggctgcttgtctaccgcatagaagatgatgttctggtgctgacgctggcccgcaccggcacacacagcgacttgttcggcaaataaacagtctgccgccgtatggggaaacctgtacggcggtttttctgtatgccaaagtatgtcgtgaaacgcgacgcacttgacaggggtacgccaaaacgcggtagcctttaccgctccggcccacggtcgtgagacttgtccctttcctgtcgggacagctgctcggcggttttgcggagccgttccactgctttcaaatccccccgcatggatttcatggcaagcgtgtccgtctgctttccggcggtcagctggtcgatttcccgctgccatgccttcggggttatcccctcgccgctgtctttcagttctttcagataccgggctgctgcgtcatacagaatcagttcccggctgtggcgctgttcaaactgttcccgtttttccggctttactttggcaagctgcttgtggatggacttgtactggttgtactgttcccacatctccccgcgctcggtaagagtggcgatccggcgctcggccttgacgatctttccccgtaggtcatagtaacggctgttcatatcagcgattttttcatggagctgctgcatggattggatgccgtttgcctgcaaaaagctgaacagggcggcgctctcctgtaaagcccggattttgccggtgcgggtgtcgggccgcttgagctgctgctgggcctcccacaagtcaatcatgctgggctgctggccctccggcttctcggcctcggccttcgaccagttgtaaaggcgggtaatgcgggccttgatttccttgagcagcttgttgtcggcggcgatctgccggtttacttcgcccttgtcggtgcggatgccgcgcttttccatttggctggcggctggccccagatggacagagggaattttatcaatgccctgccgcttgtagctgcgatggtcaatgcgttccggtctgccggcagattccagcgctcgattggtgtaggccgcccacgctacccgccaaatctccacatttcctttatcgttccaatcggttgtatcctctctgtgatttttccagccgcctttcccatccgggatacgctgtccattctcgtccagatcgtatgccttacggcactttgcgccccactgcccattttctttcagaggccggagcgtcagcatgatatggacatgagggttgccggttcccttgtcatggatagcaaagtcggcgcacattcctttgtctacaaagttgtccttcacataggcgcgcacaagggcaagctgttgttcgccggacagttcacggggcagggctgcctcgatctcacgggcaagctggctgtcccttgctttctcgatttgctccacgctgttccagaggatagaacggtctgcaaattctggcggggcgtgggcaggcagcatgatctccgcatggacaatgccgcctttccgggtgtagtcgtgggtcattccatcccattcatttgtcagcttggttccgctgcggtaagcagctgcggcaacggcagaacggcctgcgctgcgcttgatgatactgacggggatatgacagaaatctatggggaacacctcctttcagtgaggggatatttcaggctctgtggagccggacaaacgcaaagcgggtgtccgacgactgcgcagagcgcacaaggggtttggggagcgtagcttcccatcgcggacgaagtacgcaacgcccccggcagggcgcacagcaccggcaacggtgtataagtgcgcccttgtaaacaagggacttatggcgtgtccccggattttggcaggtttgcagttaattccgcagcccccggaagatgggacagggtaatcagaaatgctttgacctctgcgccggaaaggttggaagccagtgggaaaatcccctccaaaatggctccgcgctcaatcaggcggcgggtgcgaaccctgcgttcttcgttccgctgcttgttctccaaaatcttcttgcggttttcaagctgccggatctccttcaggacttcctcccgttcttctttttgtgggtgggctgtaattttttcgttcatgtcaggcacctcttttctttggaaatactcatagattgaccgtccatttctgtcgagcaaagtaccggcgcagtctccgcagtgcggcatggatggattttcccgcctgtgctggcgtgataccctccattgcggcaatatctttcactttcatacccagcatatagcgggcgtgaacacggcgagcctgcataggcggcagggaggaaatggcttcatacaatcgccgtatcagttcttcgtattcggctaattcttctttttctatcaggtagtcctccggcgatggctgcgcccagccgatggcggcattttcgattccatcgttacaatcgagggaataaaacgccttataccggaacatcttgcgatctctggcggcctcggctctcttgtccagaagaaacgcttcgacgatctcatcggacacctccacaaaaatgtcctctttgcaaaatggataatattgtttgagattgatggtctgcataggcatgccctcactctgtttggaaaaagccatcatagcagcggcgcatattccgcagacctcgacggatggcaacgctgaccttgctgctgtggacgccctctatccgagagatttccggctgcttgataccagcaatgtagtaggcgtgaacacggcgggcctgtgtcggagtggcatgagccagagccaccggcaaagctgcaattaggtataggcgggtggtcatttcttctcgttccagcaaaatatcttccggcgatctgctgtgttccagtgcgtaattttccagccagctgtatgcgtccagagagtagtaggcgcggtggtagactttccgacgctcatagttctccatctcccgcttggcctgatacatcgctgcccatacctcgtccgtaacatccacaaactcgtcatgccggtagtggggatacatccaccgcagattgattgttttcataggcttacctcctgaaaatcggagaggcggacagctcgtccgctgtccgcccctcgctgagataagggaaatgatccctttcacttggtagccagaaaacaggtcattcgttaagcctgttctcaaagaaatttataaatttttttctgaccgcctccacactttgatacacagccactttggagcagccgcacagcacaccaatctctgcaaggctcagcccgtcaagcgcatagagcaggaaccggcggcgctgggcctcggtacaggtgtccagaacagccatcagctcatgcagcgtttccatgcggcaaaggtattcctccggcgtttcgccgtagacccctacaccctcggtggtaatgatgtactcgtcaaactcccggccatcccaatgccgccgctgttcatggaacaggttctccgttttatgatcggcccggtcaagaaattcatagacttccagcgtaacctccacggccacagcttgtccgttataattgatggtaacttccatctgtctttcctccattcagatttttttggtaaatctgaatggggcggcggagaacggcactggggccagggttcgggccatgctggcccgatgtttcggctccaaagggacaaaaaagcgcccggacggcataaagccatacgagcgtaatagagtatattttgctgtttagttacatggtatagtgcatacttctgaccgcattgctccgctgctgggaacaggctttttttagctggtgcaggtcatggggactgtgaaaaaaggcaaaaatagacacggcggcaatcctcctatgtgccgccgtggatttacacggtgttaggtcgtcgttagattgggatagatgaaaagaaacggcggctctgatcttctcaaagccgccgcttcataggcgcgtggaaatgtgtctgctgtacgacggcttttttcttttgccgtcgtgcggcagaatgttattcaatattcaattcaatgtttccagtaaagtcctcacactcaatgccgatataatttccaccatcaggaagtgtaattgtgtcactataagttccggttgtttcaatcaaagtgactgcttcatccgatccagaaatccaaaatacttttgcagtaccttccgtaacctccaaagtgcagtcaatagacagctccttaccggcttctctttttatggaagttcctccgaacacatactctgtatctgaaaaattctcataatcagccgtataagttcccgtataatcatcgatccctttttcttttgttccttccaaagataactttcctgtaagctctatggttccagctgactgaacgatattattataatgatcgagaatttcatcttttgaacagccagaaagcataaaacttccaaaaagaacaaatgccaatgctaaaactgttttcttcataaaatcatcaccagcctttctttggtgctacctttttggcctttttctttgtttgggttgcttctcgctctttcatgcacaaaatcaagatggcagaaataacaacagcaagcacaagactgcaagaacaggttccgatattccagttgactgcggtatcatagctacggtagcctaccattccgagacttgcggtaatcggataaaggtttgctaatgtcatatttcctgcggcaaacatccctccatatccatagacaaaagcaatgattacaccgactaaaaagctgcccgccctccgacaagtaagagcgataatcggcagaaccgcaagatataaaaagaaattaaccgcggtaatctgcaaggttgcttttagtgctaaggaaatttcaaagccgggaaatcccacaatcatttctgctatgattgtaaacaggctgcatatcagcccgaaaataatagacaatacgccgcacacaatcaatttcccggtcagcagtttcttaaaagagatcggcacagtcagaatatttttcaatgtgtcatccgtctgctcacgagaaatcatatatccagcaattaggctgatacacatcggaaaaatcatggacatattgtttttgatgacctgttctgtaagataggcgaaatcccaaacggaaccatcattcgccatagaggtaaacaaggtcagcaagacggataggagcatgagcgcaacacccgcccaaaggatatgataccttttcaatttataaaattctgtttttacaatgcgaaccatgtttattcccccctctgcttatataatctgtcaatcagtaagaacgaaactaatgccatgatcccaagaatgaatacaacttgaaatgttgaaggaattagccctgtcatttgctccaagtccatttttattccatgagccgccatatctcctgcactccaaaatgtagtcagtggcgtgggcagaagccataacatggttttaggcagtgtgtcaaacaatgccgtagcactcatgttcagaacgctgtaaaagacacacagcaaaatggaaaaaacataggtcttactgaaaaagacaacaagaacaatcaacgggagtgttcctgccgtaatgaaaattcctgtttcaactgctaaaaacaatttatagcctgttccataaacttctaatgttccaaatccgcaaagaattgttgcaatggtagaagccacacaaaaaacaattccaaagagaaacaggacaacaatttttgcaagcaccatttgcgtgctggttacgggaattgtacgcagatttttgaatgtgtcgttgtcgcgttccataaaaaacaggatagcggcaatcacaccgataatgcagggcaataaaaactggataccatatcctaacaccatgttaaatagtccgtcgaaagcatctgcctgatccgtatatcgctccatcatagagggcgttgtcatcagataagtcagcgggattggaaacagaaaagcagccagaataatcagcggaataaatttcttccgtttcaatttcaaaaattcgcatttgattagtttaagcaattccttcgccccctgtcacacgcttgaagtaatcttcaagactttcttcacaagtatgcgcctccgatacctccaatccattttctacaaaggcagttacaattttccccacaggcagatcaaggttgtgcaggcgcagattgtggtcgtcctgtatagagaaatggttttcatggaaatttcgttccaaaattcttgccgcctgcgcagtatcagagagtgtaaaccggatatgcttactacttttttgctccaactcagcaaggctttcttcttccagcaatgcaccgtggtctataattccaatatcgtcagccagcaaggaaatctccgaaagaatgtgactggaaatcaaaatggtttttcctcttgcgtcgcaaagctcccgaataaaggagcgtacctccgcaataccgatgggatcaagaccgttgatcggctcatccaaaattaaaagttccggatcgtgcataacagcaagggcgatggcaagccgctgcttcataccaagagaatactgggaaaagagctttttatctttgtagggcagtcctaccaaatccagagcgtctttgatggcatgattgtttggtacgccccgcagagtagcaaagatacgcaggttctctgtgccggtcagattgggataaaagccgggggactcaattaggctgccgatacggggcagcaatttcttttcattcccctgcaaagattttccccagattttgacctcaccggaggtcggcttcgttaagcccaacaacattttcatagtagtggtttttccggctccgtttctgcccagcagaccataaattctcccacgcttcacatggatatttaagtcagccacactcttttgtgagccgtattgcttcgtcagattttttgtttcaatgatgtaatttgtatccatattcaaaacctcctgttctgtaaggtattctatcacgccaaccttgcattaaccttgccgcaaccttgcattaaccttgcaatttagaatccggccaaaatgacaagggttcccgccataaagacgggaacccgcttaaatctccaaaggaaaaaacaacataaattcagtcccttttcctggtacactttcaactgttatgcttccacccatcttttctacaagctggtggacaatagaaagaccaagaccgctgcctttctcagagcgtcctttatcacacttataaagccgttcaaaaatgtgtttcaaatcttctttctcaattcctactccattatccgccagcagcagctccatgttattttccttctttgacaggacaattttgattttgtctgcatggctgtgagcgattacattttgaatgagattgttgacgatcctcatatagctgtccatatccaatcttacccggacaggctgttcgggaatatcaatgtcataatcaacctgtttatcctcaaaaatcggtatccagtcaatcaggatatttcttgtcagctctgcggcctcaacgctctggatttctaaagcaaactcgtcagaatttaacttgaaccagtcaaagagtacatcaatatattctttcagatcatgggcttttcgtcgggcggtttcaatatcatcatcccggtctcttcctgtgaccagtcctttgtgtgcagcgtcaagatacccaatcagagtagtaaggggcgttcgcacatcatgggaaaggctcgtcataagctggcggttggtttcctctgtctgccgtacagttgaaagtctgctttcataggccacaacgatctcattgatttcataggcaataggtgctgtcagttcatttgttgcagacaaaatacgccgattgccatttccatttttcacatcaaccagtgcatcggtcatttctgcaatttgcttttttacacgccggacaagaaagatggaggtcaacacagccacaacagcaatcacaatggacaagaaaacgatgatttccatgctggctacacctccttattaaaccggtagccaatccctttgaccgtttgtatatactttgggcttgaaggattgacttctaattttttacgaagccgactgatgatcgccataatgttgctgtcgtcatagaaatattcttcaccccatacttcctcataaatctgctgtttggtcaaaatttttccttgatgctttgcacagtacaggagcagatcaaattcctttggcggaagttcaaaagtgccgtttgccgtcgtaacagaacgattttcaaggtcaatctgcaatccgtcaaaatccagtttttgcacagctccggcttgctgattaaagcgagtgtagcggcgaatgagagaaacaattcgggcaatcagttcgtccatatcaaacggttttgtcagataatcgtccgccccagcccgtaatccccgcactttagaaatgctgtcatttttggatgtaaacatcaaaatcggcaggctgttctctttgcggatttcttccagcgtttcaaaaccatccataccgggcatcatcacatccagcaccacaagctgatactcctggtcttttaatttctgcaagccctcttttccggtattacaaaaatcagcttctatatgttccgattgtacgctgcgtttaatcaaagcgcacagttctctgtcatcatctataatcaaaattttattcatggcgcagttcctttccttgttttgtccgaccatcaatcggcttctccgcagtttttgggagaagccaaacaccagccattttcacagcgccggggatacgccctccggcgcaataataatttaccctacgaggtgttacgccccatttctcggcggcctctttcaatgtcatatagtccatttcgcacctccataggatatattatagttctctttctcgaacaatgcaagaaacgaaatatgaattataaacttcaactaacctgcatatagcaacattccacgggcaaagtatgaattatacaatgtaaccgggtgatgttatatggcgaaagttgaagattgtcccggttttgaaaccttcggcgcagatgtcaaagccgcacgagaggcaaagcgtctggcacgaaaaacattggcagaaatggttgggattgaatggcggtatcttgccaacattgagaatcaaggtgcgattccgagcctgcctgtgatgatccagttgattaagatctgcggacttcctgtggaacggtattttaacccggagatcatgcgggaagaaagcgaacagcggcaacgggtcagccacaagctgaagctttgccctgaagaatacctgccgattatcgaaggtgccatagacggggcgctcaaaatggaacacactgcgaagcagaaggaggacgcataatcgcggcctccttctggcgtttctatatcaagtttcccggcacttttcccaaagttcccggcacctctgctggatttctccggtttctgtcacagtcagctcgcggtcatttccggtaatcttatcttccagaaagttggcgtatgtacccaacaaagcgttccgtaaatcctccggagttttctgtatttcggcgctgtaccagtcattccggtgaggttcccatgccatcaatgtataaccgtggctggtctgcaccacctcatacagaggatcatcatccagatatgcctgaaacactttcaaaaccttttcaaaggtcagcatttcccgcacctcccattcagctgcaaatcagttccctgattaaaatttcctcaatctgtgccgttaatgtgttcatcagccccacccaacgcataggatcacaggctttcagttcctccgtgacacccgcagcctccatcatgtgaggtaacatggtgtccatacgctcctgcgctgtccggtcaatctctaacaggtgtggatacaacttctcgctcatcagcagttggttgtagagaataggacgatgttccttcaggtaggattttcgcatcctgccgtacttgccgatagaagtttccggctgttcagaaagttttaggttgggtatatcataatctccacaacgaatgtaagtcaacttattcatattcatgctcctttgctccgtgatggttaaaccgctgcgctggctgctatgctgcctttgcgcggttcttctttaggcagctggctaacagtagaataaacgccttttttcatgtcctcagcccggatcagggatttcttagcgtccatttccgcttttttcttcgccttgattttgtcctcatatcgtttttgtgcgccgctggctttccgcttcaaatagttctgatgaagcctgtccttgcgttcttcttttttccgcagttcttcctgttcctccgtggttaaaggaaccggctgtaaggatggtggaatatagcgtcctaaaaaattaaagtagatttcaatttcctgcgtggtatcctgactgccttttcgggagcgttcatggacaaggattttctctacaaactcgttgagcatggtatttgtcagcgtgtcaaaattctcgtacttatcaatcagggctataaatttctctgctgatttctggctctgctcatagccggtaacagccttttccaactccgcaatttcaatctcaagtgtgtcctgctctttggcatactgtgcatcaagcgccttatatcgtgtatccggcagcttgccgagggcgttatcctcatagattttgcaaatcagtttttccagttctccggctctcttttgggcagtagccagacgcctgcgctttttcgatatatcggcactctgttgagcaacctgcgtctcctgaacagtgtgaataaattccgtccggtcatttctcgaatattcagcgatagcccggagtgtgtcggaaaccaatgtcagaacagcactctcattgatacggtgttgtgtaaggcatagtgtcccacacggaactttggtataattggaacaggtatattgagaaatccgcttgccattgttggtgcggtggacatacatcttgccgccacaatcggcacaatagagtaagcctgtgaggggagctgcttcgccccagccgtttggataacgccgtacattgctgcggattttctgcaccagatcaaaggtctgctggtcgataatggcttcatgggtattctcaaagatcgtccactcgtcctcagaaacatagtggcttttcttgtccttaaagtgcttgcgggtcttgaaattgatggtgtgccccaaatactctcgttttttcaaaatgttcacgatggtagatgatccccatccataggggtctttgaccggctttgaacggttcacaccctcgttgaagcgggcaaggtgtacgacaggaatttcaatccggtctgcggataatttgcaggcgatctgataaggcccatatccctccagcgtgagggaaaagatacggcgtaccacttcggcggcttcctcatctaccagccaatgttcccgcttttcatcccacaagtagccgtaaatcacggtgcctgtcaggtgcttaccgctcatgccttttgacttaaacacagagcggattttccggctggtatcacgggcgtaaaattcattcatgatgttgcggaacggggtaaaatcgtcatcgcctttcagactgtccacaccgtcgttgatggcgatcagccgaactccacgctgccgcaaaacctccatgacctgaccgaccttcagatagtcgcgccccaaccggctcatgtccttgatgacgattgcctctacacgccctgcctccacttcctccatcatcgccaaaaatccagggcggtcaaaacgggtgcctgagataccgtcatcggtaaagtgcgtagggtttggcagtccattccggcgggcaaaatcctctaacatctgtttttggttggatatggaattgctctcgccctgtaactcatcgtcccggctcaggcgctcgtacagtggggtgattttttcgtttctcatagctgtacctcctgaaacaaaaatgctctaagtgattgcttcactaaccatgacaaaatcatgattaagaagtcacttagagcatatatcaccagggacggacttgtcggaatttttgacggagtccgagcggggcgtggcggaatgggtgtttaagaacaacaagcacgccggcgccaccaccaacaccctgcccagcgccaagtgcctgtatatgtccatccggggcaccggcggcgccctggctgtggcggccatcgtcaccaagaaccgggagaagcccgaggcctttgagaagaattttatggtggcgattctggatgagtgcggcctggccctggagaaggagatgacggtccgggagaagcaggcggtggaggaacgggcccaccaggagaccctccgggccaaccttctccgggccatctcccacgatctgcgcacccccctgaccagcatctccggcaatgccaatattctgatggagggccgggggcagctgtgccaggaaaagctccaggccctgtataccgccatttatgacgattccatgtggcttattgacctggtggaaaacctgctgtccatcacccgcattgaggatgacaagctgggcctgaaaacccagccggagctgctggaggagatcttccaggaggccctgcagcatctggaccgaaacgccagccagcatcagatctccgtggagctggaggacgacctgctcatggccaacgtggatgcccgcctcctggtgcaggtggtcatcaacattgtcaacaacgccattaagtacacccccgagggctcccatatcaccctgtccgcccatcgggagggggaccaggtggaggtggagattgccgacgacggaccggggattgaccaggacgccaaggatcggatctttgacatgttctataccgcggataagaaacggggggacagccggcgggggttggggctggggctgtcgctgtgcaagtccatcatcaatgcccacggcggaaccatccaggccgtggacaaccatccccaggggaccattttccgcttcaccctgggcgcagtggaggagacaaaccatgaataaaccgcagattctttttgtggaggatgacacggcggtgggcaacctcatcgccacaacgctggagacccagaactatcagtttcaccgggccaagaccggggcgggggcgctgatggacgccctgtcctaccggccggatgtgatgctgctggacctgggactgccggacatggacggcattgagatcatcaaaaaaatccgctcctggagcaatctccccatcattgtggtctctgcccggggggaggacgcggacaaggtggtggccctggacgcgggggctgacgactacttgaccaagcccttttccgtggaggagctgctggcccgcatccgcgtggcgctgcgccgggtgcgctatgacagccagaaaaccagcgccgaggccgccctctatgagaatggggacttgaaaattgactatgccggcggccgggcctgctgccggggggcggagatgaaactcacccccatggagtataagctgctgtgcctgctggccaagaacaccggcaaggtgctgacccacaactatatcatcagtgagatttggggggtctccgccggggaggccgtggcggagattccctctctgcgggtgtttatggccaccctgcgcaagaagctggagctggaccccagccatccccaatacatccagacccacgtgggggtgggttaccggatgattcggcagaggcaggaggacgagagctgactgtcccgccccagcagagcgccgccgtgctgttttggcacggcggcgcttttgacatcttctggcggtacaggcagaagggtgggaaaaacaggggcaagatttgtggaatcttaatcttagaccggaactcttatgggcacactaattacttctgtgctaccataacctcagcaatccaaacgtaatccaagacctgcattgtgaggtgtttttattattatggttgaatttcaacaggtctgcatggcttacaaggaaaaagaagttttgaacaatgtggatttaaccattcaggatggtgagttttttgtgctcattggttccagcggctgtgggaaaaccacgctgctcaagagcatcaacaagctcctgcccgttcagcagggaaccctgaagatcaacgggactccggtgtcccagattaaggtcaaccagctgcccaacctggtgggatatgtggtccaggccgggggcctgttcccccatctgacggtggaggagaacatcgccctggtgatgaaagtggcccagtaccccaaggagcagatccatgaccgggtgaccgccatgctgaagatggtgaacctggacccggccctgtaccgcaaccagtatccctcccagctgtccggcggacagcagcagcgtgtgggggtggcccgggcctttgcggtggacccgcccatcgtcctcatggacgaacccttctcggccctggaccccatgacccggtcagagctgcagaatgagattcacgccctgcaaaagaagacagggaaaaccatcatctttgtcacccacgacatggatgaggccatcaagctggccgaccgcatctgcatcatccagagcgggcatatcgtccagtgcgacacaccggagaacatcctgaagcatccggccaatcagtatgtcagtaccttcatcggggaaaaccgcctgtggtccaacccggggtacatccgggccgccgatatcatgcgcctgcggcccaagaccgtcaaccgggggcggacggtcctccaagccctgcaaatgatgcgccagggcggcgtggacagtctgcttatggtggatgagaaggagcacctgttgggcgtggtgtggctgacagaactgatggaggagcgggatggctcggctcccgtggaggattacctgtctgacgactatgtggccgtggaggaggacaccaccctccaggagatcatcgccaacattgactatgacgcggcgggcatcatcccggtggtggaccggcagcggattctccggggcttcctcaccaagagcagcctcctggcgaccatgagccgccagttcgtcccggagcagagagaaggggagaggagcggtgtgatatgcgctacgcactgagcgactacttagagatctatgtgaccaaatgggatgagctggtggaggagttcctgcgccatctatctatgaccagtctggcggttctgctggccctggtgatcggggtccctctgggtatcttcatcacccggcacaaaaagctctccgcggtggtcatcgcggtggccaacgtgatgcagtccattccctgcatggcgctgctggccctgggcatcccggtctttggaattggggaaaagctggccgtgtttatggtctttgtctatgctttcctgcccatcctgaagaatacctacacagggatcgcggggatctccccggtctccctggaggtggcccggggcatcgggctgacccgggcccaacagttgacccgggtggaactgcccatggcggtgccctatgtgatgtcgggcatccgcattgccgcggtctccgcggtgagcaccatgaccattgcggcctttgccggtgccaacggcttgggttggtttatcgtgctgggcatgaactccagaaactatcccctgaccctcatgggggcagtggccgcctcggtgatggccctggccctggacttcctcctgggccgggtggagaaggcggtgaccagtgagggcctgctgccgccggatcagatcaaaaatctgtcccgtaccgtccgccgccgccggcggaacgtggcctggggactgtgcgtggcgctcatcggcgtgtccgtactgtcctatgcggcgctgatctaatgtctcccatcgggggaaatcccgcgcaatctatattattttcaaaacaaaaaggagcgtattgaattccatgaaactctggaagaaatgtttggcagccggtatgactgccgcgatggttctggcactgggtgcctgtggcggtgacaatggtcaggacgaggggcagagccaggccagcgggtctgataaaaccattacagttggctcctccaactttacagaagccattattctgggagaggtgtacagccagctgattgaggctaagacagactatactgtggagcagaagttcggactggccggcgccgcggtctgtttcgatgccctggaaaatggggagatcgacatgttcgtggagtacaccggcaccgcgctgatgaatctgctggcccagcccatggccacagacaaggatgaggtctggcagaccgtccatgaccttatggagaaggaccacggcatcgccacctccaatcctctgggcttcaacaacacctatgtgatgagcgtgaagcccgagaccgcggaacagtacaacctgaagaccctctcggatctgattgagaagtctccggaactgaacctgggctgcaccgtggagttcatccagcgggaggactgcctgccgctgctggagagcaagtacgacgccagcttcaaggacgtgtccggcctggacgccagcctgcgttatgacgccattgaggccggtgaggtggacgtggtggacgcctttgccaccgatgccctgctgtccaagctgggtctgaccatgctggaggacgacctgaacttcttcccgccttactatgcggtgaacttctctgacaaggcgctggtggatggggacccccagttggctgagaccctggcgctgttggacggtaccctcaatgaggaaactatggccgctatgaatgccaaagtggacgtggacggtatggacgccaaggatgttgcccatgacttcctggtggagcagggcctcatcgagggatgatcgcctccccacggcaaaccccataaaagaaggaaaaagttcccggtatgccagagaaagcatgccgggaacttttggggttttgcttttcaacattgagagagaaaggtcgttgtggtgatgaagaaatctgctttgtccaacgaggccgcccggcaggcgcaggagaggacaagcccctggaagcgcccccggctgtggcgggagctggctgtcatctttttggggtcccttctcttcgcggcctctatgaactgtatcgttctgcccacgggcatgtacagcggaggctttttgggcctggcccagctgctgcggatggggctggaatccctggtgccgggcttgcagagcctgggagacttggccggcgccatttattttctgttaaacctccctctgctggccattgcctggtcccggtttgggcattattttttgggcaagaccattgcctgcgtcctgttttacagtgtgctgctggcggtgatccccattccggaggtgggggtgtttgacgaggtcctcacggcctgcgtcatcggcggtctgctgtgcggcgcgggggccggcctcaccttgacagccggctgttccggcggcggagaggaaattttgggcctgctgtgcgccatgaaaaacccttggttcagcgtggggagaatctccatgctcctcaacattggggtctttgggactggcctgttcctctttgaccggcagtcggtggtgtacagcattctcatggcaggggttatgtatctttgcctggaccgggtccacctgcaaaatgtgatggtggccatgtttatcatcaccaagcgggaggacatggaaaaactggtgttccagcgggccggccgaggcgtcacccgctgggtgggggagggcgcttacagcagccaggagacggacattctgctcacggtggtctcgaaaaaggaggccctgtccctgcgccgggcccttcaggagcgggaccccaacgtatttgccatcatttgtgaggacatttccgtggtggggaatttccagaaacgggtatagaggaggacggcggagatgggaggaaagctctggctctttctgctcctgggatgctgcctgctggccggctgtcagcagacagagacggtttcggtgccgccggcggtgggatgctatccagtggagggatatgcgccggacccggcggacctggcggcggccccctatacctataccggcggcgcccagggcatttcagtgacctgcacggtgcggcaggcggagccggcggccttttccgccttgctccaggaaaaggcggccctgtgcgcccagctggcgcagaacaagcgggccaaccctgacccgtcctatcagcagggccaggaaagcctcctggccaaagcccagggggagcaggccgccctgcagcaggcgggcacggtgtatgagaccacccttcttctaaaggggataggccaggcggaggggcaggtcctgaccctgtccagtggggagcaggtctatctgtcgcttccgctggccccgggacaggagcggctgaccctgtacaacacgccggcgggggagtacagcgagggggtcctgctgccccatctgcccagctatcaggtgagcctggagaccggagagggagagccgccgctctccttccttctggaggagccggcggcgggaggctgatatatggacaaggaaaaggaccacaaaatgtggtccttttccttgtgtcgtgtgtattttcaatttgaggatgaagagatcaatatttttccagacgttccaggtccagcacgaagacggcaacaccgccttggcagacttccatgggggtggaggcaaacagcggcggcagcccgtgcgggggcggcatggagccgggattttggtagagagtaaccgtccgtcggcccgctgtttccttgagcaggtccaaaacctgttccagcttggcttcttccacgccaatcataatggtgacgctccgtttgcggagaaacccgccggtggagtgaagaatcgtgacgaatatgccgttttcattgagctgccggaccacgtcgccgtagtcctctccctggagcacggccagaatcagtttgctgtgggccatcgctgtccctccttttgcggcctgtggctgcgttcctgaaactggctttgattatagcggttttctgggggaatacaaggggaaatgggaaagtttgattcccccttaacaagccgaatggaaccttaacatgttcttaatttgtcaagaaatacctcccctggtatcccggccaaatcttacaattttgttagaacttcgtaagaaaataccataccaatgggggttctgttggcgtatcataaaggaaacccattggaagaggaggcaaacccatgtacatcaaacttgccctgcgcaatctgcggcgttctgcgcgggactatggcatctactttctgaccgtggcggttacagtggcgctgatggagtcctttctggcgctggcctgtgcccgggatgtgctgtccctgtcggagaacatggggattctcaccacggggattgtgggggtctcggttctggtggcgctgctgtcctcctgtgtcattgcctatggcgtgggcttcatgctggggcagagaaaacaggagtttgccctgtatcagctgatggggatggagctgaggaccgtccaacggatgtttttttgggagaatgggctgttgggactggcggcctttgggctgggggcgctgttgggaacgggactggcgggagtcctggcccaaggggtatggtggatttttcagacgccccatcagtaccaggtagtggcctcgcccaaggcgctggggatgacctttctgctgtttctgctgatgtacggggtgggcgccctgcgggccggccgggtgctccggcgccagagcattcaggggctgctcacctcccgccgggccaatgaggtcccgggccgctggcggccgggacggtggtttttgctggttgcgccggccctgacggggatggctctggggcttctgctgctgaggaaggccctggatatgcagaccaacggggcttgggcctatctggccggtggcggcggtctgctgctggggggcgtttacgcactttaccgggggctgcccggtctgctgctggcagcggcccgccggcggcccaaggtcaagtacagccggggacgtctgttctacctggggcagatgggggcgcgggtggccacggcgggacgggtgctggcggtgacggggattctgctcaccctggctctgaccgccctgtttgtggggctggccctgggaagcggttaccgggccaatatggaggcgtactatccctatgacgccggggtggcggtggacgcccctttgaccaagcaaagcgcccagcccctgctggcggcggtggaccggcaatgccccgtggaggacagcgtcacctatttcctctatgagaccccttacggcacggaggcgatggcactgtcagactacaatcatctccggcggatcttggacctggaggaggcagagctgggccctggggagtatttggtccactgtgacacctggaatttttgggaggagattcaacaatctctggcccaggcccccatgctctctctggcgggacagcggctcacgcccggtaccccttctctgcggacagaacccatggagcagtatcaaatggcgggggaacgggggtatgcccttgtggtgccggaccaggtggcacagagcctgccggagaagggctggcgggtggtgatggacctccagggcggggggactgcggcgctgcgggaggagattcggaccttcctccacagtgcacagtggcggcctcagctgctgccggggagaacgatgccggaaaaggtgaccatgggggtgtcggtccaggcctggggggtggccaattcgctcacagggtttaccacgctgtccttttgcggcctctatctcagcttggtgatcctcctgctctcctgtaccattttggtctttcaccagctctccgccctggacagaaatcagcggcagtatgccattctccggcagcttggggtggacaggcagacccggagccgctggatggcctgggaactggggacctttttcctcctcccgtttctcctgccggcgggggtgacggggcttctgagtgcggctgcccagcggctgatggggcctgcggttttgcagccaggggtgtttctcctgtgtggagcggcggctctgg

SEQ ID NO: 2228 - DNA, 61189 bp, KLE1738
ggtaggctccgtggtgtccccgccgcagccggtcagggccatcacgcccaccagcatggtggccgccatcaggacagagagaaacttcttcattggaataacctcttttcatttcacttctgctctcccccgcaggtttttttgcgcccgccggggggagaacgctttgcattatacacaatattcacaaaagatgcaagtccttttttcaaaaaagagccggcggaatcgtatgaaataaaaagaactgggcagcacggagaaaccgtgctgcccaggttcgacaagagaatattcatttcgtatgaatattgcatacttcccctgttttcccccacagggaaacgggaacaacttactggaagttggcctttctcttctccaggaatgcagccagaccctcgtcgccattgggatgcagacgggcagcggcctgggcctcagtctcctccttcagcaggtcctccaggttggtctcgaaggacttgttcaggatgagcttggagctgctgtaacagttcagggggcccttggcgatcttgttggccagcttcatggcctcgtccatcagctgctccttgggatagacgtggttgcacaggcccagctccttcatctcgggggccttcacagcacgctgggtcatcatcagctccttggccatgttcaggccgcaggcccggggcagcagccagtgaccagcgcagtcgggaatcagacccaccgcaccgaaggccaccatgaacatagcgtcgtcagagaccagggcgatgtcgccggccagcagcagggaggtgccggcaccggcgatggcaccgtgggccacagtgatggtgggcttgacaaagttgatcatcttcttcatgaagatgccagccacgttgtagaagtcgaagacagcctcggggttgtccaggcccttcatctcggggatgtcgccgccggcgcagaaagcgcggccctcagcgttgaccaccacgcagcggacagtgtcgtccttctcggctgcgtcgaaggcggtggtcaggtccacgaagatctgcttgctcatggcgttgagtgccttggtgcggttgaggctgacgatgccgacgttcccctcaacgcgatacagtacggtttccagttccatggtaaatcgctcctttttctatatcagttcaaaaatgtgtgggtgctcagggtttccccatgcgtatacaataaaattatagcacacggggccggcgttgaaaaggaaaatttcacgggcggcccgggaattttcccgcccggcaggtcttcgtataattttgccctggttttcccatactaaagggacaaaaggggggcaacagagatgtataccatgaaaattctggagcgggagccggcgctctcccactttttaagcgcccacctgccgccccagtgggggcgggccctgtcctccgccccggcggggcgggccgatctggtggtggtctcccccgaccttatccaggtcccatccgctcccaccgcctgccgggccctgctggcgcccggttccctggcccatctggcgggagaactctccgcagcctgggtggtgagctacggcctgaccccccgggacaccctcaccttctccagcctggggcaggataccctctgcctggctctgcagcgggaactggtcaccctgtccggggactgcctggaaccccaggaatggcccctgccccggcaaagtcaagcctctcccctcttccttctggcctgcgcgggccttcagctgctgctgggggtcccgccggcggaggtccggctgggccggggatcgggggcgtctctttccacataagaaaaaagacatccgtctggatgtctttttttgcaaaaaaatcggtgagcccagaatggactcaccgtggagcgagtgacgaggctcgaactcgctacctccaccttggcaaggtggcgctctaccagatgagctacactcgcatcagcagggattataatatcatatcccggctgctctgtcaaccttaatttttcaaatttcccaaaaaatcttccacagtctggtgttcccgcgcctgccaggtgagcagaatctccgccacccgctgctggccgctgtccgggtagagcttcacctccacccccagaagggggggcagggggcgggtctgggcctggtaggcctcctggaccgcctggcgcagggtttcggcgctgtcctcctgggtaaagtagctgatccgaaagaccaccttctccggctgatcgggcagcagcgcccggagctcctgctccacggcggtgctaccggtgacggagatcacctggctgagctcctcggggtccactgcgtaggccagtttgacctccacctggtaataggagggcgtctgcttcacatcgtacttgatatagtccaccgcgtaagctcccaaggggtcctcctgggtgacctccaggcaggcctgatccacgtcgctggcggcggtgccggtgacgctgccgtactggtagagacgcacggtccccgtctcctccccctgctccaccaggtacagcagggcgctgaccaggccctggtaggtctccgcccggaggatggcgtcgttttttgactcgtcggaaaactgggtgtggggggtgacggcggtgtagctgcgctctaacagggaaccgcagcctgtcaggaggctgagggccagaagcagcgggagaagggtgtactttttcatggcggcctcctttctgggggtaccgtttccaacggtggggtatggtggggttccctgcgtcgttggaacgggcgggaacgggggcctcccaggcggggagcgttgcgggttttctccttacgccgttggaacggcagggaaccttggcttgcccagccggggccccatttcttgggaagaaatgggggaaagaaccccagagggaagaggttcttccctctggactcccttctctggtgggattatgtgggggaaggccgtacttcttacaggatacccggcctgcggccctcacagcgaaaggtccgtaacggcccgcccaccggctgggcgggctggggatgtgagagggtaccctttgggaaaaaggcagagagtaaccgttcgggttcccgctttctcctcccgtcaataaaccacttctcccgcccgcccgagctggtgggcgggccatgaggcgttggtcttggaggccgcaggccaggcccctacctgacggaaccaccttcccccggtcctcccaccagagaatggggttccaaggggaaggaacctccttccccttggtgttctttcccctatttcttcaaagaaatagggccccgcccgggagggctccgttcccgcccgttccaacggcgatgaaggcgatgaaaaagcccccctcaaatctccaacgtcatctgccggtccccctgatcctccgccttcagcagcgccccggcggcaggcagactgcgggcccggtagcgggactggttcaccaagctggtctgtcccagcggggcggcgtggtccacctggtaggatttcttcagggtcatcacctggaccccctgggtggaccgggtggttttcaccggaatgccgtcggtctggaagaggagagcccggccctcggtggagtagaggaccacgtcctcctcctgccccgccggaagggccagcacgtcctttaaggggctcttgtcagagtaggcccccgtgagcttcttccggcgggtcaccgtctggtagctggccaggggtacccgggccaccttaccgttggcaaagaagaacaggagctgcccggtatagtccccggccaggccggcccagaggatggtctccccctcctccatctccagcttggcggggagatagtcccccaggacgctggccttgctgtcgtcaaaggcatgggcgaaggccttgtagcactgctgccggttggtgaaaaagagaagctccgcagcgctggtggtctcccagtggaaggccgggccgtccccctccttgtatttctgctcccccgacatccgcagggactggggggtgatctttttgaagtatccctcccgggacaggaacaggtggaccgggtaggagggcacgtcctcctcctccggcacctcctccgccagctgatcctggaggagaatctccgtgcggcggtcctgcccgtgggctttcttcaccgcctccagctgccggatgatctccttctgaatccgggtgggcttggcgatgaggtcggccaggtcagcgatgtccttttccagctgctcggtctcggcggtgcgctttaggatatactccttgttgatgttgcgcaggcggatgtccgccacatactccgcctggaccttgtccagctggaagccctccatcaggttgggcaccaccatggcgtccttttccgtaccccggatgatggcgatggccttgtcaatgtccaggagaatggcccccagaccccggaggaggtggagcttctcctccttctgcctcagggtgaactgggccgaccgccggacgcagtcagaccgccaggcggtccaccggtccagaatctcccccacccccatgaccttgggcatgccgtccaccaaaatgttgaagttacaggcgaaggagtcctggaggggggtggtgcggaagagcttctgcatgagcttgtccgggtcggtgccccgcttcaggtcaatggccagcttcagacccgacaggtcggtctcatcccgcatgtcggccacctcccggaccttgcccagcttgatgagctcggccaccttgtccaggatggcctcggcggtggtggtgtagggaatctcataaatttcaatgaggttttcactcttcacataccgccatttggcccggaccttaaaggagccccggccggtgcggtagatgttctccatctccttccggtcgtagagcagctgtcccccggtgggaaagtccggggcccggagagtgtccagcaggtcggcctcggggtgcctgatccgggcgatggcggcctcacagacctcggtgaggttgaacccgcagaggttggaggccatgcccacggcaatgcccatgttggccgagaccagaatattgggaaaggtggtgggcagcagcaccggctcggtgagggtgccgtcgtagttgggcacaaagtccaccacgtccttgtcaatgtcccggaagagctcctcacagatcccgtccagcttgacctcggtgtaccgggaggcggcgtaggccatgtcccgggagtagaccttgccgaagttgcccttggagtccaccggcgggtggagcaaagccccatacccccgggagagacggaccatggtctcgtaaatggcaccgtccccgtgggggttgagcttcatggtggcccccaccacgttggccgacttggtgcggcccccggtgagcagcttcatctggtacatggtgtacagcagcttccggtgggagggcttaaacccgtcaatctccggaatggcccgggagatgatgacgctcatggcgtagggcatatagttgatttccagggtgtcggtgatgggctgctccagcacctcggcgtgcagccccatcaccccctcgggattgacccgtttcttaccctggtcagatgatttttttcttgccatattcctgttgttcctctgttgtagattccccctgggggggcacaccagcgggcccgcttacagggggccgtggcacttggggcactggttggcgttggcgggcaggaagaacagaatcttcccgcagtgggggcaccggccccccagggcgatgagcagcaggcccagcgccgccatggccagccccacccagagctttgtgagaatgataaagacacagccgcagccgatgatggtccagcctgtttttcttgcttgcctgtggtccatacgccagtctcctttctatcctggggcggcccggcggtcaggaaatgtccgccaggtccaaatatttatagccgttttccgcaatgtgctccttccgcccctgggcattctcccccagcagcaggtcaaagacctgggcggtggcctccgcctcggcgggcatcacccggatcaggcggcgggtgtcggggttcatggtggtcatccacatcatctccgggtcgttctcgcccaggcccttggagcgctggatgacgggctttttcccgtcgagctgggtgagaatctccgccttttccttctcggaataggcaaaccaggtttttcccccggcgttgatctcatacaggggggactcggcgatgtagacatacccctcctggatcagggtgggggtcagccgccagagcatggtgaggatgagggtacggatctgatagccgtccacgtcggcgtcggtgcagatgacaattttattccagcgaaggttggccaggttgaacagggacaggtccttgttgtgcttgtcattgacctccaccccgcagcccatgaccttgagcaggtcggtgatgatttcactcttaaaaatcttgccgtagtcggccttcaggcagttgaggatcttgccccggacgggcatgatcccctgaaactccgcgtcccggcccagcttcaccgagcccagggcggagtccccctccacgatatacagctcccggcgggccacctccttggtccggcagtccacgaacttctgcacccggttggcgatgtccaccgagccggccaggctcttgctcttgatgctcagccgggccttctccccggcctcccggctgcgcttgctcaccaggatctgccgggcggcctcctccaccgcctggggattctccagcaggaagatctgcagcttttcccgcaaaaactccgtcatgccctcctggataaagcggttgttcaccgcctttttcgtctggttctcgtaggaggtctgggtggagaagttgttggagacaaagatcagggtctcctggacgtcgggccaggtgatcttggcctcgttcttgttgtacttgttgttctgcttcagccacccgtccatggcggagaggaaggccgagcgcatggccttctccggggcgcccccgtgctccagccaggaggagttgtgatagtgctcaatgatatgatgggccgggcagaagcagaaggcgcaggagagctttaccttgtagtccggcttgtccggccggtcccgtccggtgcgctccccggtccagaattggatgggggtgtggggggcctggccggccagctcggccacatagtcggcaatgccgttttcgtaggtgaagagggtctcctcaaagccccgctccccctggttcctaaagcggaagaccacccccgcgttcaccaccgcctggcggtggaggatgtcggtgaagtagtctgtggggatgtccgtctgggtgaagacctccaggtcgggcagccaggtgatggtggtgcccgtcttcttccggtcggcgggggagaccttcatctctcccaccaggcttcccttttcaaaatgcaggtcataccgcttgccgtcccggcggaccaccacgtccataaaccgggaggcatactgggtggcgcaggcgcccaggccattcaggcccagggagtattcatagttgtccccggcggcgttgtcatacttgcccccggcgtagagctcacagaacaccagctcccagttgtattttcccaccttttcgttccagtccacagggcagccccggccaaagtcctccacctgaatccggccgtcccggaaccgggtgaggatgatctccttgccgtagccctcccgggcctcgtcgatggcgttggagaggatctcgaacaccgcgtgctcgcagccctccagcccgtccgagccgaaaatcaccccgggccgcttccgcacccggtcggccccctccagcatggagatggattcgttgccatattcccgtttgctctttgccatggaagttctccttgtcctatgaaaatgggcccatgggcccaagctcgtcatataataccctttatcttaatccatttttccgcggtatgtcaaggggaatcctggcaggccccgggggcagaaaagcagccagcctcctgggaggctggctgggataaaagggcagagggatcagtcggtcaggtaccggtggagcatcaccgcgacctgagcccgggtggtggtggacttgggggagagggtggtgccggtggtaccggtgatgatgccgtgctccaccgcccaggtcatgggggtcaccgcgtaggaacccaccttgtccttatcggtgtaggcattcaggttgcctgacacggccacattgtcccccatggtgtccgcgtagcggtagaggatggtggccagctgctcccgggtcacataggcgttggggctgaaggtggtgtccgaggtgccgttgaccacccccatcacattgccccagaccaccgcgttgtagtaataggcgcccacgtccaggtcctcaaagttggtggtgaccgtcacctcggggctgcccgctgcccggtacagaaccgtcaccagctgggcccgggtcatgggggagttgggggcgaacttggtctcctccaccccgctgaccagtccgaagtggtaggcaaagtccaccgcgtcggccgcccagaggcccaccgtggtctccgtgacatcggtaaactgctccgagtgggtcttgctggtgacatagaaggagagggtatcctccacctgcttgcccgactgggtgatcagcgtcacgggaagggtcacccggccggagaaaccggcgttcgggaggtagctcagggtggagacatggtactcgccgttgctggcggcgttggtgtagtagcgggcgccctcctcggccaccccgctgccatgggccaggtcccgcagcagctggccggcggagggcttgccaaagagcaccgcggccaccgggtcggcgtccccgctgtggaagaagtccgagccggtgaaggtatagccggtgcagtcacatgggatatcctccccgtcagggggctccacggcctgtccgctgaccaccacttccagccggccgtagtagacctggtccccataggccaggaagttgatcccataggtccccgcctggaggggggtgaaggacacgtcggccaggtgattcccgtcggcctcccggctgagatagtactccacctctcccctggccgacagggtgcctacggcagcgccggtgacggagttcatgtcaaagaccacatgggtcaggccggggatggcgggggtcagcagagagtccccatccccctggagcagctgatccaggatagactgcttgccctccagatccatgagcttgtccagggtgacgctccccttcgtcagcgcgtgggccgcccccacggtggtaccggggtagaccttgacgccatagcggcagctgccggtgagcacctgggtgctgtcggtcttgctggtggcggtgacggtacaggtcaccgtcaggtccgacagggtcacaggctggatcagctgggtgtcctgggtgcccagctccttctgggcgctgtcggtccagcggtaggagagggtgtaggcgtcggtgacatcggtggcgccgctgcggatggtgaccaccggggccttcagcaccgtatccacgtactggccgccgctggtggtcacggtggtggcggacagggagaggacatcatcggcagaggacgccccctgcttggtgacggtgagctgataggtctccatcaccggcgtgccgttcttgctgccctccttggacagggccacaatctccgctgtgccctcggacactgcggtgaccaagcccttctgggtgacggtcgccaccttggggttgtcggtggtccaggtgacggtctggtccccctgggtgccgtgggcatagaccacctccgcctccagctggcgggttttgcccacagggagggtctccggaccggcgggggtgatggtgacatcggtgacatagtcatcctccacggtgacgttgcacaccgccaggtagccgcccacggaggcggtgatggcggtggtgcccttctttttcgccgtaatggtcacgttcccctttttatgatcttggtcagagagggtggccacgctggtgtcgctggatttccaggtgatccgctggtcctgatactcgctggagcgggtggcgtggaggacaacgctctgcttgggagacagggagagctttgtctgatccagcgtcaccggttcgtcagcggccaaagcgggcacagccagactcaccgccagcaccagagccagcaggagggagagggatcggttcagggtctttttcatggcatccacctcatctgaaggatcgaaagtaagccttggcccccggaaacgaaggccaagggaaagaacaggtccattatagcatatcctgccgtttcgggaagggctttttgcaagatttccgactttttctggttttttgtcgcctggtccaaaaattcccccgcataatccccggcatatccgcgcaggctatccatatactgaaatcacagggagaccctgtctcccaaggagggattgtatggcgaaatcctcgccccccacccaggcccagtctctgcgccggcacctggaagagaccagccgggacctggccgccgcccaagcgggctttgaccagacggcggaccgggacctcttggagtactatctctatgagatcagcgccctgcgggccaagcacacctatctgctgcggcagatgaaatccttggaaacggaggccacatcatgaatctctttgccgagggcggcccctggctgaccatcctgtttttcagcgtcctgttcctggtgatcttccgacggcccctgggctggctgctgaagctcctggcccgctccgccctgggtctggggtttctggccctgtggtcccagagcggcctggccgccggtctggccctgggggtcaatgccttcaacgccctcaccctgggcctgctggggctgccagggctggggctgctctttcttttccggtgggtgggtacataatgcccggcggccccgcccaagtcccccgtcccgccaaatctccccagagaaaggtgatcctccatgcgccacagctcctatcacaccccctccctcccgtcccggatcggccgggttctgctggttctcctgtgttccgccggggtgctctccggcggttttctcctgctgtgcggcctgggggtcctctcccccgccgccatctctcagcaggtgtccgcctggctgcatccgccggcggcctccacccccgcctcggcccccgcggaggacctctccctgccggaggaaaacgaccccttccagggggttttcctttccctggaccagctggccgatgcccagaccctggccgacggctatgacggggtcattctccccatgaaaaccgccgacggcgccctgggctatgtctccgccctccccctggccgccgatgccggggcctcctccggggacccggaccgaaacgaagtcctccgcgccctgaacgacacccccggcctgtacaccgtggcccaggtctcctgccttcgggacagtgctctggtccgggaggaacccggtctctccctgcaccgggtcagcggctccccctggctggacgaaagccgccagggctggctggaccccgcccagccccaggtccaatcctacctcatcggcctgtgccgggagctggcccagctgggctttgacgagatcctgctcaccgactgcggtttccccacccagggagacctggactccctccgcgccgtggaagagaaggaggaaaccctggagaccttctgccgccagctccagggcgccctggctgacacgcctgtcaccctgtcggtgatgggacagcgggacagcgtcaccgccgatcccgtcagcggccagaccaccgccctgctggccaccttcggccgggtgtggacccaggccgaggaccaggaggccctggcggcgtttgacccggtggtgctgccggcagtctcataaagatgcgtcctttttgcaataagcgcctgcccagttttggggaggcgcttataacttgtccaatttaattgacaatagttagagcatttttatatactgtttatagtgccaatagtgccaaacaaactgaaaaggaggctcccatgaaaaaacaactctgcacactctgcctggctctgctgcttctgatccctggcgccggtacattctgctccgcggccgaggcggagcggacatatacctgctctgactgggcggaaacggatgtcttttccgccctgtactatggattggcccgggcaccctacggcggggattaccgccagcccattcagcggcaggcctttggggagaacgccgccgccctggtggcccggacatacggtacggacctggacctctacctcaatgtaaccagcttccggctccagaaagcctccggctgggggaccgtaggactgtacgaccccgtgctggcggtggccaaagagctggggattctgcagggccgggaagacggcagcttagacggtgccaccctcataacacgtcaggaagctgccgtgattttggcccgcacctatcgggcctgcatgggaaaggtgtccgatgccctgtcccctctgtcctacgacgacagcgcgcagattgcatcctgggcccaagaggacgttcagctaatgacccagctgggaatcctgcagggggttggggacaaccgctttcatccccagggcagctacaccgtcgaacagtgtttttcctccctggtccgtttgctgcagaagatcacaccctatccagggcccagcccctttgccatgacgcaggaagaagctgtcatcggcggtttctgcggaagccgggagatggttgcctatgcggacactgaaaacacagcgcaggtaacggcagcagcttgggccgctggaaagggtaccctgtcaggtgcaaaatattacatctctgtctttgaccaagacctgaaacgaacagattatcgggaagtgatcaaaggcagttcagacgggcggtacggcgtacatgacgcccatttggagaacctgtccctctctcccgacggaagtcaggtcttttaccaggccaaggtagaacaggatgtctacgattttgacagcaacggcaaccaaggggacttgctgttctcacaagggctgtactcggtcaccttggatctggccacaggagaacagacctatacccgggcagagctgcccagtgcttgacttttcctatttcgcgaacggcctgccgcaggatgtgcggcaggccgtttgttgtcgggggctggcagggtccggcccttggtttcgggggagggagccattggggtgtttgcccggcgccgttggaacggcggggaacggagccctcccgggcggggccctatttctttgaagaaataggggaaagaacaccaaggggaaggaggttccttccccttggaaccccattctctggtgggaggaccgggggaaggtggttccgtcaggtaggggcctggcctgcggcctccaagaccaacgcctcatggcccgcccaccagctcgggcgggcgggagaggtggttcgttgacgggaggaaaaagtgggaaacggaatggtttttctcctccttttctcaaagggtaccttcccacgtccccagcccgcccagccggtgggcgggccgttacggacctttcactgtgagggccgcaggccaggtatcccgtaagaggtacagcctccccccacacaaccccaccagagaagggagtccagagggaagaacctcttccctctggggttttttcccccatttcttcccaagaaatggggccccggctgggcaagccaccgttcccgcccgttccaacggcgtggggataaaacccaaaacacccgcccgagagagtccaaccctcccggacgggtgccaacccagcaaggtcagtggataaacatccgaatgagcttgccgttaaacttcttataggggtgataccgcatgggcagatccagccaggtggccttgtccacgatggcccggtagtgggagaaggtgtcgaagctccgcttgccgtggtagcttcccatgccgctctgccccacgccgccgaagcccatgtggtgggtggccaggtggatgatggtgtcgttgatgcacccgcccccgaaggaacagctgcgcagaatccgctccttaatccgctggctccgggtgaagagatagagggccaggggcttttcccggcggttgatgaagtggatggcctggtccagaccgtcataggggatgatgggcagaatgggcccgaaaatctcctcccccatgggcttggaagtcccgtccagggtatccgccaccaaggtgggggcaatccatccgctgtccgagtcggggtcgtcccggtggccgccgccgtacaggatctcctccccctccagtaggccctggagacggttatagtgcttgcggttgatgatccgcacaaagtggtcgttggccagagggtcctggcccagcatccgctggaactgctttttcagctcctccaccagttcgtcccggacctttcggtccaccaggcagtagtccggggccacacaggtctggccagcgttgaggagtttgccgaacgccaggcgcttggcggtgagagggatgttggcggtgcgatccacaataaccgggctcttcccccccagctccagggtcaccggggtcaggtggcggctggccttctccatgaccattttgcccacatccacgctgccggtgaagaaaatgtagtcaaaccgctgctccagcagggcggcgttctgttcccggccgccctcgatgacagtcacccagtcggggttaaagacagcggcgatgagctcggccatggcccggctggtgttgggggcgtaggcgctgggcttgagaaccacgcagttgcccgcggccaccgcgccgaagagggggtccaggctcagcagatagggatagttccagggggacatcaccagcaccaccccatagggctcggccagctcatagcttttggatttgaactgggccaggggggtgggacgccggcgggggcgggaccactcggccacatgccgggccaggtagcccagctcgtccaggttcagtcccagctcacacatatacccctcaaagtgggacttgtgcaggtcggcctggagggcgtccaacaaaatctgctcccgggcctgaatctcttttttcagccgcttcagggcggccacccggaccgccaccggacgggtggcgccggtctggaagaaggcccgctgccgggccacggtctcctcaatcttggcaacgtgggtggcgttactcatgcccacacctccttaagaattcccaggatctcgtcgtagtctgcctcggcggggttcacaataatggccccgtcgttcagcgccgtgcgggccacggcttcgaagtcctcctgcttcacccgcccggtctgggacagggtggtgggcaggccggtggcgtcagccagctcctggcgcagggctttcagggtgtcgatggtcttttgagcccgctgggccgccggggtggcggcgtagacctcggggccggccacgtggagcagcagctccccatatctctcccggcatttgtccaggttgtactgcatcaccgccggcagcagaatggtcatggcgtccccatgggccacatggcacaccccgcccagggcgtggccgatggcgtggaccagacccaccatggagttggaaaaggccgccccggccagcaggctgccgttggccatggccatgcgggcccgccggtccctgccgtttttcaccgcccggggcaggctctgggtgatctggcggatagcccgctcggcaaaggagtcgctcaccgggttgcgctggagacaggtggccgcctcaatggcgtggaccagggcgtcaaagcccgtggaggcggtgatccgggggggcagggtctcggtcatccgggggtccagcaccgccacgtcggggagcagatgatagctgagaaactccattttcacctggagcgccgggttggccaccacggccaccaaggtggcctcgctgccggtgcccgcggtggtgggcaccgccacaaaggggacatgggccccccgggggaggacctcgcagccggcggaatccagcaggtcgctgcccgcctgggccaggaccatccccacccctttggcggtgtcaatcaccgatccgccccccacggcgatgaggctgtcgcactgggcctggcggtagaggccggcgatctggttgaccacctggatggaggagtccgggggaatccggcagaaggtctccgccgccgccatccccccctggcggagggcggcctgcacaatctttaccgtccccacctgctccaggccctggtcgctgagcaggagggggcggtgggcccccaggctgtccagctcgtgggggatgtgctccagggccccgtccccggagagaattttggcgggcagtttgaactcatagtaggcggacattcacattacctcccaaacagcaccgccaggtagacccgggcggtggatatttccttttttggtcgtcgcttcaggattcgcctggccagaaccgcggggaaaagatacccctccgcaatgtccacacatcgcacaaagggcatggccaggcccatgtttccccgcagggtaaatcggtgctgggcgtacgcctgggcgatgccgatctgcccggtgaagacccggaaggcgtcatccggactcttaaagcgaatggttacatccccgggggtgtcctgggggagcttccggaagcccttctccgtgccggtgacggtgaaccccctggcgccggggatctccagccgcagggtcttcccctggggccaccggcaggcctcctccttgacccggctgtcccggcaggacaaaaacttcagcgcccggaacaggcaggtggagaccatgctgcaggtggcgcactgcaggcacattttcacggacccataggccatcgttccatccctcctctgggtgatattctccgtttagcatactccaaacggggtatgattgcaaggttttccacggcgggaaagggctttcggcaaggcaacatccccctccgtgccgggaaatgggccggagggggatgccagtgcagaaaactcattgttccgcgcggtttctgttctgcaggagcagaccgagggcaagtccgagaaaaatcccggaaaaggccatgttgacaaggagtcatcctcgactggaatgaccacatttcctctctcgtcgatgaagccccacagcccctccttcgatactttaatcaaaccgttttcccagtgccagacatcatcataggccatctggcagggcacttgtatggcggccttccgtaaattcatcggcttcttactcctttgcccggtggagcagcgcctgctgatagctccccatcaagccgtaatagttgagcagatcgggaaactggttggatggatgccaatagtccaaaacgatggcggcgtggccgtttatctgcaccgtgtaaaacaagttgctgttttgctgttcggcgttggcatactccttgacaggcgtttccatgatgatattcagggcagaaattgtatagccgcagacgatgacggtcgggtcgattagttcaatctcacggcgaagctcccggcggtcatattccgcataccgctgaatttccttataatccgagactttctccccaccacttttcttgacgttgaccacggcggcctgacgcagatagggatttccgaaaacgtggtccgcggcttcatcggcataggggtataagcagtcttccgtggtcagcatcagcccccgggtccactgagaaattcgtttccaagtggtatgccttccaatttttccctcagtcaagagatggtccgctatcaaatcccaatcgccatcgccgtgatacgcctctttcaataaaaacaggggtcgtaccgtttgggaaaaccaccgctcgggacagacaacgccgtcccgaataaagatgccatgctgatggtccatcccgtcaagggggttcttctctttccatgtgcggaacaacatttccacttcccgccggtatgcttctgcccgatccatgctatccctcctgctcctcttttagacatctccccataggacggattccccaacgcgcaacttccagcccttcaacgccgtgtcgtattcaacccattctcccgaaatacggcgcgcctccagaaataggaacttatcattctgtagcggcaacagtatggtatcggataccctcaattatattttggtttttagaaaacgcaagagcggtactgatgagcagagcgttctctttcttactgacagcccccgacccaagaggcgtccctttccttggcaaaggaccgggcacagacaaagcccccgctggtgtaaattctaaccagcgggggcgctctgcgcggtcggacccgtcaacctgcctgttcccaggggcggggatttggtgttactgcacgtacgcctggatcacctgggcggccacggtgcccagggaggagccggacccgccctgctccaccaccacggccagggcgatctccgggtcctcgtagggggcaaagcacaccagcaccgcgttggaggtctcctccccgtccacttgggccgacccggtcttggcccccacctggaccgggagggactggaaggccgcggccagggagccggactgggtcaccgccagcatcccctccttgatggccgccacattgccgggggacaggttgaccttgcccaagcgtaccttttcccggggggcctccccggccaccttctggagcaggtggacctgccaccggtccccaccccccaccagagtggccaccatgtgggccagctggaggggggtgaagcggttgttctcctggccgatggccgcggagaggacgctgccctcataccaggtgccccccaccgaagccgtatactccgggccggccaccaccccggcctgctctccggccagctcgatgccggtcttttcccccaggcccagggcccgggcatactgccccagcatgtcaatgcccacccgccggccggcgtcgtaaaagaagatgttgcaggagtcggcaatggcctcggacaccgtctccaggccatgggtcttgccctcctgccggtagagccagcactggggctgggggctcttgtagtaggtatagcggccggtgtctaaaatctgggtctcaggggtgagaaatccctcctccaaggccgcggcggcggtgaccagcttaaaagtggaccccggggcatagagcccctgcaccgcccggttcatcagggggtgggcctcgtcctgggacagggccgcatagtcggcggagaaggaggccgcgtcataccccggctggctcaccatggccagcaccccgccgtcccggacatccagggccaccagggccccgccggtggcctggggatggcggtccaagaagccggccagggccgtctccgccgcggcctggaggtcccggtccagggtcagggtcacatcccgccccgcctggggctgcaccgcgttggtctccccggtgatccggccgtccttgtcggtctccagcaccttctggcccggggtgccgtggaggtaggactcaaaggccccctccgccccgtccttgcccacggtttcatccatggcgtatccccggtcctggtagacctcccactcctcagggctcatctgtcccacccggcccagaacgtggggggccagggtgccgctgcccacccgctggaccgcaggggtgaagctcacccctgccagcccctcctccttcacccgggccagcagacggggggtaaccccggcaatggggccggtcccctcccaggccacgtcctcctcctggcagagagttttcaaacggcggaccacctggtcctccacgtcctccgccagaaccgccgaccaggtcacctgatcctgggccagaatggttccgttgcggtccaggagcttgccccgggcggcggggacggtttccacttgggcaatgcttcgctgggatttggcatagtaggccgcgccgctggtgacttgcaggccccagagcaggacagcaaaggccgtgagggcagcggcaaaaaaagcggcggcggcgggaaggcggcggttgggcatggtggtcctcctttccaaacaaagggcgccctcccggcctgtgatccaggaggggcctgtcataaaacagtgtttttccgggccggctcaccagcccttcctcttcctgcggggatgccctttgagccgggtcaggagcacagccagggggaagcaggccgcagacaggaggagctccggcccggcaatgcgcagccccgcgaatacagaggccccggccaggcagtgccccagcaccagcaggacctccagccccgccagcgcggccagacaggtgagccactttccccaaaaggaactggctttgtggaaaatgaccccggacagcccccccaatagggccagcagggccatctgccagggggtggcgccggccagatagcaaagaattcccccaaaaaatccacattccgccccccggtccgggccctgctccacccccaccagacacaccagcgggggaagcaccctgggccgaaccccggccacgggaaaccagagcaggaccagcacctccaggaggaaggccagggcggtgatgaggtagagacgaaggcggcccattcagcgctcctcccagaaggctgtcaccacgaacacctgggacagcgtattcaggtccgcggccggggtgaggatggccgagcgggtgaggccgccggggtcctcctccagggacatcaccgtgcccaccaccagccccgagggatacaccccctgggccgcgaaggtgaccacctcctcccccagggagacggggtcggcctccgtcaggcaggccagggccagctctccccgggacagcaggtccaaggacccctccagggagcccagcaccccggacttggtcccctggccggccatctggaagccagggtcccacagcagggtcacattggcccagctggcccccacctccttcacccggcccaccagggccccgtgctcatccaccacgcactggccggcctgaatcccctggtcggttccctggtccagggtgacctcccccttccagttgtccggggcccgggccaccacccaggcggcggtgaaggtgaggtcctgcccggtctcctggagctccagcagggaccggagccgggcgttctcctctgtggccaggtcccccgcccgggcggcccgccggagctgggccacctcctgctccagggccctgttctcctcctgcagggcctggacccccttgagatagtccccgccctggcggagtttgtccgtaaccagggaaaaaaagcgcgaaaagggccgtgacacggtctcccccaccccccgcagcggctcggtggtccccgtcaggaccagtgccacagcggcggcgatgaggctcagagacagagccacggcgatgatttttacccatgtatgctgcatccatcgtttcacggcaggtcctctcctgttcccgggcgggccgggacgccggagtccatcccccaggtcagcggccagccagtgccagacagtccacgccgaagtccaggagcatccgccccaagcggcagaccggcaggcccaccacattgtggtagtccccctgaatccccgccaccagcagcccgcccaggccctggatgccgtaggcgccggccttgtccatgggctccccggtggagacatactggcggatctcctggtctgtcaagggccggaaggtcacctgggtctcctccacctgggtgaggaccttgtccccccggcagaccgtgaccccggtgcaaacctggtgggtgcgcccggacagggaggccagcatggcgcgggcctcctcctcccctttgggctttcccaggatttccccgtcccggaccaccacggtgtccgccccgatgaccagggtctccgggtccacctgcccggcgatccagcgggccttctcccgggagagaatctgcaccaggtcccgggcatcccggccctggaacgcggcttcgtcaatctccggcgattgtgtggtaaattccagtcccatctgccccagcagctgacggcggcggggggattgggacgctaagactattttcatgggttgcctccgttttttccatcgaatttgggtggtttgcaaaaatttcttccccctgtcctcctcatgtcccctggacagagggggcctggcccacggtgatatctacgctgcccaccgcgccctggccggtgacggccacggtgtagagtccggcctcctccacctccacagtgaagtcctgagtggtcaggccctctccttcatagatgggttcctcctcccccttccagatggtgatggacagggtccccgcctggctgaccagggagagggcaatctcctctccggccttcagggacagggtctgcttctccgtggtgtgaaaggcggtgtacgacatgtgaagtccccggggggtgcccatgcggctgccgctgaaatccggctggcaggcggtgagagggagcaggagcaggcacaataggattgggaagagggacttcatgatatgcgatctcctttcgtggggggcgttccatcgccagcgccgttggaatgggcgggaacggagccctcccgggcggggccccatttctttgaagaaataggggaaagaacaccaaggggaaggaggttccttccccttggaaccccattctctggtgggaggaacgggggaaggtggttggtcatgtaggggcctggcctgcggcctcaaagaccaacgcctcatggcccgcccaccggcttgggcgggcgggaaaagtggtttattgacgggaggagaaagtgggaaaccgaacggttactctctgctttctcccaaagggtacctacccacgcccccagcccgcccagccggtgggcgggccgttacgggccttccaatgtgagggccgcaggccgggtatcccgtaagaagtacagcctccccccacacaaccccaccagagaagggggtcctgggggaggaacctcctcccccgggggttctttcccccatttcttcccaagaaatggggccccggccgggcaggccaaggttccctgccgttccaacggcgaccgaaaggaacgcctcccccaccggagagatactcctactccacccctcgatagtaaagcccccgggtaaaggcccgcggcggctcccccgccccctcccggtaggcccgaaacacccgggcgcattccccgggaccctcccgcaggaaggccagccgggcataggccgccccggcggtccgccagtcggtcttgtccgccagccacaggggcttggcgttgaagagctcattgcggcagccccaggccgactccacggggaagtgttcccccttccggtcccccagggactgaggcttgtcctggcagtggcagccctgcccccggtttcggaggatgcagtgctccatgagcatcaaaggcagccggccatagaccagcagctccaggtccaggggcttgctcaggtcccgaatctgggccaaacggctctcaaaggacgcagtggccgaggcaaaccccagccgggccagctccgccgccgtctcgtcgttggtcaggcccagcccaaagtctccccggggaatcagtccaaaggagcgagccaggggaagctgtccgatgtgccccagcagggcctgggtgacccctgcctggcgggcggcttccagctctctccgcagccggggcagctcccggtcccagaccacccggggcagaacaaccccaaacccgatgtctggatacgcctgggcccaccggcgcagggcgtcctcatggcccgggagctcctggcagggcagatagaccagggcggggccctggtccaggcagtccggcgtcagctgctcccaccggcggaaggacagggtaaacgccggcacacccgcccgccctctctccggggcggccggaacaaagggaagggtccgccgggcagggggctgggtgcgggcccggtccagttcctccaaggcctggcggcgcaggctgttcaccgccgacagggggaccgacaggccgggggccaggtccacttggacctggtgcgcctggtagacggtgcccccggtctttctcagctggccggccacctggtctgccgtggtctggcgggtgcgggcggcctggggacaggggccctggacgacagcggtatggcccgccgggtcccgggcggtgagaaccatgggcatctccccctggacctgggcggtgagagacacgggaaccgtccggtgctctccccgggtgtagaaccgccgggcctggtcaaagaggtccgccgggtcccgggccccctggggacgggtgccgaacatggccggacccttctggtcccggaaatacccctgggtaaagccctggcgggagaaggcggcctccagctgagccagctccgcctgggtgggctcccgcccctggcgcagggcggcggcgtagatgccggtgaccacagccacgtactccgggcgcttcatccggccctcaatcttcaggcaggccactcccatctcctccagctgacccagggccccggccagggagaggtccttcagggacagagggtgggagggggttttctcccccggccaccggaaggccaggcggcagggctgggcgcacaggccccggttgccgctgcgtccccccagcacggcggagagaaagcactggccgctgtaacacatgcacagcgccccatggccgaaaacctccagctccacgggggagcgggcgcacaggtccgcgatggcatcggcggacagctcccgggacaacaccacccgggtcatgcccaggtcggcgcaggcccggaccccgtccaggctgtggacggtcatctgggtggaggcgtggaggggcaggtctggacaggtccgccggagtaggcgggccacccccaggtcctgcaccagaaccgcgtcaatccccaggtccgaggcccaggctccggtctccgcggccaggggcaactcccggttggtcagcagggtgttgagggtgaggtagaccttcaccccccgcagatggcagtaggccaccccggcctccagctcctcccgggtgaaattcttcgcgttccggcgggcgttcaggggcccaaaccccagatacaccgcgtccgccccggcctggaccgcggccgtcagggcctccggggagccggcgggggccaggagctccatcaggtctcctcctgtcgggggccctgtttgggggccttggtccccttctccccccgggcggctttgcgggcctcccgcttggcctcggccagctcccgggccaggcgggtgttctcgtccagggcctgcttcagctgggcccggagattgtcggacacctggcgctccttacagtacttatccgccacgttcatggccgccagcaccgcaccgtcggtgatggagagggtgttgcccgccatggcctggtccatttctttgttgacgatgtccgcgcactgctggaggtaggtctcctcctcctcggccaaaaagcggtagctctggtggtgaatataaatggtcactggatttgccatagggattcctccgtttccaggttgggttttctttggaataggatattataccacggttcgacaaaaaaggatagacccccacccaccgggggcgagacaccggggtgaaaaaagttacacctttacgaaccgggaaatttcttgtaaaataaagtgttatcgtatgattctatccccacgaaaggaggcggccccatggcaaaggacttgctgctgcccggaagtatcctctctcttcaccggtccgcggtggaaaaactcctgaaagcgggcaacggcgacgccgccctgctgtatctctgcctcaccgccggccagaacagcggggccctgccctggggaccggaccaggtggaggcggcccaaaacaccctgctccggctgggcctcatctcctcggacaccccggttcagcccccccggccggaaaagctggaggacgaccggcccccggactacaccacccaggacatcgcccaggccttccagaacgacgggggcttcaaggccctggtgccggcggtggagcagatgctggggaaggtcctctcccccgccgacctcaagattctctacaccctctttgactttctggccctgcccccggaggtcatcctcaccctcaccggctggtgcgtggagcaggccaagcagaaggggcccggccgcaagcccaccctcacccagatccgccgggaggcctacaaatggcagaaggccggcattgacaccctggaggccgccgacgcccatctgcaccggctgagccggcgcaaccgccgggggacggagatcctccagctcctcttcggggagagccgggcgccggtggagaaggaggcggaatttttggacgcctggattcagatgggctgctccgacgagctgctgctgctggcccgggaccggaccatcttccagcttcaggagttcaagtggacctatatgaacggcattctcacccgctggtacaaggagggcctgaccaccgtggaggccgtggaggccagcgagcgcaaaaaccgccggccccagtacccccgggccaccccccagccggcccaggggacccagccgctgccctcggatgacatcggccggatgatcgaacaggcccgccgggccgcagccgcgaaggagggctgacccatggcatacagcgcatccattctcacccgggccgaggcccggctcaagcaggcccagcgggcccaccagctggaccaggcccgccgccgggcggagatctaccgggccctgccccgcaccgcggagattgaccgccagctgcggcagaccgccccccggattctggccgccgccctccgccaggggttgggccaggaagaggctctggccgccctgcgccgggagaatctggccctccaggacgaggaggccgctctgctggaccaggccggttacccccccgacgccttggaggagaccccttactgtcccctgtgcaacgaccggggctggcggggcgcggccatgtgcgactgcctgaaggacctgtgccgccaggagcagatcgcggagctctcctccctgctggacctgggggatcagtccttcgacaccttccgcctggactactacgaccggcagacctggccggagttccaccgctctccccgggagaacatggagtttatcctctcctcctgccgcagctatgcggagaactttgacgcctatccccacaaaaacctctttttcaacggcccccccggcctgggaaagaccttcctctcggcctgcatcgcccgggtggtgtcggaacaggggtatgccgtggtttacgacaccgcggccaacatcctctcccggtttgaaacccggaaatttgcccggtatggggaggagagccgccaggcggaggcggacacccgccggtatctcacctgtgacctgctgatcttagacgatctgggcagcgagttcacctctccctttgtccaggcggccctgtatgaactcatcaacacccggctgattgaggggaagcggacggtgatctcctccaacctgaacctggaaggggtgcggcagcggtattccccccaggtggcctcccggctggagggggagtatttgctgatggcattctttgggcaggatattcggctgctgaagaagcagcggtgaggggggtgtccctgcgctcttttctatcgccgttggaacgggcgggaacggtgccctcccgggcggggccctatttctttgaagaaataggggaaagaacaccaaggggaaggaggttccttccccttggaaccccattctctggtgggaggaatgggggaaggtagttggtcaaattggggcctggcctgcggcctcaaagaccaacgcctcatggcccgcccaccagctcgggcgggcgggagaagtggtttattaacagcaggaaaaagcggaaaatcgaacggttactctctgccttttcccaaagggtacctacccacgtccccagcccgcccagccggtgggcgggccgttaccagcgtgacaaggagagggccgcaggccaggtactaagaaagaagtacagcctccccccacaccatcccaccagagaagggagtccagagggaagaacctcttccctctggggttctttcccccatttcttcccaagaaatggggccccggctgggcaagccaaggttccttgccgttccaacggcgccgggggaaaacccaccaccgcctcccccggcaaacccgccgcaaaatcaaaccccctgtgcaggaatccaaacctacacagggggtttcatcatcgcaacggtctgaagggcccgcaccaccgccccgggcctgtccttgttcaccgcatgcccagcgccggcggcctgctcataccgcccatggggaagccgccgggcaatctcccgggccgcgctttggttgacccggtccttctctccacacagtaccagggtcggctgacagaccgcgtccagggtaggggtgaggtccagcgccagcatggaacgggtgagggagaggacttggtccttccccatgccctggcccgcaaaggcccgggccggaagcaggcggaaaaccccgttttgaagccgcagcagcccccggggcatcctgacccggggggcaatcagcaccagggccgacacctgtcggggatgacgccaggcatagtccagggcgagaatggcccccagggagcacccgcacaggaccatggcctcttcccgcccagcacactgggcttccagaccctccaacaagctctcataggtaacgggccggcccgcccaccaggcggccaggtccgggcagagaatcttctgtccagggagaccggcctccacagcggcccagtcagctgggctctgccccagtccgtggaggaggcagtattccactgccttacgcctccagcaccagcgcccggtacgcctcggcggtccgcacctggcccacagcggagagggagacctgatcccagcggaaaatctcctgggccagagccaccacatcctcgtgggtgacgctgtcataggcggcgatgatctgctctggggtgaggatttccccggaaaagaggagggagcggccggcgtggctcatccgggactgggtggactccagacccatgaccacattggccttggactgttcccgggcccgctccagctcctcggaggtgggcccctcccgacgcagctggtccaccacctggcggatggtggccagggccttggcctcggtctccttgttcagggcggtgtagatgcagaacaccccggtgtccgcgtggcccgccccataggagtaaatggtatagcacagcccctggcgctcccgcacctgttggaacagtcgggaggagacacccccgcccagaatggaggagagcagctggagggcaaaccgcttgggggagttgtagtccagacccgggaaggccagggtcaggtgattctgttcaatgggcttggacgtgaccacgaacgcaggggtatacaccgccggaaccacaggctggggcgccccggcgggcagggcggcaaaccgccggcgaagctcgtccagaatttcctgggaaaagctccccgacagggccaccaccgtgttgtccccccgatagtgggtcctgtggtattcccggaggaactcccccgtcatgggggccagggtctccgccgaccctaagatgggccgggccagggcgctgccctggaacaccgccccgaagagcttctccgcgcacaggtcgtcgggggtgtcctcatacatgtcgatctcctccaggatgaccccccgttcggtctccaccgcctcctgggcaaaggaggagtgatagaccatgtcgaagaggatatccagggcctggggcaaatggctgtccagcacccggccgtagaagcaggtacactccttggtggtaaaggcgttcatctggccgccgatggcgtcggtttcccgggcaatgtcctgggcggaacggcgctgggtccctttgaagagcatgtgctcaataaaatgcgccgcgccggactccgacggggcctcctcccgggagccgccgcccacccaaatgcccagggcggcggagcggacggtatccatgggctctgtgacaatgcggactccgttggggagggtttcgatttgaaccatagatggcctccttgtgttggttgtggtgaggggggctcccctgtgtgcttccacgccgttggaacgggcggggaaccttggcctgcccggccgggaacccgcctccccctttaccgcttcttctccatcgtcgtccccagagacttctcagaaatcgcctccagaagaatagcgtgctccatccggccgtccagcaccgtcaccgagcccaccccgtgctccaccgcgtggatgcagttgagggtcttgggaatcatacctccggcgatcaggccgctgtccatgagctccttggcccggctcacatccattttggcgatgcgggtggactggttgtggctgtccaccagaattccatcggtgtccgtgaggaagatgagcttgtccgcccccaccgcctcggccaccgcccgggcggcgtcgtcggcgttgcagttgagggctcccccatcctctccccggctcaccggggagaccaccgggaggaagcccccctccagcagggtacgcagaacccgggggtccaccttggtgatggtccccaccaggcccagggccttgtccttctgccgggcggtgatgaggcccccgtcccggccggagatgccacaggccttggcgccgatccggtccagagcagccacaatggacttgttcacccgggcagacagggccatctccgctgtctccagcaccgtctggtcggtgacccggtagccgttttcaaagtgggtctccacctgcagccgctccagcagggcggagatctccttgccgccgccgtggaccagaatcacccgcacccccacggactggagggcggcggcgtcctccaaaatggtgtcggtggaggccgcgtccagggcggagccgccgtacttgatcacaatggtgcgcccctcataccggcgcagcagcgggagcacatccagcagggcccggactttgctcatcccatccatgccgtgctggacatcgtactcatggagatattccttggcatagtctacgtcggaagggcagtcaatatactcgatgcctcgcttctgccgggtctcggcccccttgccggtgaggaggatcaccgtgggcacctggcagcccatcaccgcctggcggacggcctctccccggtcggggacgatggagtagtcacagcccccctgctccacatactgggcgatgtcccggcagatctcctccaccggctcctccccggcgtcctcttcggtgaggatgaccaggtcggaatactggccggaaatctcccccaagtccttccggcggtcataggccttgtagcccgggcagccgaagacggtgacgatccgccggccggggtattcctcccggaccgactggaagagggtctcaaaggacagccggttgtgggcatagtccacgatgacagtgaccttttcatcggcgttggcgtagacctccatccgtccggggacccgggccttcatcagacccgcgaaggcgtactgctccggcacccccaccgcctcgcacaccgccagggcggccagggcgttctggacattgaacaggccgggcatggtcagccggaactcccggctgtaccggggggtcttgacccggaaaaggatgtctccccccactttgcggacctgggagccgaagatggtggccgaagggtccttctgggagaaggtaatcattctcgggcagctcttccgggccgcctccagcacccggtcggcgtggtcgcagtccaggttcacgcaggccgcggcggcctgggaaaaaatccgcagcttggaggcaaaatagtcctcgaaatccgggtgctcaatgggagagatgtggtccatgccgatgttcaggaagaccgcggcggcaaactccacgtttttcacccggtcatacttcagcgcctggctggagacctccatggtgaggtaccgcatgccggtggccaccccgttggcaaagtggcgctccaagtccaggggctccggggtggtcaggtgggactcaaacttctccaccccgtcataggtctcaatggaggagatcaccccgctggcgggctggcccttggcggccaggtactcgtcaaagatatactttaagtagtaggccgtggaggattttcccttggttccggtgatgcccaccacccccagcttggccgaggggtggttatagtaaaagtccgccagcagggccatggccagacgcacgtcactgaccaggatgcaaggcaggtccacctggtcatagcgcttttccgacaggtaggcgaaggccccctgctccttggcggactgcaaaaactccaccttgaagtgggcccccttgcagatgaacagggtgccgggcaccacctgccgggagtcgcagctgaccagggagacctcccgggtcagaggggccccggagaactccagctggaggtttttcctttgcagcaactgaatgtaatcccccaagggatagagggtgagactcataatcatattcctttctactggaaggttgggcacggggcggcgtctttgcgcggccccttctctttatacgtttcgcagggccttgccgcagcggaggatggcctgctcggccagaatctccatggcgtcaatgtaataagggggcaggctgtggaggctgcggtacaccgacagctccgtgcagcccaggatggcgcagtcacagccggcctggcggagataggcgtcaatctccccaaacttctcccgggagccggtctccccctttttgatctcatcgtaaataatggacatgaccaccctttgcagctgtgccggcagggtcaccggggtgaggccggcggcctccagcgcctgctggtaaatccccgtccggacggtgccgtcggtggccaggatgcccacggtggttttccccatggcccgaatggcggacaccgtctcccggatcatgtggatgagagggatatgcagctctccctggagccggtcggcaaagtaatgggaggtgttgcaggggatggccagcaccgtgcagcccgccctctccaggagcttggcgtccgccagcagatgctggtagacggcctccgcctggtctggggtgcccaggatgccggcggtgcggtcgggaatcttcgcatcgctccagatgagcacccgcaggtgctcctggtcggactcggcctgggtgcggtcgatgatccgctggtaaaaggtattggtggcctgggggcccataccgcccaggacgcctaagatgccttcttggtgcataggggtacctcctttgtctgccggagcattttggttttttccttacgccgttggaacgggcgggaacttggccctcccgggcggggccctatttctttgaagaaataggggaaagaacaccaaggggaaggaggttccttccccttggaaccccattctctggtgagaggaacgggggaaggtggttccgtcaagtaggggcctggcctgcggcctcaaagaccaacgcctcatggcccgcccaccggctcgggcgggcgggagaagtggtttgttgacgggaagagaaagcgggaaaccgaacggttcctctctgccttttcccaaagggtacccacccacgtccccagcccgcccagccggtgggcgggccgttacgggcctttcgctgtgagggccgcaggccaggtactaaggcagaagtacagcgtctgaccacttctcaccagagaagggagtccagagggaagaacctcttccctctggggttctttcccccatttcttctcaagaaatggggccccggctgggcaagccagggttccctgccgttccaacggcgtgggaagaaacccaacaccccccggccaggcatgccgctctcctcagctcttgcgctgataataccgcttaaacttctgaaaatgccccagcaggttcttctccatccgcagcgtccgcagcagcggccggtccttgtggtaaaacaggggccggacctctctcccctgccgcatcaggtccttcatctcctggtggtagtcggagacaatgtagcggaaggccacctttcggggcaccacccgccacaggctggggttgtccgccaggacgaaggggaggtccttcccctccacccggtcctccaccaggagcttggcgatgttataccccgccccggtgacgtagtagttgctccgcccttggcggcagttgatctcaaagaccttgtacttgccgtcccgctggtcatacttgatgtcaaagttggagaagcccacatagccgatgtcctccaaaaaggcccggatcttctccgcgatctccccgcagggctcggtgaggatcaccgcgtggttgccgatgccgtggggggtgtgctcctccaggagcacatggcccatgcacatgagcttgactttgccgttgcggtcggaatagttggtgagcacccgcatgtagctgtcgtccccggggatgaagtcctggataatcatggtgtctggataaccagcggcatagaccttgtccagcacctcctccaggctcttccggtcggggcaggtgaacaccttttcattccccgggaaagggtgctcccaataggccaccccgttggcgggcttgcagatgtaggggggctggaagtccaaggtaaagtcgtggcccatctcccggcggtagatgaaggtgccggggtggtcgatgccgtactggtcgcacagctcgtaaaaggtctgcttgttgataagggtgttgatgagcgccccgctcaccgtggcggccacgcagttgggggggaaggtatccttgttctccgccgccagctttacatagctgtccccgcagccgatgaccagcacggtcttgccggcaaactccgcggccacgtcggccacattcttgcgaaatgtggccgcgtcctcgttctgggggcagacccggtaatccaggatggtggagccataggccggtccggaggcaaacttgccgaagcacacggatttcaccccgtaggcctcatggaaggcccgggccacgctgtaaacattgatgtccccgccgaagaggaggggctggaagttgtgttccatagctatatacgcttcctttattttcccgggaaagaaaggagccgggcggctcctctttttgttcccgtttttggatggatttatacggcaaggggtgcttggtgcaggggcccgcgccgttggaacgggcgggacggtgctctcccgggcggggggtgttgcgggttttctccttacgccgttggaacggcagggaaccttggcctgcccggccggggccccatttcttgggaagaaatgggggaaagaacccccgggggaggaggttcctcccccgggacccccttctctggtggggttgtgtggggggaggctgtacttctttcttggtacctggcctgcggcctccaagaccaacgcctcatggcccgcccaccggctcgggcgggcgggagaagtggttcgttgacgggaggaaaaagtgggaacccgcaagtatactctcttccttctcccaaagggtacccctccacgtccccagcccgcccagctggtgggcgggccgttacgggcctttcaatgtgaaggccgcaggccaggtacgccgatagaagaagatcgccgctcctactccagcccggagaaaaggggtgtgggggaaagaaactctttcccccgcgggggtccaggggcacagcccctggtgttctttcccctatttcttcaaagaaatagggccccgcccgggagggcaaagttcccgcccgttccaacggcgatagtcaaaccgaaaaaccaacgcagcaggccgccggtcacccgctcacccgggagacctgatacaccccctgcacctgattgagcttattcattatggtggtcacctcactctgggtccgcacctccaccaccagattcatcttggtgtatccgtcgggcagcacgttcaccgtcatccccaaaatattcatcttggctgtggccatcaccgtggtcacatccatggccaggccgggacggtccttggcaatgaggtccagggaggtcttataggtgttgaggctgtccgggtcccagctgaccttgatccagcggtccttctccccgggacgctgggcgccggccacagcgttgggacagtccgaccggtggaccgacaccccgtagccccgggtgatgaaccccacaatggggtccccgggcacgggggtgcagcacttggcgaacttcaccatacattccgtcatccccgagacgatgaccccggagaccgagcgtttcttattgcccgctcgggctaccccggcgtccagggctgagggagcctcggctttctcctcagcctccttttccgcccgctcggcggccaggcgctcggcctgctggcggtcctggtggaccagctcctcccgggcccggttggcgcacttctgggcggaggccccgccgtagccgatggcggcgtacatctcctccagggagttaaaccggaccttctccaggatgtgggggagcatgtgctccgcggtgagcatggcgatggtgaggcccaggcgcttgatctccccctcaaacatggcccggccgtgggccacattttcctcccgcttctcccgcttgaaccactggcggatcttggtgcgggcctggttgctcttggccagcttcatccagtcccggctgggacccttggcgtttttggaggtgatgacctccacaatctccccggatttcagctggtagtcaaagcccacgatccgcccgttcaccttggccccggtcatggagttgcccacggcggagtggatggcataggcgaagtcgatgggggtggccccggcggggaggttgatcacatcggcgttgggggtaaagacaaagacctcgtcggcaaagaggtccaccttcagggtgcggatatactcctcggcctcggtgtcctgctggttttccagcaggcggcggacccaggcgaaggtctcctcggtgcccagcttcttgttgcccatgccctgcttgtatttccagtgggccgccacgccgtactcggccatgtggtgcatctcccaggtgcggatctgcacctcaaaggggatgccctcgctgccgatgacggtggtgtggagggactggtacatgttgggcttgggggtgctgatatagtccttaaaccgtcccaggaccgggcggtacatgtcgtggatgtcccccaggacccggtaacaggtaaaaatatcgtccacaatcacccggaaggcgtacaggtcgaagatctcgctgagctttttgttttgggcgtacatcttccggtagatggagtagacgtgcttcacccggccgtagaccgtgcccttgatgccctccttctccaggcgggtggtgatctcctcctggatgtgctccataaaggccgcgtgggccttggcctggcggtccagctcgtcggagatctcctggtaggcgatggggtccaggaatttcagggactggtcctccatctcccacttcatccgctgcatgcccaggcggtgggcgatgggggcgtagatctccagggtctccagcgccttctcccgctgctttttctctgtctggtactccagggtgcggatgttgtggacccggtcgcagattttgatgaggatcacccgcacgtcctgggccatggccatgagcatcttccgcaggttctccatctgcttttcctcggtggaggtgtacttcaccttggtcagcttggtgaccccctccaccaggtcggccacggtctcgctgaaccgcttggccacctcctcgtgggtggcgtcagtgtcctcaatggtgtcgtggagaagggcggccatgatggagtccgcgtccagtcccagctccgccaccaggtgggccacctccagggggtgggtgatatagggggagccgtccttccgcagctgcccctcatggtggctgcgggcgtagtcaaaggcgtccctgacccgggcccggtcctcctgtgtgagattcttcagtttctcttccagctcctgaaaacgagcctccagcttgtcttccataggccatccctttcctcccggcgggcgccggcccgccgcactggctccgggacgtgtgccgcgccccttatgagctcaaatgacttcttctctcttctccccaggcaatggcctggagcttttgaataatgggggcctggtacagggccaccttgccctttcctcgtcgcttctgcaagcgaatccgaagggcgcccccctcctcgggacggagggtgaccaggtcaaagctctccaggacctccaggcaaatcatggtgtgcagggtggactcccacaggtccccctcctgggccaccttccgggccaggctggcgggcacctccaccacctccccgtcccggttggccaaatagcgccacacggcggcaaactcctcccgctggggaatcatcatccgggcctcgcagggggagagaggctctccccggctgtacttccggtacagggcctgctcattgagctgctgggccgagtaagccgggcgcaggtccaccaggtggagctgcacggagcgggagccccggtactcgttgatctgggggtagaaagccacgtcggcccggtcccccacggtgagccccgacttggcccgggtgacggagaaaaagatcatgtccaccgtccgcccgtcccggctggcccgcattttcaggtggcgtccgccccccacgtcggacatgcaggtgatggtaacccccgacagggaaaacacgggcttgggattgcccgccccgtagggctccagcatggacagggcctccacctcctccacggtgagcagggcggtgttctcaatctccccgtcgatctgcagggtggagaccatctcctctcccccggtgtcctggcggacgatctcctccatccgggcccggaaggcggggatgttctcctcctgaatggtgaagcccgcggccagggcgtggccgccgtagccctccagcaggtcggcgcaccgctccagggcgcaaaagaggttgaacccgccgtaggaccggcaggagcccttccccttgccgtcgtcctggaggcagatcataaacaccgggcaggcgtactgctcggccaggcgggaggccacgatgcccaccaccccctggtgccaggccttgtccgccagcaccaggcagtcatactgcttccggccggccagcagggccaggcactggttgaaaatctccagctccaccgcctgacgctggcggttgagctcacacagctcgtgggccagcagctcggcctggctgttgtcctcggtgaggatgagctccgccgcggtcaccgcccggcccatccggccggcggcgttgatccggggggagagacagtagcccacggtggtggaggtgatggcccggttcagggtgcccgcctccaccatgagggcgtacagcccacggcggcgggtttttttcaggtggttcaggcccacccggacaatggtgcggttctcccccaaaagcttcatcacgtcggccacggtgcccacggcggccaggtcggcgtactcctggaagagggcgcggtaccgcttttccccccccagggccatcaccagtttcagggccacccccaccccggccagatccttgaagggataggggcagtccttccggtgggggtccaccaccgccacggcggcgggaatctcctccttgcactcgtgatggtcggtgataatcacatctatgcccaggccgctggcgtaggccacctcctccacggcggtgatgccgcagtccacggtaatcatcaggcgcaccccctgccgggccagttcctccaccgcctcccggttgaccccgtagccctcggacaggcggttggggatgtagtagcacacgtcaccgccctgggcgcggagataatgggtgagcagacaggtggaggtgatgccgtccacgtcgtagtcgccgtagactgcgatcttctccccgttgcgcagggcgcggccaatccgggcggtggccaggtccatgtctttcatcaggaaggggtcctgaagctggtcctccccgctggagaggagacccttggcctctgccaagtcggtcatcccccgggcacagagagtggcggccaccagggtggggaccccctgccgttccatggctttataggcctcctgggaccgctgtgcgatgttccactgctggtatttcatgattgggacctcggttcgggaaattttctatccttacttccgtgccccggcggggcgaagaaagaaaaaatgcaaataacaatacatattacaggataacacaaaacctcccttatcacaagggataagggaggttttttcctctttttcctgggaaatcccggggcatttccggttttttcccttgctttgtgaacttctttccccttcggactcactcaaaccgggtccggtcataggtggacagattctggaattcctccatccgggcctgggccgcgggagagggggtgggggtgagcacgccgttctcctccgcccagccggtggtgtggaggacggggagggtgtgggcggtctcccgctgggcctgcatgtaggccgacccctcccagccgatgagctcaaagacctcattcatcaaaaagcagggggacaggtcgggcccctggccctggaagtcctggcccagcagatccttggcggcctggttgccccagatcatgtaccaggtggagtagtaattgcggaagccctcctccgtggtggtgtccaggctgatgcccatgccctcgtagatcaccccgtggttgcccatccagggtttgtggtccccgtagaggaggaggaccaccggctcgtccaggctgtccaggtactgggtgaaagacttcatgtaggccgagctgtcctggactaagtagaagtagttgttcagggcgttgagggtggactgggaatagtccccggtgcagtagctgtccccccagtaggtcctctccatgttgtagggaccgtggccctggtaggtcacattgaaggagaacagaggggcgtcgttggtgttgaaatactctgtcagacgctgctggagatcggggaagaagacctcgtcataggccacgtcctccccttcctcaatgaactggtagtagtagttgtccgtgaagaggtagtcgtccagccccaggttggggttgacgtgcttgcggtcatagaaccagtcccggcaggggtgggagccgttggcggtgtagccctggctcttcaggtaccaggccacggaatcggtcttggtcttaaaatccccgtgctggttgcccccggtgaggacagcccactcggtctcggtggtgcccccggcgaagatgtcggtgatgagggtgccggaatagctctcggcctggagctcgtggaagtcccggtagacctccggggacaggccgtcgatgtcgtacagggagaggtcggcaaaggcctccatctgaatggagatcaggttgacctttttctccgggggaatgaccccgtcggtatactggttgtaggtctggcgggcggcccgctcgtcataggaactggaagaggacaggtaatcccccgcgctgtggaaaaagggatagaccacccccgtggcggcataggcctcccgctcgtcctgggcatgctcccccgccagggcggtgtaccgctgatcgtcggggtaaatgtagtcaaaacaaaccaggctcaccatccccactgctgtcagggccagcaggcgcagggtggccttgggccggccccggcccaggaagaagagaaccactgtggcagccacaatgactccgatccacaggaacatcataggggtcagcgccacctgatattggtcagacatctggaggccctcccgcatgcggaacaggtcctcccagagcatggggtcatcccgaaacatcaccttgaagtagttggcgccggtgaggaggaagatcagcgcccccgtcaccaggcaggccagccaggcctgcccggaggccagccaaatcaggcccagcaggagaaacaccggcagggtgttccagaaaaacagggtgggattgcccgcccagctgactccgttccaccccgacagggccagggaaaaggcgctgatggacagccccgccgccaccagcagcaaaagcgtcagcaccgcggagcggggcaagattcgtttggatttcttggtttgcatcgcttgtttgtctcctctttcagggggattgctccgctgtcccgtagtaatttcccgccagcacccggttgctgagggtggtgatacggttgatctccgccgagcgcgcctcatccccggcgcctccattcttgctggaccagtaggtggtcccgtcataccagctgccgtcggagaagaagacataccctccctggtcccccagaccgtcgtggccggccaggaaggctccgctggtatccaggccaaagaggttggccaccgtgggcagcacgtccaggctggaggtcaccttgtcaatctgggtgggcgctaagtccgctgaccagatgaaaaagtcggtgtgttggagcagatttccgttgtccactcctttgatctgcatgttcagttggtcatccatcatgtagtaatcatagtggtcggcgtagaagatcagcaccgtgtcctccagcaggccctcctgggtcaggcggtccaccagctcgccgatgaacagatcggtctccatggcccccgccaccgcgtagacatagttgccgtcggtgcgctgggccgcggcctgggcctcctccgcatgggcttggtaaacaccgttttcctccccgtaggggccgtgggcggagtaggtgatgacgaaggaatagaaggggtccccctcggtcatctcgtcaaagccgttgatgagatggcggtccagctggtagctctccatctgcatgtcgtagcccccatagtacttctcatagcccagattggggtggatgaggccccggtcatacacctgcccgtcgctgttgtggaaggagcgggccgtgtaccccgcctggcggaagagattggccatggagtaggggaaagcattctcagtatacaccgaggtggagatgcccccggtggccggcagcaggccgctgttggtcataaactcggtgttgaaggtgccggcggagatgtaggccggggtgtaatggttggtaaacaccagcccctcggacttcagcttggccaggttgggcatgtaggcctcctggagcatccaggtgtcaatggcctccagctggaccattatgacgtttttccccgccagcaggccggtataggcgttgtccttctgggcggcctcatactcggccacatagtcgtctatctgctgccgctccccgtcggtcatggtgtcttgggggaagagcagccgccccaggtcccggacggtgtactgatacagaccgctgaccatcagggcgttggtggtgtcgttgaactcatggtaggccatgcgctggttctcctcgggggaggtctcccagatcatccggtccaccacagggaagtaatggatgtgggtgaaggccaccagtcccgcccccaccaggcaggccagcaccccggccagcacagaccccttgacgggcttgggggggatgaccttcagcagccgcccggagatcatcatcagcagcaccgcgatggccgaaccggcgatgaccttccagttgatggtgatatatgaggcgtccacaaagctccccgtccccccaaaggagagggaagaaaaggagaagaactttcgaaaggcactcataaacccgctgtgggtgatggccagcaccacaaaggtcaccaggggcacgcaccggacaaaccaccggggcaccttgggcaggaagaacaccagccccgcgaaaaccagtgcccagcccagggtgaacaaccccgccgggaggtatttgacccccacaatgcccatgccccggtaggtaaaccgcagggagaaatccagcaccaaataggccaggaagaaggggatgatatagagatagggccgcagaccgggcaggtcccggctgtacagccagttccgggcaaaacactgccagaaagagaggccctgctcctggccgggccgatttttgtccaaagctttgtctgtctgtttcatgaaaacctccttgcttgggcatcaaggacccgccgggcaggccaataacaccccgggggcggaaaccggcacgaagaaacagccggctcccacccccagaaaatttgctcattcagcagggactattttatttagacgcaaattgtgaaaaaatgcaagaggaaatcgttaacttttttttaattttttctcagaacgccatcttttcctggagatatgccttcaactggtcaatgggcaggcggacctgttccatggtgtcccggtcccggacggtgacgcagtggtcggccgccttctccccgtcccccacggtctcaaagtccacggtgacgcagtagggggtgccgatctcgtcctggcggcggtaccgcttgccgatggagccggcctcgtcatagtccaccataaagtccttggccagcatctgctggatctcctgggcggcggggcccagcttcttggacagggggagcacggcgcacttgaagggcgccagggcggggtggaggcggagcacggtgcggacatcgtccttgccgttcttgtcctggcccaccacttcctcgtcgtaggcgtccaccaggaaggccagggtcacccggtcggcccccagggagggctcaatgacgaaggggatgtaatgctccccggactcctggtcgaaataggtctgatccttgccagaggtggtctggtgggcgttcagatcgtagttggtccgggaggccaccccccacagctcaccccagccgaaggggaaggcaaactcaaagtcggtggtggcgttggagtagtgggagagctcctcgggctcgtggtcccgcaggcggaggttctcctcccgcatgcccagctccagcagccacttgtggcagaagtctttccagtaggcaaaccagtccaactcgctgccgggcttgcagaagaactccagctccatctgctcaaactcccgggtgcggaaggtgaagttgccgggagtgatctcgttgcggaaggacttgccgatctggcagaccccgaaggggagcttcttccgggtggtccgctggacgttctggaagttgacaaaaatgccctgggcggtctcggggcgcaggtagacggtgttcttggcgtcctcggtgaccccctggaaggtcttgaacatcaggttaaactggcggatatcggtccagttgtggcccccgcaggaggggcaggggatgttgtgctcctccacaaattccttcatctccgcctggctcagggcgtccacggacttgcccaggtcgaagccgttctcctcgcaccagccctcgatgaccttgtccgcccggaaccgctccttgcactccttgcagtccatgaggggatcggagaagccccccacgtgaccggaggccacccacacctgggggttcatcagaatggcggcatccagacccacgttgtaggggttttcctggacgaacttcttccaccaggccttcttcacgttgttcttcagctccacacccagggggccgtagtcccaggtgttggccaagccgccgtagatttcgctgccggggaagacgaacccgcggcccttacacagggccacgactttttccatggtcttttcgttgtttttcatatcctgtcaaactccttcgtttgtaatttacgggaaaatggggcagtctttggggacaaaaaaacgccctgagcggaaagctcagggcggaggttctccgtggtaccacctgaattcgggccgaaaaaagaacgcggcccgcactcgaacccgataacggcggggaaccggcggggcattgcctccccgcggcttacgggcgccttccctccaccaccgccagagccttgcaccgtccggctcctctcttgggcggggaagtgggggtactcttcccggtcacagcctcttacatcggggtattctatcaccttttcccgcctgcgtcaagggagcgcgccgatttttcctctttcccctctggcgccgccggttctctcgccctttttccacaagagaagggttttttgtgcatagttttttgaaaatttgaggcagccaggcaaaaaatttggaaaaaccccttgcatttccaccggaaatccgtcttagtttatataggacgtcctgccggacgaaagaaaagaaaggagagattcctatgaaaccaatgcggcaaatggtatgcgccctgctggcggtcaccttgctgatccctgcggcggcggcttccccaggcagcggcaaccctctatgggatgtacagggccactgggcccagaaggaaattcaggaggcagtggccgccgggtgggtagacggctatcccgatggcagcttccagccggaaaagaccatcacccgggcggagttcaccaagctcctgctggacgccatccatctgaccccggacagcgagacggtggcttggatgacagagaccgcaaccacaaaggatggccggtattcggaaaaaaagtatgtccccatcctcaacgacatggacggccattggctgaccacccagggctggacggacgccgccctttactccggcatggtggtgcccgatgactacaacggcaaaaacttccggccggaaaaggagatcgcccggtacgaaatcgccctgatgaccgaccgggccctgggcctggtctatccggccaaccagtatgcgggagaagacctccccttcgcggacaacgccgagattctggactggatgaaggggtatgtccatgaggcggtccaggccggcatcctggagggctaccccgacaacaccttccgtcccaaccagacctccacccgggccgaggcggtggtgatgattcagcggatgctccatgagatggagcaggggctgaatccggagatacatcttgtggtgcagtacgcagaggaaggaaccgtcctatgggaagaggagacggacgaaattcagctccaaatcgtggacaacgtggtctatgcctccatcaaagacatctatgatgtggaaaggcgcctgataaaagaccatggcaccgagcacaccaataaccccctctggaacatcaacgacccttactcggaaatgtggtggcccattcagcagatctattgcattagtatgatctcccagacctgtgccttttttgactaccgcatgggggatactgggtatgtcaccgaatccggtcttgccagacagtttcatactccagcccgcgctctgtatggagaagtgatgatcccggtttgtgatctcagtcacccggacagtcagccccagggcagctggtatcaagatgactggcatggtgcctgggatgctgacaccaatacgttgacccttcttctatactatcatgttcagacttttgttggaagctaacgaatccctatgttctgtatgctgaaaaaatgccacctggggcggccctgatcaaagggccgccccaggtggtttggtgatgctattttgttgttgaacacacaatgtatagaatcagtacccaaagccgccgaaaggccagccgccgctgccttgctgctgctcttgctgcaactgttgctgctgctgttcttcatattccttctgggcttggtcctgttgggctgttttttccggggtggactcctccaaggtcagcttcacggtgatggtttttccatcccgatagaccgtgagattcaccgtgtccccaggcttgtagttgtccttggcggtgatgaggtcattccccgaggccacctctgtgtcgttgatcttggtgatgatatcaccctcttgcaggccggctttctccccgcacaggccgggggtgaccactttcaccgccgcgccggccgggacgccgtaggcctgcacatcctcagccacgtcgcccacggagatgcccatgagaggcttgccggtgacgtagccattggtgaccagctccgaaaccatgtccgccacgtcatccatggggatggcgaagcccaaaccctctaccgaggctgaggaggaactggcgctggaggaatacttggccgagacaatgccgatgacctccccgtggctgttgaacaggggaccgccggagttgccggagttgatggcgcagtcggtctggatcatattcatcttgttgccgtcactcatggtaatggtgcggtccagggcggagatgatgccggtggtctccgagaaggtcagctctcccaaggggttgccgatggtggtgacctgctcccccaccagcatgtcgctggagctgccaatgaccacgggggtcaggccggtggcctccaccttgatgacagcgatgtcgttggcctcctcgccgcccacataggtggcggtatactccttaccgtcagagaaggtcaccttgatggagttggccccgtcaatgacgtggtagttggtgaggatgtagccgtcctcggtgatgacaaagccggagccggcggccgcgccggtgacggtctggccaaagatgttggtgctgacgatgtccacggtgatgcccacgcaggagctgacatacttggcgtaaatctccgcggtggtcagttccttctccgtgttcactgcggcggtgtccaccttggtgggggttcggttgccggtgtaaatggtggtcccatttccgccggtgacggcattgtacacaggatgggccaaaccgcccaccagggcgcacaccagacacagggccacgacctttaaggtgcttttctgtctggcactcaagggctttctgggctttttcccccggggacttcccccgtcaaagtttggcccctgaaagccggagccttgaaaggaggggccatctcccgaagcaaagggatcgtgagaatagccgccgttctgattgccgttgtcgttgccgtagtagtccataagtatgcctccagtccatcctgttttctgaggatgcaaaggcccctcccaagggaagaccccgtgctctttttactgtggtcagtatagcggatatttatgaagatttcgtgaaatcgaagtagaaaaacttttaactttctttctccattttttgaacggtttcgccgggtttttcgggctctggcgggtctgtctcctccggtctgccatggaggatggccgccatatcccgggccgccatggtgaggtcccggacggtggcgtggaacatccccgcccgccacaggttccggagcatcagcagcagaaccggggccaggatcatcgccaccacgccccctaacttcatgcccacgtaaatggccagcagggagagcagggggtgcagccctgtctggtcccccacgatcttgggctcaatcatccggcggaagaggcagataaccccccacaccgccagaaaggccacgccccgcttccactcccccagcaccaggagaatgacagaccaggggaccatcaccgtccccgcccccacaatggggataaagtccaaaatgcccagggccaccgccagcagcacccaatagggctgccgaagcaggaaaaagcccaccaaaagaatccccgtcacccccagggagaccagaatctccgccttgagatagcccccaaaggcggcggaaaaagcgccccgggcctgtacgccgatgcgccggacactccggggaatggtctcccgggccacccggcggagattgggataatcctcggcggtaaaataccaggccaccaggaaaaagagaaaggccagcacaaaggaggagatgctccgcaccgctgaggtggtcttcggtaacagattataaacaaattcctccagccaggccagcagccggtccgacagattccaaagggtgtcctgcacctgctggggcagataggccagccacttgtccagggcatggctgagctgatagtaagtctcctgaaaggcgttccagccttggtcccagtttccccacagggtggaaagttcactccagcctttccaaatgagagccgccattaggccacccagagctcccaccaggagcaaaatcaggacaatggcccctatgccccggggaatgttccaccgcctgtggaaaaaccggagcaatggctcggtcaaccaggtggccaaaagagccagggcaaagggcatgcacagggagagcagagggcggcccgccaggcagaggaagagaaccagggacaaaaaaatccccagccgaatggccagacgggcccacagctgccgccgctgtccaggcggcagggggcgtggatcgggaaaataggcgtctgcggaagtatccatatacggtcctttctgcggtatggtgggagagagggagacagagataggatgcccggattgggaccggagaacccgtctcatgctggtttttcccgccgccaaggcgggaaaagcccaatacaaaaaaaccgtctgatccaatcagacggttttccgtaagtccttctcgttactgaggaatcttgttcagccgcagggtcatcttgctcttgcggttggctgcggtgttcttatgcatcagaccacgggcagcagcctgatccacagccttgacagcttccttgtatctcttatcggcctcgctgcggttgccttcgttgatagcagcatcaaaatacttcagctgagtcttcagggcggactttgcggccttgtttctggcggcctttgtctgattgaccagaacacgcttcttggcagacttgatattcggcaaaccaaacacctcctccgattgattcattttgtcacaaaagttctgtgcgagaatgtattttagcataccccgcttgaaattgcaaccttttttccagaaaaatctgaatttttacataaatttttgcaaagtgctaaagatagtgattagaatctgcttgtcccaccatatctggtggtgggacggaagggagtgccccatgatccaagacagaaaaattgatttggccctggaggccaaggagctggcggagggttccgcggcccagaccacccgtctggccggggtgaaggcccaggaggacaccgtctttggctatcccctcacccgggtggaaatcctcaatcgggagggggaggccgccctgggcaagcccaaggggacctatctcaccttagagctgccccagctgccccgggagcgggaggaggttctgcgggcggcccggggggtggccgcggtgctggaagccctgcccaccctgcccaaacaggggtctgttctggtggccggcctgggcaaccgccgggtgacccccgacgccatcgggcccagggccacggactttctcctggtcacccgccacctggtgcagaccatgccccaggacttctccgccctccgcccggtctccgcgctggccgccggggtcaccgggaccacggggatcgagagcggcgagctcatcggggcggtggtgaaaaagctcaagcccgcctgcctcatcgccgtggacgccctggccgcccgccggcaggagcgggtgtgccggacggtccaggtctctgacaccggcattgtccccggctccggggtgggcaacgcccgaatggccctggatgaggaacacctggggattcccgtcatcgccgtgggtgtacccacggtggtggaggcggccaccctctgcctggacctgctggaccaggcggggcaggagggattcgacccggccctcttccgtcaggagggggccgagtggtttgtcaccccccgaaacgtggacagcgaggtggagaccctctcccgggtgctgggcctgggcatcagcaccgcgctgcatgtggacttttccgtggaagatgtggaaaagtggatctcataagtcccatttttccctcttttccggagaaaacttagaaaaaacgaaaaggttctccccaatttcccaggaaattggggagaacctttctttccatccgttccatcagagggaggcttccccgccccactcctccacaaaggccagcagtgcgtcaaaatccccctggggataggaggagatgtccttctctttccggttgagcaggcagtctgtgagcagaaagaccgacagccccgccgcctgggcggccatcatatcctcctccacatcgttgcccaccatcaggcagtcctccgcccggcagcccaaataccgcaaaatctcccggtaataatcggggttgggcttgcagtagccgatgttctcataggtggtgtaccatgcaaaggtctccggggccagccccgcccagcggatgcggctctccgtggccaccgccggaaagatgggattggtggccagggccacccgatggccggcggccttgcaggcctccactgcggcccgggcttttggggtaaagccgcagaaagccttggcctgctgaaactcctgccggtaaaaggcgtcaaacagggggatgtcctcccggacctgctccccatacagggcggcgaatctatcccagaaggccgcctcattggtgcgtttgccatcgttgcccaccatggcggcggtgccggcccagatattgtccaccagagcggccgggtcatacccgtggggggccagcttttgggccaggagtttgaaatacccacgggtaaaggcgtcctggtccatggggagcagggtcccgtccaagtcgaatagaatggtttttttcttcattggttctccttttttcttgccgccctggggcgggcgcaccggcccgaacagggccaagagggattttacgcaggaagagacagcccccttgcagagggctgcctccatctgttacgccttaaacttccggctttccgccacggccatctcgtcacagcggttgttgtaggggttctccgcatgcccttttacccagtggtagcgcagctggtgccggtctgtcagggccagcagctgctcccacaggtcggggttcagggcgggctttttgtcgcttttcacccagccccgctttttccagccccgggcccagcccttctccagggcgtcgatgacgtatttggagtcagaatagaggtccacgccgcagggctccttcagcagggacagggcggcgatcaccgccgtgagctccatgcggttgttggtggtggaggcctccccgccggaaatctcctttcgatggctcccatacaggagcaccgccccccagccccctgggccggggttgccggagcaggcaccgtcggtgtaaatggtcacctgcttcatgacgctttttcccgctcctccgcgttctttttcttccgccgggcccgcaagggcgggaccaccagcagcgccactcccaccaggaagaagaacaagcctcccagggtgaacagtcctccatggacccagccggtgacgggaatcatctttgtcaccccgcgccagatcaccagagcgcccaggacggccataattatgccaaaggtgagggtgatctttcgaaactctttttccatttatgtctcctcctgggtttccccttcattctcctggggaacccgggccagggagatgaccttggttccctcggacacccgcatcacccggactccctgggcggtgcggctgtacaggttcacatcggcggcggccatgcggatgatggtgccgtcgtcggagatgagcaggatgtcgtcgtcctcctccaccaccttgaccccggcggccttgccagtcttttcggtgatctggtatcccttcaggccgaagcctccccggtgctggggttctcccccggaacggatgtactcctcaatgtgggtgcgcttgccatagccgttttccgtaatggccagcagggtagtacccagctgggccagcaccccgccgatgacatagtctcctggccggagcttgatgccccggacccccaccgcggtccggcccatgggccggacatcggtctcccggaagcagatggccatgccgtcgtgggtagcgatgaggacattggcctccccgtcggtctccagcacggcaatgagctcgtccccctcgtccagggtgaggccccggaggcccgccgcccggatgtttcggaaggcggatttctccgtgcgcttcaccgtgccgttgcgggtgaccatgaacagatagccgttctcatcataatcccggccgtggagcatggcggtgacccgctctcccggctcaaattggaaaatgttgttcagatgggttcccttggcggtccggctggcctcgggaatctgatatcccttcttcttgtacacccggccggaactggtgaagaagagaatgttgtcgtggctggaggcggtgaacagggtgtccacatagtcctcctcccgcaggctttgggcggagacccccttgccgccccgcttctgggcgcggtaggtggacacaggcattcgcttgatgtacccggcggcggtgagggtgaagacgcaggtctcctcctcaatgaggtcctcaatgtcgatctcgtcctccacgtcctggatctccgtcatccggtcgtcgccgtacttgtcccggatctccagcagctcctgcttcatcacacccaccagcttctcccggttggacagcagctcctggtaccaggcgatcttcttctccagctcgttgtattcctcctggagcttctcccggttcaggccctgcagggcgatcagccgcatgtcgcagatggcctgggcctggacctcgtccaggtggaagcggttcatcaggttctccctggcgttgtcatagctggagcggatgatctgaatgacctcgtcaatgttgtcctgggcgatgagcagcccctccagcaggtgggcccgctcctcggccttgcgcttttcatagcgggtgcggcgggtgatgacctcctcctggaaggtgaggtactcgtccagaatattccgcagggagagaatccggggctgcctctggttgtccaccagggccagcatgttgatggcaaaggtggtctgcagctgggtctgggtgagcagatggttcagcaccacctgggggttggcatcgtgcttgagctcaatgaccacccgcatgccgttgcggtcggactcgtcccggaggtcggagatgccctccagccgcttttccttcacctgctcggcgatggcggcgatgagcatgcgcttgttgacctggtagggcagctctgtgacaatgatccgggtgcgctcgtggttgcggccgtactcctcaaactcggtgcgggcccggatggtcacccggccccgaccggtggcgtaggccgcccggatgccggagcggcccatgatgatccccttggtgggaaagtccggccccttcacgtactgcatcaggtcggccaggtcggcctcggggttgtccagcacgcagaccgccgcgtcaatgacctcccgcagattgtggggggggatgttggtggccatgcccacggcgatgccggaggagccgttgaccagcaggttgggaaaccgggcgggcagcacccggggttccctccggctctcgtcgaagttggggtcccagtccaccgtctccttctcaatatccgccagcatctccccggccatcttggccatgcgggcctcggtgtaacgataggccgcgggagggtcgccgtccacggacccgaagttgccgtggccgtcgatgagccggtaacgcatggagaaatcctgggccagccggaccaaggcgtcatacacggagctgtccccgtgggggtgatacttgcccagcacgtcgcccacgcaggtggcggattttttgaagggcttgtcggaggtcaaaccgctttcatacatggagtataaaatccgccggtgcacgggcttgagtccgtcccgcacatcgggcagggcccggcccacaatgacggacaccgcgtagtcaatgtagctgtccttcatctccttgaccagctccgactccacgatgacctggtccgggaaagcgatgtcctccggccggtagtctttgttctttgccatagtttcactccttcactgccgccgcccggcggcgggggatgggtcttgtcggaggcaggccgcctcacaggttgattggcccgtcctcccgggcgctttgccgcagcagacggaccacatagaccaccaaccccgcgaaatatccataaaaaatccagccaaatcccacgagcaaaaagtcatacagaccgtggagaaccgccggcagaagccaggcccgccgccgggccgccccggcctgttcccgctgtccatggacctccagccattttgcccggctcatcgcctcccccatgaccacgccgaacatggcgtggcccgggatggagaaaatggcccgcaccaccgccgtggaaaagccggaggtgagcacatacagcacattctccaccgcggcaaagcccagggagacaaagaccccgtacaccacgccgtcaaaccggtggttaaaatggggctcattccaggtgcgccggagaagaacccggtacttgaccccctcctcaatgaatcccggcaccacaaaataggccagaaagaggtagacgatgggacgccaggggaaaaaatcaatgaactgatcggccacaacctccagcaccaagatggggaccatggccaaagccccccgaaagaacagggccaacagcagggctcccggctcccggtccagtttatccatttggtagaccacccgcagcagcaccagcgggggcagcagggcggcggccaccaaaaacagaatggaagatagcatcataagcgtagtttggtttcctttccttttgactggaggtagtgtatgcccttttggggtgggcgatgcacagaccgttcccaagggaggtctccaaactcaaatatccaaatttaccacgtacttggcgttctcctcaatgaactcctttcggggctccaccttttcccccatgaggatggtgaagatttcgtccgccttcaccgcgtcctccagggtaatccgccggagggtacgggtttcggggttcatggtggtctcccacagctcgtgggggtccatctcgcccagacccttgaagcggctgatctccaccttggcgttggggttgtccccccgcatctgggcggacaccgcgtcccgttcctcgtcggagtaggccacccgctgctgcttgcctcgggtgagcttatacagggggggcacggcggagtagacatacccctgctcaatgagggggcgcatgaaccggaaaaagaaggtcagcagcaaggtccgaatgtgggccccgtccacgtcggcgtcggccatgatgacaattttgtggtagcggagtttttccgggttaaactcctccccgatccccgcccccagggcggtgatgacggggctgagtttgtcattgccatagacccggtcagcccgggccttttccacgttgagcattttgccccacagggggagaatggcctggaaccgggagtcccggccctgggtggccgagccgccggcggaatcgccctccacgatgtagatctccgtgagggaggggtcccgttcgttgcagtcccgaagcttgtcgggcatctgtcccgactccagcccggttttccggcggacggattcccgggcttttcgggcggcctctcgggcccgggcggcggtgagggccttgtccaggatggcccggcccacggcggggttctcctccaaaaactcctccaacttctccgagacaatggaattgaccagggtgcggatctcggagtttcccagcttggccttggtctggccctcaaactgggcttcggtgagcttcacggagatgatgcaggtcaggccctcccggcagtcctcgccgctcaccttctcgtcctctttgagcagcttcattcttctgccgtaggcgttcagggcattggtcagggcccgtttgaacccctcctcgtgcatgcctccttccggggtgtgcacgttgttggcaaaggagacaatgatctcgttgtagctgtcgttgtactggagagagacctccgccatggcgtcctcccgggacccggccatatagatgacgccgtcgtggatgggggtcttgttgcggttgatgtaggtgacaaactcccggatgccgccctcatagcacatggtctcggagatcacttcctccccccgccggtcggcaatggtgatggacaggccggcgttgaggaaggcctcctcccgcatccgggtgtgaagggtctcgtaatcgtactccgtggtctcggtgaacatctccgggtcgggctgaaagaccacctccgtaccggtgcggtcggtctgccccaccacctgcatgggctgggtcacctggccccgggcaaacttcatctcgtagatctgcccgtccttatggacccggacctccagccactggctcagggcgttgaccacagaggcgcccaccccgtgaagaccgccggagaccttatagcccccgccgccgaacttgccgccggcatggaggatggtaaagaccacctccagggcgggtttgcctgtctgcttctggatgtccacggggatgccccggccattgtccaccacccggatgatgttgcccggctcgatccccacctgaatctcggtgcagtacccggccagggcctcgtcaatggcgttgtccacgatctcatagaccagatggtgcaggccgctggaggaggtggagccgatgtacatgcccggccgcttccggacggcctccagtccctccaggacctgaatctccgaggccccgtactcatgttccaccgcggtggtgtttttctgttccaactgatccatttttgatacctccagagggaattcccctgccggcgaaattctgttcgccgaaggggcttgctgcgctatattgtctcaaagcggccggactccacccgcctgagcagggtggctgaggagagctgagagaggtagacggtgaccctgcccgcctggttccggcagaggagaaaagacttgggcaggtcctcccccacgctgacaacctggccggcctgctgggcccgggccagaaagtcccgggtcacccgggaggaagtggtattgtccaggtcgaaaatccccagcacatcccccagggggatgaccaccgaggcccccaagtgcagatacatagcttccacccgcctttctgtgacaaaatcaaaaaggttcctctatcttaccacagtcccccccgcgaaaggaggacgtttttgtacaacacaggagagaatttttcttaattcggcgaatccaccaaagcgccctggtgaatatggaggatttttccccgggaaatctcccccgccggggcctcacagctggtgatgaacacctgtcccccagtgatccggtccaggacaaagtcctgccgccgggcgtccagctccgagagcacgtcgtccaacaggagcaccggccactgtcccgtgtcgtcctcaaagagctcccgctccgccagcttcagggagagggccgccgtccgggtctggccctgggaggcaaactgccgggcgggctgtccgtcgatccaggccgccagatcgtccttgtggggcccggacaggcaggaccgggcctccaattccgcccggcggtggctgtcctggtgggcccgaaggtcctcataaatggacaccgtgggccccaaggggttccggacggtacccacggtctggtaagagagggtcagctcctcccggtccccggaaaagtcccgctgaatctgggccgcccggggggccagtttccccacaaagtgggcccggtagtgaatgagcagggcccccgcccgggccatggcctcgttgaagtcctccagcacctccagcaagctgggattcttctcccaatcccgaagaatccgggtcttgtggtccagcagcttgtggtattgggccagcgcctccccatatcgggggcgaagctggcagatggcgtggtccaaaaaggcccgccgctccgccgcccccgatttaatcagcgccagatcctccgggcagaacagcaccgtctggacaatccccgtcagctccgccgcggttttcagcttcacacggttcaccagaagcttccgccggcgcccccgggccagctgggcctcaatgagaaaggtccggtcccggctgtccacctgggctgtgatggtcccctgatcccgctgaaaggagatgagctcccggtcccctcgggcccggtgggaccgggccccggagagaaagccaatggcctccagcagattggtctttccctgggcattctctccccagatcacattgacccccgggtcaaaggaagcggaaaagttggtgtagttgcgaaatccgtccaagcagatggagcagaccctcattgcactgtgagctcccggccggcaaaggccacccggtccccgggacgcagcttctttccccgcatccggcaaacctggccgtttacggacacctgaccgtcctggatgagacatttggcctctccgccgctggagaccaggttggccagcttcagcagggcctccagcttgatgtattctgtggtgatggaaacggattgtggttccatgggcgcctccttgggtctttgggtttctttggggggatatcgccttttctgcggttttttccggcgccgttggaacggcggg

SEQ ID NO: 2229 - DNA, 54682 bp, KLE1738
cggggtagggcagggcctggatgaagccgtccccctcgttggagtagatctccccgccgatgacctcttttttatagaggagaagactggcccagatattttcctgtaaaccggggtagttggagacctgataggtatagcgtttgacggttttgccggcgtactgggacaggtcgaagccctgggatttctggagggacaggtactcgtcgtaggaggcgtcgaaggtgtccgggaggcggatgtcctctacggcggcaggctcctgggagacgatccagccgtagccctccagaaaggccacccggtcggcgttggttttgatgccccgggggtccacttgcaggtcggccacggccgcggcgctctggatgtcccgcaccagtcccaggccggcccccagaacccccagggccagggcgaacagggcgcagccggccaccaggcggcggggatggagtttcttggtgatgatgatcatggatggtagctcctctcagtgcggcgccggcggccgggaaaggggaccggcggcgaaaatcttctccttactctatgtccacggcggaaaaaatatgatacaatggcgaaaacaacgggtacaggaggggagagaccatggagcggttggacaagctgttggcggccacgggccagtggtcccggaaagaggccaaggcgttggtcaaggcgggccgggtccaggtagggggcgcccggcccaagggaccggaggacaaggtggccgaaggcacccccgtcacagtggatggccggcccattgccacggagcagggggtttatgtgatgctccacaagcccgccggggtggtctcctccacccaggacccccgggagcggacggtgctggacctgctgccccagcatctgcggcggcgggcgctgtttcccgtggggcggctggacaaggacaccgaggggctgctcctgctcaccaatgacggacctctggcccacgcccttttggcgccggggcggcatgtggacaaggtctactatgtggaggtggacggccggctggaccagcaggaccggcgggcctttcaggcgggagtgaccctggccgacgggacggtgtgccagccggcggacctgacggtgctggacccgcccagccagggcttggtgaccctccgggaggggaagtatcaccaggtcaagcgcatgctggccgcccgagggaagcctgtgacctatctcaaacgcctgtccatggggcccctgaccctggacccggcccttccggcaggggcttggcggccgttgaccccggaagaaaaagccagtcttggacgataaaaggaattatttcggcattttccacaaagattcacgaaaaagctattgaaatcgctcgaaggaaccgctataatataggctattctatgatgccatcatggggaattctaattttcgtacgtagaaaccaggaaaaacccccttttgagagcaaatatgaggaggaaatagacatgtccagcagagtatttcaaagcattgtgctccaaatgaaggagtgcacggaccgggtcatcggcgtcatcgacgaccagggcaccgtggtgtcctgcaaccagctgacctggatcggtgagaaatgggagggcgctgcttccgccttaaatgtgaatgagtccgccgtggtgatctacggggacaagaccttcaaaccgttggtcagccgggggtcccactacgattatgccgcctttgtccagggcagtgacgagcaggccaagctcatctgctccatggtgacggtggccctgaacagcgccaaggcctactatgaggagaagcacgacaagaccgcctttgtgaaggccatcatctccgacaacatcctgctgggggatatctacgtccgggccaaggagctccacttcgcctcggaggccctccgggcggtctttctggtccggcaggtgggctcggcggagatcgcggcggtggacgtggtccagagcctgttctccgacagccaggaggattttgtcatctccatcaacgagacggacatcgctgtcatcaagaccctcactgaggggggcgacggcaaggagatctaccgcattgccaagagcattgaggacgccctggcccagaacctgaagatcaagaccaccatcggcatcggcaccgtggtcagccacatccgggacttggcccgggcctacaaggaggccggggtggccatcgacgtgggcaaggtctttgacacggagaagaccatcatcacctatgagaacctgggcatcggccgcctgatctaccagctgcccacggtgatgtgcgggatgttcctccaggaggtatttaagaagaaccccattgacgccctggaccaggagaccctgtttaccatcaacaagttctttgagaacaacctgaacgtctcggagaccgcccggaagctctttgtccatcggaacaccctggtgtaccggctggagaagatcaagaagctcaccggcctggacctgcgggagtttgacgacgccatcaccttcaaggtggccctgatggtgaaaaagtatctggtctcccgggggatcgagtcgtaagggttcggggcaccgccccgccgggcgcgggggaggacaaccgaatacagcacaagatagataaaggagtgttactttgattcgtctgagagacattcataaggagtatcaaaacggcacaaaagccctgaaaggggtcagcatgcagattgacgacggggactttgtctttctggtggggccctcgggctccggcaagtccaccatcatcaagctcatcacagcggagatctctcccacccggggcaagctgatggtcaatggatacaacctcaacgacatcagcgaaaagcagattcccctgatgcgccggaccattggcgtggtcttccaggatttccggctgattgagaaaaagaccgtctatgagaacattgaggtggccatgcgggcggtgggcgccaccacctatgagatccgccggcggattccctatgtattggacctggtgggcctgaccaataagggggggcggctgcccacccagctctccggcggggagcagcagcgggtggccattgcccgggccctggccaacaaccccagcgtcatcatcgccgacgagcccaccggcaacctggaccccgcccgctccctggagatcatgtccctgctggagaagatcaacgacatgggcaccaccatcctggtggtcacccacgagcgggagctggtcaaccggttcggcaagcgggtggtggccatcgagagcggccggatcatcagcgacgcggcaggagggtattacggcaatgggagatagacagatttggtatcatatccgggagggcttccggagtatatttacccatggactcatgtccattgcggcggtgtgcatgaccgtggcctgcctgctgattatgggttccttctccctgatcgccatcaacgccaaccatgtgctgggcgatttggaggacgacaaccagttcctggcgtacattgacgactccctcacccgggcccaggcccaggcgctggaaagtcagattaaggccgtacccaatgtggcggacatccactttgtcaccaaggaggaggccctggccaactttaaggcaaaccaggaacggcaggacctgtttgacaacgtggagtccgacacccttcgggaccggtatgaaattcatgtggtggacatccagctgatgcaggagacggtggaccaggtgaaggacattgatggcattgccaaggtgcaggcctccctggaaattgccgacggctttgtcatgctgcgcaatgtggccaccgctttggccatcattctggtggtgatgctggtgctcatctccatctccatcatcgccaacaccatcaagctggccaccttcacccggcgggaggagatcgccattatgaagatgtgcggcgccaccaactggtttgtccggtggcccttcctggtggaggggatgatcctgggcctgaccgggggcatcatcgccttcttctgccagtggggcatttatggcctcatcgtcaaagccattgaccagagcgacctgctgggcattatcagcaccctgcccttctccagcatgtcccactggattttgctggtcttcctggctgcgggcttcgtcatcggcgccggcggttcggtgatggccattcggaagttcctgaaggtataacgcagtcaaggaggcgacgcacagcccatgagcaagcaaaagaccaagcgccgggaccccatgcgcctgcaaaagcgcattgccgcagtggttgcggtggtcctgtgcctgtccctggtgctctccctggtggccacagtgctgccgtattgagaccgggaaaagcgacaacccatcaggcaaagcggcggctgcggccgccgcttgcttttctttcgccggcatccgccggcggggggcgagaaggaggaaacgccatgcagcgcaacacgaaacgaatcgttggaaagggagtagtctgcctgctctgctttctgctgggcggggtggccaccctggggatcacctggcacttgctgggccaggacgggcggaccctgctccaggcccatcagctcattgagaagcggtttgtgggggagtatgacccggcggagaacctctcggccaccttggagaccatggtggattccctgggggaccggtggtcctactacctggacccggaggaggcccagcggacccgggaggcccggagcaacgcctatgtgggcatcggcgtcaccgtgagccaagagccgtcggacgggctggagatcgtgggagtcacagcgggcagccccgcccaggaggccggcttgcaggtgggggagatcatccgcgccgtggacggccaggccatccagccggagacccgggaggaggcggtggaggccatcaagggggaggagggcacctggctcaccctggaggtggaggccgccgacggcacccgccggacggtggagctccagcggaaacaggtccatgggatcaccgccgcctggaagctgctggaggaccaggtggggctggtgaccatccagaacttctacgccggcaccgccgacctggtgaagcagggggtggcggagctccaggcccagggggcccgggccctggtctttgacgtgcggaataacccggggggatatgtcaccgagctcacggagatcctggatgacctgctgcccgaggggaaaattttcatcaaccggagttccgacgggaaggagacggtctacacctccgacgccgactgtgtggacctgcccatggcggtgctggtgaacaggaacagttacagcgcggcggagttcttggccgcccagctccaggagtccgccggggcggtggtggccggggagcagaccagcggcaagggcttctcccaggtgctcttcgacctgcccgacggcagcgccattgggctgtccaccgcccggtactacaccggcggcggggtctccctgatcggcaccgggctgacgccggaccccctgtgctccctgtcggaggaggatgagcagaagctgctggccgggcagctggagccccaggaggacgaacagctgcaggcggccattcaggccatggagaagtgagggcccggtccggccggccgggaggggacccttccccggcgggaaacctggggaaccctgcgattttcccgggaaaaacccggtacgctgccgaagggcaggtccatccccttgacagaccgggagaaagttcctataatacttagacatgtaaacggagtattatatttataatgtgtatggcccccgggccgtcccattgtaacgcgaccccattaagaattggaaggtgtgtcaccatggcaaaggaatatagactgagcgcggagcgcctggaggaactgaagcaggagctcacgtatttgaaaaccgtgcgggagaaggaagtggcggagctcatcaaggaggcccgctccttcggggacctgtcggagaacagcgagtacgacgaggccaaaaacgagcagggcaagctctactcccgcattgcggaactggatgagattttgtccaactacaccctcattgaggagcaggagaaccacatggacatggtccacgtgggcaacaacgtggtggtgaaggacttggagtttgatgagaccttgcactatcaaattgtgggctcccaggaggcagaccccatgaacgggcgcatctccgaggactcccccttcggccgggccctgctgggcaagaaggccggggaagaggtggtggtggaggcccccgccggcaacatccgctatcagattgtggagatccagagataaccaacccagaaagataaaggagctgcgaaacatggcagagaagaacagaaaggacaacccccaggagcaggaacaggacctgtcccagattctccaggtgcgccgggacaagctggccgccctccaaaaggaggggaaggaccccttccagcagaccaagtttaccgtgtccgcccacacccagcagattaaggaccactttgaccagatggaggggcaggctgtgactgtggccggccgtctcatgtccaagcggggcatgggcaaggtgagcttctgcgacctgcaggacaaaaccggccgcatccagctctacgcccggcgggatgagatggacgaggcggtgtacaacgccttcaaaaagtacgacatcggcgacctggtgggggtggaaggcgaggtcttccggacccagcggggggagatgagcgtgcggtgcaagaacgtcaccctcctgtccaagtccctgcggcctctgccggagaagttccacggcctgcaggacaaggagctgcgctaccgccagcggtacgtggacctgattatgaaccccgaggtgcgcaggaactttgagatccgcagccagttcattcgctatctccgggctttcctggacgagcgggggtacatggaggtggagaccccggtgctcaacaccatctccggcggcgccaccgcccggcccttcatcacccaccacaacaccctggaccttgacatgtacatgcgcatcgccaccgagctccacttaaagcgcctgatcgtgggcggcctggagcgggtgtacgagatcggtcgcattttccgcaacgagggcatggataccaagcacaacccggagtttaccaccgtggagctctatgaggcctatgccgacttccacgacatgatggacctgtttgaggccttcctctcctccgccgcccagaagatcctggggacctatgaggtcacctggcagggggagcagatcagcctggcccctggctggccccggctgaccatggcccaggcggtccagcagtacctgggggtggacttcatggccatcgacagcgacgaggcggccgtggccgccgccaagggcgtgggcatcgacatggacggggtggagcccacctggggccacgccctctacgagtgctttgaccaaaaggtggaggggatgctcattcagcccactttcatcaccatgcacccggtggatgtctcccccctggccaagcggtcggcccaggacccccggctcaccgagcggtttgagctgttcatctgccgcagtgagatgggcaacgccttctccgagctcaacgaccccattgaccagaagcagcggttccagaagcaggtggagctccgggccggcggagacgaggaggccggcatgatggacgaggactacatcaacgccctggagtacggcctgccccccaccggtggcctgggcatcggcatcgaccggtgcgtcatgctcctgaccggggcagactccatccgggacgtgattctcttcccgaccatgaagcccctggacagcgcgaagaaagaaaacagcgtcaattccgagggggccgctgcgcccaagcctgtggcggaaaaggtggatttttcccaggtgaaaatagaacccctctttgaggaaatggttgacttcgacacgtttgccaagtcggacttccgcgctgtgaagatcgaggcctgtgaggtggtgcccaagtccaagaaactcctgaagttcacattagacgatggaacggaacgcagacgcaccattttgagcggaatccatgagtattatgaaccggaggagctggtggggaaaaccgccatcgccattgtaaaccttccccccagaaagatgatgggcattgattcggaggggatgctgatttcggcggtgcatgaagaaaacggccgggaagggctgaacctgctgatggtggatgacaggattccggcaggggcaaagctgtactgagcaggacgggccgcatggcctgtcaggcccgttgcacacgatgttacccctgttttacaccgcttgaacgaaaaaacggcacgatatgccgacagccgggggcccctgtgaggggtccccggctgtcggcgttgtctttttgtctgggattacgcttggttcagctgccactgggcgctctggctctggagctccaccatgcggcggtagagtccgccgcgggccatcagctcggcgggggtgccctgctcggccacgcggccgttgtccagcaccacgatgcggtccgccccggccacggtgcgcatccggtgggcgatgaccagcacggttttgccggccagcaggcgggagagggcgccctggaccttggtctcgttctccacatccaggctggcggtggcctcatccagcaggacgatgggggcgtccttcaaaagggcccgggcgatggagatgcgctggcgttccccgccggagagcttggctccgttctccccgatgggggtgtcatagccctggggcagcctgcggatgaattccccgcagttggcggcctccgccgcagtccgcacctcctcgtcggtggccccccggcggcccagccggatgttttccatgacggtgtcgtcaaagagcaccacatcctggaacaccatggagtaatcccgcagcagggcctccgggtccacggtggagatgtccaccccacccacctggatggtgccctcggtggcgtcccacagccgggcggccagccgggcgcaggtgctcttgccggagccggaggggcccaccagggcggtgacctccccctccttggcggtgaagctcacaccgtccaggacttttttcttgtcgtaggcaaagcccacctggcggaacacaatgtcgtgcccctggggctggaagtgcgcggtgccctccgccaccggcgtgttgtagatttccgtcatgcggtcggcggacacctgggagacgaacaactccgcgatgagggccaggctctggtcgaagggggcatagacccgggtgatgaccagcaggaacaggaagagcagcatgaagtcaatctggccggagagaatccggtcggcgcccaccaggatggtggtggccacgcccagacgcatgatgacgctggcggcgttgacaaagatgccggtgcccagttcgccctggatggtgaccttctcgtggtcgtcaatcttctggttcagcccggccagataccggacctcctggttggtggcgcggatctcccggacattctccagggcctcctggatgccatcggagacgcggacggcggcctttttcgtccgctcagagctgcgggcggagagcctgcgggtgccgaacagcaggccgaaggccacgggcaccccccacaggcaggcgatggccagttgccagtcatacaccagcaggcacaccgcgatgagcgccgtggagaggtaggagccgtacagatagcccagcacatgggaccagacgtgctccatgcggttgacatcccccatgagggtctcggtgaggtcggccaggtcccgcttgccgaagtagcccaggggcagcttccgcaggcgctcggccaggctgaggcgggtggccttgacctcgttgtagaccaggccgtaggttgccttatactgctgcaaatgggtgaggaaggacaggagaacaaacagaaccaccaggccgaggagtggaggggcgctgggcagcggccggccctctgttaaggtgtccatcagcttgtacatgagcaggtacaggatgcccatgccgcccatgacgatcaggttgaccagaaaggtccagaacgtgcccttcttggtgttccgcacgccttggtctgtcaaggcgtatttgcgctgaaagttttgaccgaacattactctacctccctttcgctggtgattttccactggactgcctggttatagtccgcccacatccgggcatacagtccgcctgcggtggagagcaccgaatgagacccctgctccacgatgcggcccttgtccaggacaagaatctgatccgcccccaccacggtggacaggcggtgggcgatcataatgaccgtgcggccgcgggtcagttcggacagggccttctggatcagtgcctcgttctcagggtcggcaaaggcagtggcctcgtccagcaccacgatgggggcgtccttcagaatggcccgggccagggccacccgctgctgctccccgccggagaggtaggtcccctcggagccgatctgggtgtccatgccctggggcagtttttccaggatatccccgcactgggcggccatcaacgccgcctccacctgcgcccgggtggcctccgggcgggcggcccggacattttccagaatggacgtcttgaacaggcggctgttctggaagacaaaggcgatctggtccatgagcacatgggggtctatctgcgtcacgtccacgccgcccaccttcaccaccccggaggtggcatcccagaaccgggggatcaggctggcggcggtggttttgccgccgccggagggccccaccagggccaccgtctgccccggctccacggtgaaggagagatgggagagggcgggggaggccgcgccgtcgtaggtgaagctcacgtctgcaaactccacgcggctgtcctggggtttctggggccggggaggctttttcagcgtgggggcgcacatgacctggtcaatgcggcccagggcggtgctggccagcatcatgccggcggaggcaaacatgatcctggcgagggccgtggagaggatggcggagaagaccgcgtagaaggcgaaattggtgacaaatccggcaaaatcgccgccggccagggcgctgggcgccaagaacagcgccaccggcaccaggaacacgaaggccccttcggtgaaggtcaggttgagggactgggggacccggcacaccttgtcctggtagtattccgatttgctgctgtacgcctcaatggcctgctggaaagccttgaaggagtagaccgtctgctgaaaaatcttgaccaccgggatgccccggacgtactccgtgcccgccttggtcatgcggtcctgggctgcctggtactccgccatcagtttggcgtttttgccccccatcatggagaacatggccgccaccgagatcaccgccgccagcaggcaggcggcgcccatccgccagtcaaagaggaacatcatcaccagcatggacacaaacagggtgatggtgcccacgatgtccgccaggttgtgggccagcagcgtttccgtctccgccgccgccgcgtccagccgcccccggatgaggcccgaggcgttggtgtcgaaaaagcccaagggggcctgcatcatgtgggccaccccccgcttgcggatgttggacgcggtgcggaaggccgccaggtgggtgcacatgagccccgcgaagtacagcaaaatgccccccaccgcaaacgcaaaggccagccagccgtaccgggtgatgccctgtgcctgggtccagtccggtgccacggcgatcaggtcccgggccaccagccagatacagaggtagggcaccatgctcagcagcatagacaccgccgacagagccaggcccaggaaggtcagccccttgtggctgcctgcatagtccagcaggattgccacactgctcttctttttttccttcattgagaaacctcctttttggttagcttaagctaacttaaaatcaaaaaagataggggccgctgcccctgcggaagtctgccgcctgccgcgaaagcccctgcacgaccacagcccgggcggcgcagaacggagtttgcttacgctaaccgaagtatagcacacaagagcaccggggtcaatagaaatcgggggtttcagcgttgccggggaggcagatgcctcccgttgtttcgaggagcggggccatttgccggggaggcgggacggtggacggaccaatggtgcagcgccctgcccgcctgtttaatttgtagctgatcctctgactggatgatcttctttttatatataaggtatgaaaaaatagaaagtatgcgaaaaaccgttgacttgaatattcggggggcttatgctatagttgtctttgtatgattccacggatcaccaggtccgtgatcttgtcaaacctgactgccatgccggaacggggcaggcggtcaggcggggtccaggcgcaagcggtatggcgcgtgcccggggccccgtcccatggaaatatcaacaatacagcataccggcagggattctgccggtatgttgtggcattccccgcccaagaggcggttggaggagcgatggagagtattacaagcagaaccaatcccctcatcacccgcatccgcaagctgaccggggaccgaaagtaccggcggcgggagggggtcatggtgtgtgaggggcccaagatgctggccgaggccctccggtggggggccgggctggagaccattctgtggcagaccgggacccatccccccgctgggattccccagggggtccgccaggtggaggtgcccggggacctgctgcggtccgtggcccccaccgagacgccccagcaggtcctctttctggcgcgtctgcccgcccgggccctgccggaggagctgaccggcagccggtatttggtgctggatggcctccaggacccggggaacctgggaaccttgtggcgcacggcggacgcctttggggccgacggcctccttctgctgcccggctgcgccgatccctggagtcccaagaccctccgggccaccatgggggcctgcttccgcctgccggtgtgggaggggaagctggaggacctgctgccccggctggcccgggcgggccttcccctgtatgccactgccctgggggaggacacccaggacatccgcaccctgcctctgggccgggccgcggtggtcatcggcagcgagggccggggggtgtcgccggcggtgctggcggccagtgaaaagaccttgcaaattcccatgacagagcgctgtgagtccctcaacgccgcggccgccggcacggtggtgctgtggcagatggggttcggcccggtgggatgaggatattgtgccatcggcagaagggaggggcggcagttgagcagtctgcgccactgggtttggctgagcacccggggacctgccccggggatgtacgctgcccggattctgcatcattttggcaccccggagggggcctactttgccgggcgggaggagcttcaggcctgtccgggcctcccggagaaggtccggcaggccctggaggacaaggacttgtcccaggcggaccagattctggcccagtgcgaggccctgggcatctgggttctcacctgccaggacgcggcctatccccagcggctgggccagctggacagcgctccctgcgtgctctatggccggggaaggctgccccagatggaccaggaggccgccgtggccctggtgggggcccgccaggccagcccctatggaatcatggccgccggccggctggggctggatttggcccggcagggggccctggtggtcagcggcatggcccagggggtggacgccgccgccctccggggggcgctgcggggcggcggccgggtggtgtcggtgctgggcagcggcattgacgtgatttatcccgccggacatggggacctctatgaggacgtggcggcggccggggcgctgctcagcgagtatcccccgggcaccccgcccaccggcccccattttcctgtgcgtaaccgcctcatcgccggcctgagcctgggggtgctggtggtggaggggagccagaccagcggcgccctcatcaccgcccgatgggccctggagcaggggcgggatgtgttcgccgtccccggggggatcgacgcccccctgagccaggggcccaacggcctgatccggcggggagaggccaagctgatccaggacgcctgggacgtggtggaggaatatgcggccctctacccggataaactgcatccaaagacacccttggcccccggggcggcccgggcccggctggaggggcgggagagtccgcccccagtaccgccccagcagaaggaacccgccccggcccgcctggtggtggacctgggcaaggacccggaggccctcaccgacgaccaggccgccctgctccgggcgctgcaggccaggggggaacagtccgccgacgacttggtggaggccacgggcattcccgcccggcgggtgctctccgccctcaccctgctccaggtccgccagtgggtggcggaggcggggcggcggttcaccaccctggtggagctgaaagaagaccgtacccatccccccaggggatgagaccatacaggcggggacagcggggccggcgccccctgaaccccgcggaaccattgtgccggcgccgggagacgcctggtaccggcagaacagaaattcggagggaatcgtgtggcgaaagcaaacttagtaatcgtagagtcaccggccaaagcgaaaaccattggaaaatatctggggcccacctatcaggtgctggcctccatggggcatgtccgggacctgcccaagagcaagatgggggtggacctggagaccggggagtttgagccccagtaccagcccatcaaggggaaggaggagaccatcgcccagctcaaggacgcggcggaccacagcaaaaaggtctacctggccaccgacccggaccgggaaggggaggccatctcctggcatctgaaggagctgctggagctccccgatgacaagaccagccgggtgaccttcaacgagatcaccaaaaaggtggtcaccgagagcatcgccgccccccgggagattgaccagaacctggtggacgcccagcaggcccggcgggttttggaccggattgtgggctatgagctctcccccctgctgtggaagaagatccgccggggcctgtccgccggccgggtccagtcggtggccacccgtctggtggccgagcgggaggaggagatccgggcctttgtccccgaggagtattggaccctggaggtcaccctggaccggatcgcccccaaccagggcagctttaagacccagttttacggccgggaaaagaagctggagctcaagtcccgggagcaggtggaggaggtcctggccgccatccaggacgcccccttttcggtcagccggatcaagcggcaggacaaaaaccgctccccggcgccccccttcatcaccagcaccctccagcaggaggcctcccggaagctgaacatgagcccccggcggaccatgtccatcgcccagcagctgtatgagggcgtggacatcgagggggaggggacggtgggtctcatcacctacatgagaaccgactccctgcgcctgtccgacgaggcggtggccgccgcccggtcttttgctggggcccggtatggccaggactacctcccggcggccccccggcagtttaaggccaaggccggggcccaggacgcccacgaggccatccggccctccaatgtggagctcaccccggagagcatcaagaaggacctgaccagcgagcagttccgcctgtataagctcatctggagccgctttctggccagccagatggccgcggcggtctatgacagcgtgggcatcgaggtgaccagcgccggttatgtgttcaaggccagccggtccgaggtgaagttcccgggctttctggcggtgtacgaggaggggcgggacgaggacgggggagagctccagacccgcctgcccaacctccaggagggggagcccctgaccaaggcggccaccaagcccgagcagaagttcacccagccccccacccggtacaccgaggccaccctcatccgggccctggaggagaaggggatcggccggccctccacctacgcccccaccatcaccaccattatgaaccgggagtatgtggtcaaggacggcaagtacctccacaccacccccctgggggaggtggtcacgggcctcatgaaggacaagttccacgacattgtggactatgatttcaccgccgacatggagagccgcctggacaaggtggagagcggggaggagaactggaaaaaggtcctgcgggacttctaccaggacttcagccaggagatgaaccaggcggaaaaagatctggatggcacccggatcaaggtccccgacgaggtctccgacgaggtctgcgacgtgtgcgggcggcagatggtggtgaaatccgggcggttcggccgctttttggcctgcccgggcttccccgagtgtaccttcaccaagcccctggtcattgagatgcctggcaagtgccccaagtgcggcagccggctgctgaaaaagacctcccgcaacggctacacctactacggctgtgagcacaacggggacaaactgggccgggcctgcgactttatgacctgggatgtgccggtgaaggagacctgccccgagtgcggccagaccatgttcaagaagtccggccggggctttaagaagcccttctgcatcaacgaggcctgccccgcctttgtccccgaggagaagcgggggggctaccgcaaaaagaaaaccgaggaggccaaggccgaggaccaggccgcccccgcccaggagaccgccccggcggaagaggcggcggagaaggccccggccaagaagcgcaccgccaagaaggcggcgggggagaagaagaccgccgggaaaaagccggcggccaagaaaaccgccaaggccggggaggccaagccggcggccaaaaagaccgccgccaagaagaccaagaaagccccggaggagaccccgggagagccggaggagacgccatgagagagcctgtcaccgtcatcggcgccgggctggccggctgtgaggccgcctggcagctggcccaggcgggcatccccgtggtgctgcgggagatgaagccccggaaaaagacccccgcccaccatgccgacctgtttggggagctggtgtgctccaactccctgcgctcggaccagctggaaaacgccgtgggcctgctcaaggaggagctgcggcggctgggctccctcattctccggtgtgccgacgagcaccgggtggccgccgggggcgccctggcggtggaccggacggccttcgcccaggctgtcaccgacgcggtccgaagccatcccctcatcaccgtggaggagggggaggtcaccgccctgccggagaccgggcaggtcatcgtggccaccggccccctcaccgccgacgccctggccggggacattgcccggcgctttccgggcagcacagccctgcacttctacgacgcggcggctcccctggtgacctttgagagcatcgacatggacagcgcctggtttgcctcccggtacgacaagggaaccgccgattacatcaactgccccctgacccaggaggagtacctgaccttctggcgggaactgtgcgcggccaaggaggcccctgtccacggctttgaggacaggaacgtctttgagggctgcatgccggtggaggtcatggcccggcggggggagcagaccctgtgctacggccccttaaagccccggggcctccgggaccccaagacagggcgggagccctacgccgtggtgcagctgcgccgggacaacgccggcgggagcatttacaacttggtgggctttcagacccacctgacctggccggaacagaagcgggtgttctccctgatccccgccctccggcaggcggagtttgtccgctacggggtgatgcaccggaacacctatttggattccccccggctgctggaccggtactaccgggtgcgcaccgagccccggatcgtctttgccgggcagattaccggggtggaggggtatgtggagtccacggcctcgggctttgtggccgccctggagctggcccggcggctggagggcaaggcgcccatcgactttcccccggagaccgcccttggggccctggccctatatgtgagcaacgagacggtggagcacttccagcccatgaacatcaacttcggcatcatgccccccctgggctaccgggtgaaggggaaacggaataaaaacgccgccctgtcccagcggtccctggagatcctggcggggttggaagaacttggaacaagaaagaaggcgtacctatgagaatcatcgtggatgccatggggggcgacaacgccccccaggcccctgtggagggagccctgcgggcggtccgggagctgggcgtggaggttctgctcaccggccggccggcggagatcggggcctgcctggccaagctgggccacaccgccccgcccccgggggtggagatcgcccccgccagccaggtcattgagatggaggacaaccccgcccgggcctttaaggacaagccagacgcctccatgaccgtgggcctgcgcctgctcaaggagggccggggggaggctttcgtctccgccggttccaccggagccctgctgtcggcggccaccctgctcatcaaacgcatccggggcatccgccgggcggccctggccccggtggtgcccaatgccagggggaacatggtcctcattgactgcggggccaccgccgagggcaccccggagtacctgctccagttcgcctttatgggcgcttactacgcccggcggtttctgggcatcgagaacccccgggtgggcctgctgaacatcggcaccgagccaagcaagggcatggagctccagaaggccgcccacgctctgctcacccaggcccacgaggccgggcgcatccgctttgtgggcaacatcgagggccgggaggccatcagccagggggcggcagacgtgctggttaccgacgggttcaccggcaacatcttcctgaaaaccgtggagggggcggcctccctcttcagccacgccctaaaggacatgctcctgggcagcaccaagaacaagctggccgccctgctgctgaaaaacagcatcggggctttcaagaaacgctttgacgccaacgaggtggggggcaccgccctgctgggcatctctcagccggtcatcaaggcccacggctcctccaatgcctacgccttcttcaacgccatccgccaggcccaggtggtggcccaggcggacattgtgggcgacatcgcggccaacgtggcccacatgcgcctggaacccggggagaaagaggggtaatttttccaatttgctattgacagaacctgaaatagtccctatattaagtacagcatccccagtaaaatggattccaaaaaggagcagttcgatatgattttagagaaattacagagcttgattgcggatcagttgggcgtggacggcaataccatcaccatggacaccaactttgaggaagatctgggcgttgattctctggatatcgtggagttatccatggccctggaagaggaatttgacattggtgagatgagcgaggaggatctggcgggcatcaaaaccgtgggggatctggtgcgctacttacagggcaaactcgatatgtaaaattggcaagactgcctgcaacccccgtccagtggccgggggttgtgtgttgaagggggaagagaatgaagacattggaagagaagatcggctattccttccgggaccggagcttgctggaaaacgccctgacccacagctcctacgccaacgagcaccgggccgccggggtacccagcaacgagcggctggagtttttgggggactccatcctggggctggtggtggccgaccacctttaccgcacccggcccgacctgccggagggggacctgacccggattcgggccgccctggtgtgtgaaggaagcctggtgcaggtggcccaggccctggacctgggcagttacctaaaactgggcaagggggaggaccatggcggcggccgggcccgcccctccatccaggccgacgcggtggaggccatgctggccgccgtctacctggacgggggcatcggccaggtgcgcaagctcatccaccgtctggttctggaccaggagcaggagaagaccgccgccggccgggactataaaaccgccctccaggagctggtccagcgggagaacggccaggtgctctcctatcgcttaaccggagagtccgggccggaccacgccaaggtctttgccatggaggtccttctcaacgatggggttatcggcagcggccagggcagaagcaagaaggaagccgagcaggccgccgccaaggcggcggtgctgacgctggaaggggaggcgccatgaaagccagccggagaaacattgtcatcgccgtggtgctgctggcggtgctgctggtgctgcctttctggcccaaaatccgccaggccctggccccggcggcaggggaggaagtctcctgcacggtgacggtggcctgccaggcggaggccctgccggagctcagggcggcaggggttgcgctggaggcggatgggaccctgttctccactccctgtacggtgacggagaacagcacggtactggaggcattgaaaaccgccgccaaagctgccggctgcccggtgaccacccagggcagccccgcttacgtcaccgccatcggggacttggctgccggggcccatggggaggcctcgggctggacctataccgtcaacggcgagatggtgatggacagctgcgacacacggacggtccaggcgggggaccagattctgtggacctatgtgaccgcctggacataacagcgacaagacccggacgcgcagcagaggagcgcgtccgggtctttccccaggcaccggagagaggaggcggagatttctgtgaaaccaaccagacaggagacggtccggcggtatggcctgctgggcctggggctgctgatcaccgcctttggcattgccttttccatccaggccgggctggggacctcccccatttccagcctgccctatgtggtcagcctgctcacccccctgagcgtggggacggccaccatctgcctgcatggggtgctgatcctgctgcagctcctaatcctgcgccggcggtacgaccctgtccagctgctgcagctgccggtggccctggtctttgggtacctcaccgacctgggggtctgggtgatccagggcatcccggtgccctcctatggggtgcggtggctgctgtgcctggcgggggtgttcctggtgggcgtcggggtggccctggaagtggtggccggggtggtgaccctggccggggaggggttcgtgctggcggtgtgccgggtgaccccctttccctttgggaacctgaaggtggcctttgacgtgctgctggtgggggtggccagcctgctctccctgctgtgcctgcacgggctgtacggggtccgggagggtaccctggccgccgccctgggggtggggctcatagccaaacggctccagccccccttgcaggcctggtttaccaaacggctgccgtagcccagggggccagcaggccggcggtccgctcccccagctgggggaagggcaggaagggggccggggggagggaatgggcccccaggaatttttccatccagaccatgtggtaccaccggccgaacttatagccgcactgatgaaactgccctgccggggtataacccaggcgctggtggaagcggaggctggccagggtgagggtctcgtcctccacctggggcagggcgatgcaggcgttgcagttgaggacgttctgggcggtgagcagggcctccagggccccatatagccggcggcccagcccccggccccgctggtcctgccgcaggtagatggtggtctccgcggcccactgataggctgcccgggggtgaaagggggcggcgtaggcatagcccagcagggtcccctccgcctccgccaccaggtaggggtgggtggccagggtgtcccgcacccgttgggtgaactgggccggggtgggcacggcgtactcgaaggtgacggcggtgtgctccacataggggcggtaaatggacagcaattccccggcgtcctccgggaccgccgggcgaaggtgaagggatggcatgggaaaagacctcctgcacgggaaacgatggcatctatgatagcacaccccgccggcggcggcaacggcggaacgtgaaaaaaggaaaaaaaagacttgacaaggggggaggcaggtgctatactcacggacataaaccgaggaacgggaagagtacacaggacctcgcctttccaagcgagccgcgggcggtgtgagcgcggtagagtgtgagccggtggaatggtcccgggagggcaaaccgaacgcgcccaggcgccagtaggggagacgggggagagcacgccgttaccacgtgccggcacttgttggagtgcgctgagtgggcgcaaatactgcgccaagccgggtggcaccgcagaagctgtcgcttctgtccctgcaaaatactgcaagggacaggagctttttttgtccctgcacatgagaaaggagccaaataccatggcaaatgagacaaaaattccctacaaaatctacttggaagagagcgaaatgccccaggcatggtacaatgtccgggccgacatgaagaacaagcccgcccccctgctgaatccgggtaccctccagcccatgaccgcccaggagctgggcggggtgttctgccaggagctggtggagcaggagctggacgaccacaccccctacatccccatcccccaggagatccgggatttctataagatgtaccgcccctcccccctggtccgggcctactgcctggaggagaagctccagaccccggccaagatttactacaagtttgaggggaacaacacctcgggttcccacaagctcaactccgccatcgcccaggcctactacgccaaaaagcagggcctgaagggggtcaccaccgagaccggcgccggccagtggggcaccgccctgtccatggcctgcgcctacctgggcctggactgccaggtgtacatggtgaaggtgagctatgagcagaagcccttccgccgggaggtcatgcggacctacggcgcttcggtgaccccctccccctcggagaccaccgccgtggggcggaagatcctggccgagcacccgggcaccactggctccctgggctgcgccatctctgaggcggtggaggccgccaccagccaggagggctaccgctatgtgctggggtcggtgctcaaccaggtgctgctccaccagagcgtcatcggcctggagaccaaggcggccatggacaagtacggcatccaggcggacatcgtcatcggctgcgccgggggcgggtccaacctgggcggtctcatctccccctttgtgggggagaagctccggggggaggccgactaccggatcatcgccgtggagcccgcctcctgccccagcctcacccggggcaagttcgcctatgacttctgcgacacgggcatggtctgccccctggccaagatgtacaccctgggctccggcttcatcccctcggccaaccacgccggcggcctgcggtaccacggcatgagcccggtggtcagccagctctaccacgacggcctcattgaggccaccagtgtggagcagaccaaggtctttgaggcggccacctactttgcccgggtggagggcatcctccccgcccccgagtccagccacgccatccgggtggccatcgacgaggccctcaagtgcaaagagaccggggaggagaagaccattgtcttcggcctcaccggcaccggctattttgacatggtggcctatgagaagttcaacaacggggagatgaacgactacatccccaccgacgacgacctggcccagggctttgccggcctgccccaggtggactgagcgcccccgccgcccaaaacccaacgcgccccggacccatggcggtccggggcgcggtttttatggggcggaaccctccggcgcggcgccgggggatgaggacaggggcagcaggaaggacagggtgcccatggtctcattgcgggtataccagagggagccggccagggagacggggctgtccagggcctctctggcccggcccagcagggtgttgagctggccctggtcaaacagggcggcgcaggcggcggggtaggccgcgtcggcatagcggacgctgacctggcgctgcccggcggccagggcccgctggaagagggcggtcagggcgtcggggtcataggcggagaagtagaggccgttgcggaagaagtagttgttgctgttggaggtgcagtctgggacggggaccttgtcgtcgatggtgtgggtgcgcagcaggtcgtcggtggtgaggccgaagtactcataggccggcccttggctgtcgtccccgccggtgaagacagggtcgccccaggtggtgtcgatccagcagggggtgccgtccagccaggccaggttccaggcgtgggactccccctgggcctggccggtgatgtaggcggtgtccacccccagcaggcccagcaggtattgggtggtcttggcatagcagccgcacaggcccgcgccgcccaccatgatgttgacaatggagttgttgtccaccacctggtagtcggcgtgctggatgatgtaggtgaagacccccagggctttgtcatagtccgaggccccctgggggatggtggcaaagcagtccgccgcccactggtcgatctgggcctgggtggcctggcgctgggcctggtccatggtgtagaccggcgtataggccgcctccaggggcttgcccgccagcagggtggtctcaatttgccccgtgccggagaaccagaagagctcgggatagtcccggtcgatggcgtcgatggcggtctggatcatctccgtgtcggggtagaggtccccgatggtctcctcctggttctgaaggccggccagcagctggtcgtagaggtagcgttcctggccggtgagggtggtcttggtgtagcggaagccgtcctggaggccggtgtagtcctccgggggcggaggaagggcgccgccgtgggccaggcgctccagggagaattcgcagccggtgagcaggaccagggccagcaccagggccagcagagggggaagggcgcgtctcatggccgcctcaccccttccgggccagacagcggcggaccgcctgggcaatggcgtcggcgttcaggccgtaccggaccagcagggcctcggggggaccgctctccccaaaggtgtcctggacggccacagcctccatgggcaccgggcaggtgcggaccaccacctcggagaccgccccaaagagtccgccggccagctggtgctcctcggcggtgaccaaggccccgcaggaccgggcggcctcctggatggcggcctcgtccaggggtttgatggtgtgcaggtccaccaccgtcagggagatgccctgggccgccagcgcctgggcggccaccagggcctcatagaccatggccccgcaggccagcaccgcgcagtcccggcccctctggaccaggcgggccttgccgatggtaaagggggtggtctcgtcggtgatcaccggcacggcctcccggccaaagcggaagtagaccggccccggccagtccacggcggccaggacggcctttcgggtctgcgcgctgtcacagggggcgatcaccgtcatgtggggcagcacccgggccagggccaggtcctccagcgcctggtgggtggccccgtcagggcccacggagatccccgcgtgggcgccgccaaagcggaccttgaggttgttgtagcacacggtggtgcggatctggtcaaaggcccggccggagaggaaaaccccgtaggtggacacataggggatctgcccccccagggccaggccggcggcggtgcccaccaggtcctgctcgctgatgcccaggttgtaaaagtggtcggggaaccggtcccgcacccagttggtgcgggtggaggcggccacgtcggcgtccagcaccaccacgtcggggcgggcggcgcacaggtccagcaggccctggccgtagccgtcccgctggggaatccggggaatctggttccagttcatagggtacctccttccgccagctctgccagggcggcggccagctcttggtcgttgggggccttgccgtgccaggcgggctggccctccatgaaggagacccccttgcccttcacggtgcgggccagcagcacggtgggacgcccccgggtggcggcggcctgccggaaggcctcggccagggcatccaggctgtggccgtccacggagagcacctgccagccaaaggcccggaacttgtccgccaggggggccacattcatcacttcacaggtggggccgtccaactggaccccgttgtcgtccacaatggcgcagacggtgtccagggcgaagtgggccgccgtcatggcggcctcccacacctggccctcctggagctccccgtcccccagcaggcagtaggtccggtaggtccggccggtgcgccgggcggccagggccaggccgttggcgatggacagaccctggcccagggaaccggaggagcagtccaggccggggagcttggccatgtggggatggccctgcaggggggagcccagctggcgcagggtgggcagcagggcggggtcaaaatacccccggcgggccagcacgctgtacagcaggggggcggcgtggcccttggacagcaggaaccggtcccggttggggtcgtcggggcgggcggggtccaggcgcatctggccgaaatagagactgaccagaatctccaccgccgacagggagcccccgggatggccggagccggcggcatgggtcatggacaggatgtcccgccggatttgccggcagagggcgggcaggtcgtgtgtcatggaaaaacctcctgggtccgtgatggaaaaacttactaagaaaaaagtaccatagtgggcggagattgtcaatcagcgggcggcccgctggtcttgtgtccccagacggtgggagaaacgggtcgaaccctgtcgggcgggcaggtgaaatccacaaaaaatttcctaaagattgccgtttttttagcgggagaatgggaggaagtgacaagttgtacaaaagaaacccttttatggggaaaagaacttgacaatggagcaaatcggcgtaatattaaccattgcaaagacttacaagggaatattgggcaaacccagtgaaagctggtgacgcaaagctatagggtctacgtttctccgcacggaagcatgacagccagttgcagcaatcccataccggttccaggggaatcggtatgccttgttttttactcaagggcctgcaagctttcgtcttgtgggttttttgcaggaaaaaataaggaggtattgaggaagtgggcacgtattacgtgacgaaggagagccaggagatagcgggctgtcgcttgatccgatacggcatcggttgccgatggcgggagattcttgggctctcccacaatcgccaggcagtggagtggctggtggaacgttgcaacaccctggagctggaccccatccatctggaggatgtggtgcaggattttctatgggaacagggggaaccgatgcgaacgattgcgggttgaggtgagaaaaatggaagagaaacgagaggggtcccgatccctgtcccagcaggaggaggacgcgttgcagtccattgcccgcagtgacctggggggcttgttcaaggcgagaatggacgagggctttaccctcctctatgccaacgacagctactatgccatccatggttacacccgcggccagctggagcaggagatgcatgggcaggcggtggggctggtgcacccggaggatgtggcgtgggtcagcgagcacttgcggcgggccctggcagaaaaccaggggaccgtctcttttgagtaccggatcgtccgccgggacggagcggtggtgtggcttctcatcagcgccgggctgtcccaggaggacgggggcatggttttaagcgggatgattctggacatcaccgcccgcaaggccatggaggaccggctccgccggagtgaggaacggtttcagatcgcggtccgccaggcggggatcagcgtgtgggagtatgacatcccggcccgcaggctctactcctcggtctccacccagggccatggggaggcctgccctgttgtggagcaggtcccccagagcctgatcgacagcggctatgttcaccccagcggggtgaaggagtttcaggggatgcacgaggccctccaccggggggagcccaccgccagctgtgtggtgcaggtccgctccccccaggggggctaccgctgggagcgcatccattacaccaccctgtttgacgaccgccggaggccggtctgggcggtggccattgtggaggatgtctccgaccaaaagtatgccgagcgccgctgcatgcaggaggagcagctccgggagatgctgtcggtggatgtgctgatctccggcaaggtcaacctgaccaaaaaccaggtggaggagctgtggggccaccggtcctttccggcggcgtttcaaaaggtgcaggactgcgacggcctcttccagctcatgggggagtatctggccaacgccgaggagcgcaagcggtaccgggcgctcttccgccggcaggccctgctggccaagtaccgggcgggggaccggggaatctggggggagtaccggtgcgtgaactttgacggggagatcctgtgggccgccctccgggccaccatacacgaggacccggagacgggggatatcctcctgttcggctacgtccgggacatcgacagccggaaaaagacggagctggccctgctggagcgggcggaaaaggacggggtgacgggcctgtacaacaaggccaccattcagaccatgatccagcgcattctccaggagcgccgaggcagcggcggccagtgcgccctgctggtcatcgacctggacaactttaagcaggtcaacgaccgctacggccatcttcagggggacaagctccttcaggagatcggccacattctccacgcctccttccagcaaaaggggctggtggggcggattggaggggatgagttcgtcctgtttttgggggagatccccagcgaacagtgggtcctggagcagacggacgccctgtgccggatgctgaacatcgcctatgaggccgcagaggaccatgtcccggtgtcggcctccatcggcgtggggctggccccccacagccaggcccagtatgaggagctgttccgtcaggccgacgccggcctctaccacgccaagcagcaggggaaggcccggtacagctgctgccgggacgagggctttctggagggggagggcacggtgacctccctccagtgcgcggccaaggagcacctgggcacccactgcatgctcgatgcgctggaggacatgctctttgtgatcgacctggagacctacgagatgcgctatatgaatgccccggcccgggccgccttcgggtatgaggagggggcgtacgcgggcagaaagtgctaccaggttctccagggcttttcccagccctgcgtcttctgccagaaccacctgcccagtgagcagggattcaagacctgggaaaaccagaatgtccgccttcaccggcggttcctcatccgggacaaaatcattcagtgggacggccggcctgcccggctggagatctatcaggccccggcggcccaggaggaggccagggagaacgccgaacacgtgctgctggagatggcgggccttctgctgtcggcagagagcctggaggacggcatccagggcaccctggagcggctggggggcttttatggggcggaccggtgctacgtggtccaggccagactgggggagaggacctttcaggcggcccagcagtggcagtctcctgccctccaggcccgggggaacgccgccgcccagaccctggagggggccgggtggctggagcatctcaaggcccgccacctggtggcctgccacgacgtggagcagctgcagcaggtctttcccgagaagtaccgggacatgcgggcccggggggtacggtccttctacgccgtggccctgctggaggagggggagctccggggttacctgggcatcgacaacccccgggagcggttggagtgcaccaccatgcttctctccctgtcccactttctgatgggggagcggagcaagcgggaggggaaggcccagaacgctttcctccgcagccacgacgccctgaccggctgcctgaactgggagcggtacaacgactatctggtggccttctccaatgatgtctcctcctccctgggggtgcttcgggcggatgtgaatcagctggcggagctcaaccagcgccggggcaaagaggcgggggaccggatggtctgccatgtggcccaggtgctgcgccggcggtttgggccgggaaatgtctaccggataaacggggatgaatttgtggtcttccgcaccgatgtcacctaccgcaagtttgccggggatgtggaggcctgccagcagctgctggaggagcaggcccccggggcggtggccttcggctggacctgggccgaccaagacattcagatccaggggatggtccaccacgcgggagaggccctccagctggaaaagcagcgccatggaaaggggaagggggcctggggacagcaggccttctggggtctggaggaggcctttgccaaggggcattttcacatatacctccaacccaaggcggagattgccagcgggcggattcggggggccgaggcccttatccggtaccgggatgaccaacacggggtggtgggaccggataagttcatcccccagctggagcggtcggggcttattcgtcacatcgacctgtttgtattggaggaggtctgccggaccctccgccggtggcgggagcagggggtggagcccatccccatctccctgaacctctcccggtacaccctgatggagaaggggattctggcccggatcaatgggatcaccagccggtaccaggtggaccggcggctgctgaagctggagatcaccgagtccattggggatgtggaacggcgcatcctggaggagatcagccgggagattgtgggggacggctactgcctctccctggacgactttggggcccagtacagcaacctgtccattctctccagcctgcagctgagtgagctgaagattgacatgagcatcatcaacgacctctactccaaccagaatacccgtatcctggtggagcatttgatccacatctgccgccagctgggcattgacagcgtggcggagggggtggaggagcgggaacagctccaaatcctggaggacattggctgtacctatgcccagggctacctctacaacaagcccatacccgtcccggacttcgagcggaagtacctggcgggcccggggaatgacccttgacaaatgggggaacttgccggataatggggctacaaaatccacgggttgggagggaagcagcgtgaggcagtgtatggattccgacaatctgcaccggcgcctgaaaaagatcatcggacaggtgcaggccattgaccggatgatcgacgaggacatcccctgcgaggacatccttgcccagatcaacgccgccaaatccgccctgcacaaggccggccaggtggtgctggagggacacatcaagcactgcgtccgggacggcctggagcacggggacccggacctcaccatcgccaagttcaccaaggcggtggagcggtttgccaacatgaactgaccacaccggcccagccggcgggaggagacagcctcccgccggctttttttgcgggtccccttgacaacatatacccctatgggtataatggggctgtattcagttaggggaagataaccttcccggcaaacggaacagaaaagaggagatatccatggaaaaactggaagccctcctggactgggggggcacgcgaaaggacgtggcctgcctggtgctggggggcgcggcgctgctggccagcctttttgactggctccccctgccctttgacccggcctggatcgccattgtcctgtgcggggtccccatcgtgctggaggcggtgatcggcctggtcacggcctttgacatcaaggcggatgtgctggtctccctggccctcatcgcctcggtgtgcattggggaggactttgccgccggggaggtggccttcatcatgcagctggggggcctgctggaggacctgacagtggccaaggcccgggcggggattgagaagctggtccacctcaccccacgcaccgcccgggtgctctccccggcaggggagaaggtggtcccggcggaggaggtccaggtgggcgacctgctccaggtgcgccctggagagaccgtcccggtggacggggttatcaccagcggccagacctccatcaaccaggcggtgatgaccggcgagtccctgccggtggacaaaggggtgggggaccaggtctccagcggtaccgtcaaccagttcggcgcctttgacatgcgggccaccagggtgggccaggacagcgccatccagcggatgatccgcctggtccagtccgccgacgcgggcaaggccaagatcgtcaggctggcggaccggtgggccacctggatcgtggtcatcgccctcactgcggcggccctgacgtggctcatttccggggaaatcatccgggccgtgaccatcctggtggtcttctgcccctgcgccctggtgctggccacccccaccgccatcatggcggccatcggcaacgccacccgccacgggtttttggtccgggaaggggacgccctggagcggctggccggggtgtccaaggtgacctttgacaagacgggcaccctgaccttcggcaccccccaggtggtggccgtggaggcggcgacggtggacgagaccctgctgtacacctacgcggcctgtgcggagctgcgctctgagcaccccttgggcaaggcggtggtccggtgctaccgccaggcggtgggcaaggagccgcctcagggggaggattttcagatgctccccggccggggggtccgggtgaaggtggcgggggtctccgtggtggcggggaaccccaagctcctggaggaggcgggcatccccctggacccgggcgttctggcggcggcccaggcccatctgcgggagggctgcacggtgatctactgcggcgtggacgggaccctggcgggctttctggccctgtcggacaccctgcgcccccaggcggcccaggtgatccagcggattcgggccgccggcccggaacctgtgctgctcaccggggacaacgagaacgcggcggggcacatcgccgggcagctgggcatccagaccgtccgcgccggctgcctgccggaggataagctccgctacatcgacgactgccagcaggcgggggagccggtctgcatgatcggggacgggatcaacgacgccccggccctgaagaaggcccatgtgggcatcgccatgggcggggtgggcagcgacatcgccgtggacgcggcggacatcgccctggtaagcgacgacattcaggagttgccccacctgctctggctggccaagcggatgatggggaccatccggtgcaacatgtccttttccatggccctgaactttgtggccattctcctggccatagggggcattctgaacccggtggtgggggccctggtccacaacgccgggtcggtgctggtgatcatcaactccgcctttctgctgcattggaagaaaaaagcctgacccctgccccagggggcgcggagccggaaagccgttggctttccggctttttttcttaaatctttctaaaaatcccccttctcctggagatttatggtataatcactttcgtctgacgaaagcagaccgcccccccgtccggcgggggacggctgaccccatagagaaagttgagaacgttccatgcttgttaaaatgtttcacggtttttgcatggccctggccgacagcgtccccggggtgtccggggggacggtggcctttatcctgggcttttatgaaaaattcatcgacgccctccacggcctgttcggcaaggacaacggggcccggaaggtggcggtgctctacctggccaagctgggggtgggctggtgcctggggctgtgcctgtcagtggtggccctgaacgacctgttccagaccaagacctatttcctcagctccctgtttctggggctgacggcggcggcctttcccttcatcctgcgcaccgagtggtgggccctgaaggggaaggggcgctacctgccctataccctgctgggggtggccctggtctgcgggctgtccctggtgcggggggcggcctccgggggcggggtcatcgactactggagcctgggggtgggggagctgctctacctctttgtggccggggccctggccattatggccatggtgctgccggggatctccgggtccaccctcctgctgatcttcggggtgtacgcccccaccctgtacgccctgcggcggctgctggccctggacctggcggtcctgcccgggctgttcgccctggccctgggggtgctggtgggggtgggggtgtccatccggtggattcgggcggccctgcggcggaaccgggccaagatgctctacttcatcctgggcctcatggcggggtccctctatgccattgtcatgggacccaccaccctgtctcccccccagcaggccctgcacctggagaccttccacctggggggctttgtcctgggggtggggattctcattgggttggagcggctgaagctcctcatcgcccggcgggaggcccgggcggaaaagacagaggacgggacccagggggaagaggaggcccagagcggcggcagcccccaaggacctgcttgacagagagaaagcaggagagagtctttgactctctcctgcttcgtttttttttcagctgggctcaggacagcaggtccagcagctgggcgatggattttttcccgaagctcacctgctggccgtggttgaccaccaggcagggcacgctcatcaccttgtactggtcccgcagggcggggaagtggttcaggtcataggcctgggcggtgatgtgggggttggccgccgccagccgctgggcggcggtgaccagctcggggcacatggtgcaggacagggagaccaggatttggaggtctgtgggctgctggatggcctggatggcggccatggtggcctcgtccagggcctggcccgggccggcggcgttgtagaggcccaggacaaaggaggtgaactcgtggccccccggcaccccgtggaaggccaggccggtccaggtgctgtcggcccggcacacccggacgcagggggcgtcctgggcggtaccatcggtgcggagggtgagcttgtccgtgtaccggcacagggcctgcatataggcctccagctcctgggacaggggggtgctgtccagggtgagctccagcaccagggaggcggtcatccgggagaagaccgtctggagctgggcggccatctccggggggaacaggccgcccgcctccgtcccctgtccctgtgccgtctgggcgccggcagggggcgccgcctgaggggcctgggggcgcaggccggtcctctgctgggcggccgcggcgtacttctccagctccgtggcggccagggccccgtcacccacggcggtgaccacctgacgcaggggcttctggcacacatccccggcggcgtagaggccgtcggcggaggtcttctgcccccggtcggtgaggacatagccctgttcgtccaggtccgccaccccctggaggagttccgtggcgggctggtagccggcaaagacgaacagaccgaaggtctccccggcggggggccggtactcggtgacctggccggtctcggtgttccggtagcggaggtagcgcagggcgtcgtcccctcccacctcctccacctgggtgtgggggaggacggtgatcttttcatggtcccgggccgcctgggcggtggactgggcgcaggagaagtccgccccccggatgaggatggtcacatggcgggcgtatttggtgaggaagacgctctcctccgcggcggcaaagccgccccccaccacaaagacctccttgtcggtgaagaactctccgtcgcaggtggcgcagtaggccaccccccggccccggaaggcctcctccccctggaagcccaccatccgggggtgggccccggtggcccagaggacgccgaagcaggacaggtccccccggctggtgcggacggttttcacatcccccgccaggtccaggccggtgacctccgccaggaggaactccgccccgaaggactgggcctgctggcgcatggtctcggtgagctgggtgccgctggtgtgggccacgccagggtagttcaccacctgctcggtgatggtgatctggccgccgaagcgctccttctccaccaccagcacccggtaccgggcccgggccaggtagagcccggcggtgaggcccgccgggccgcccccgatgacgatgacgtcgtagagtctgctctggtccatcacagctgccccaccaggtccaggctgggcttcagggtctcggcgccgggctgccatttggcggggcagacctcgtccccgtgctcgtggacgaactggagggcctggaccttccgcagcagctcgtcggcgttgcggcccacgttgccggcgttgacctcataggccacgatcttcccctcggggttcaccacaaaggtgccccgctcggccacgccgtcggcctcgatatagacctcgaagtccttggccagggcgtgggtggggtcggccagcatggggtactgaatcttctggatgcgctcggaggcgtcatgccaggccttgtggacgaaatgggtgtcgcaggagacggcgtagacctggcagccggcggcctggaagtcggcgtacttgttggccaggtcctccagctccgtggggcagacgaaggtaaagtcggcggggtagaagaagaacaccgcccacttgcccaggacatcggccttggagaccgtctggaatgccccctggtggtaggcctggacgcggaaatcgctgatttctttctgaatcatggacatgggtatgaccctcctttgaaaacgaatgagattatgaaattagcaaaagctaactaatgggagtatagcatggtccgaggacagatgtcaagaaaaaggaaaatcccccttgacaaaaatccggtttcggattatagtatggtccgaaaccggatttttacctgaggagggggcccgatggaggagaaccgacagatcatgcgcgcgctggccacggccatgaaccgcattgaccagatgtactgcgacgatgtgacccggatcggggtgaaggcgtcggagctgtggctgctgtacgccctggacgacggggcgccccactcccagaagcagatctgccaggagtgggggctgcccaagaccaccctgaacaccaccctgaagcaggccgaagccaaggggtatctgaccctcgtccccatcgcggggaagcggcgggagcggcagatctgcctgaccgccgccggccaggcctacgcccgccaggtcctccgccccatctacggggcggaggatgccgccctccaggccaccctggaccggtacgggccggcggtggtggccgccctggtggaggccgtggattacttcggccggtgcctgcgggacagctttgccaaacaaatggaggaaaaggagaacgacgacaacccatgagaacctttctgcgatttttgaagccctaccgggggctctgcctgctgaccctgttggtcatggccctggacgtggcgggggcgctgtacctgcccaccatcgtggccgacatgatcaacatcggcgtggccgggggggacctggactttatcctgcgcaagggcgggctgatgctgggggtggccctggtctccggcgggggcaccctaatggggtgcttcctgtgcgcccggctctccgcccggatcgggcgggacatgcgcaacgccctgtacgacaagtccctgaccttctccgccagtgattttgaggggtttggcacgggctccatgattacccgcaccctcaacgacgtgaacgtggtccagcaggcctttgtctggagcgtgcagatggtgctgccggtgcccctcatgtgcgtcatcggggtgctcatggccttttccatcgaccacgtcatggggctgctgctcatcggcatcaccctggtggtgatcctgggggcggtgctggtgacccggcgggcctcggccatctttgcgcgggcccagcggtttctggaccggatcagcgtggtggtccgggagaacatcaccggggcccgggtgatccgggctttcaacaaggccacgggggaggcggggcggatgcgccgctccttcaccgactacgcccaggcggccatccaggccaacaccctgtttttcgtgctggagagcctggccatcttctttctgaacctctgcgtggtggccatcctctggctggggggcaaccgcatcggcgggggctttatggagatcggggacatcaccgccctgaccgagtacgcggtgctcatcctcttctatgtgatgatggcccagatggtcctcatgctcctgccccgggccaaggtctgtctggagcggattgacgccgtcctctcccaccggccggagatcaccgacggcgccggcagcctgccccagacggaaggggaggcggtctgcgccttccagcacgcttggttccgctttgccgacgccgacgaggccaccctccaggacctggactttgtcctgcgccggggccagaccaccgccatcatcggcagcaccggcagcggcaagtccaccatcgccaagctcctgctccggttccacgacgtgacccagggggccatctgctttgacggggcggacctccggaccctacggcaggaggacctgcgccagcggatcgcctatgtgccccagaaggcctggctcttctccgggacggtggcggagaacctccgccacggcaacccccaggcgggggaggaggacctccgccacgccctggcggtggcccaggcgggctttgtggacagcctgcccgggggactccaggcccgggtggagcaggggggcaggaacttctccgggggccagaagcagcggctggccatcgcccgggccctgaccaagcgggccgacctgtacattttcgacgacagcttctccgccctggactttcagaccgacgcggccctgcgccgggccctgcgccaggaggtggcgggcagcgccgtgctcatcatcgcccagcgggtgagcaccatcgcccacgccgaccagatcattgtcctggaggatggcagggcggtgggcatcggccgccatgaggagctgctggagacctgcccggtctaccgggagattgcccaatcccaagggaaaggaggggagagctgatggaggaacagaagaagacccagggggaggcagggggcgattccctgtttgacgggggcttcgacaccgccgtgccggagcgcccctgggccaccctcaagcggctctggcacaccgcccaggaccagcacctgcggctgctggtggtggtcctgtcggtggtctgctacacggccttggccatcgccgccccctattacagcgcggggattgtggacctgctgtgggagaacatccagcgggcccaggggctgggggaggcctttgtggtcacctggcggcaggggggacgggagatctttgtgctcctgctcctctacctgggctcctgggggttttacaccttgcagtcctacctcatggtgggctttgccgagcagctgaacctccggctgcgccgggagatgagtgagaagctccaccgcctgcccctgtcctatctggacagccaccagaccggggccaccctgagccacttcaccaacgacatggacaagatgtcggaggccatgcagtacggcatcctgcgcctggtgacctccgtggtgctcattgtgggctcggtggtgatgatgttccggttcaacgtggtcatgaccctgctgtttctggtctttaccctgctgtccatggtggtgaccaagctcttctccggggtcaccctccgccgggccagccggcgccagcaggccctgagccaggtgaccggactggtggaggaggcgtacagcggccgggtggtcatcaaggccttctgccgggagcaggccagcgccggggagattcacagagccaccgaggaactggcccaggccacggagaaggccgactttatgatgaacgccatcaaccccaccgtccggctggtcaaccgcctggggcagatgggcattgccgtctttgccggctggcagctgctcagcggccagctgaccgtgggggtgttccaggccttcttccaatatgtgaaccagtccgccgagcccctcaccgaggcctcctatgtcatcaactccatgcagtccgccttggcctccgccgagcgggtgtaccggctgctggacgccccggaggagcggcccaaccccgccctgccccagcgggtggaccgggcccgggggcaggtggagttccgccacgtgtcctttggctacaccccggaccggccgctgatgaaggacatctcctttgccgcccggccggggcagaaggtggccattgtgggggccaccggggcgggaaagaccaccctcatcaacctcctcatgcgcttttacgaggtggacggggggcagatcctcctggatggagtggacacggcggccatgacccgggagaacctgcgggacaacttcggcatggtcctccaggacacctggctctttgatggcaccatcgcggagaacatcgcctacggcaagcccgaggccacccgggaggagatcatcgcggcggcccggaccgcccgggtggacttctttgtccgcaccatgcccaaggggtatgacacggtgctggggggcgaggcggagaacctctccgtggggcagcggcagctgctcaccatcgcccgggtggtccttcgggacccgccggtgctcatcctggacgaggccacctccagcgtggatacccgcacggagatcgagatcggcaaggccatgcaggccttgatgcgggggcggaccagctttgtcatcgcccaccggctgtccaccatcgtggacgcggacctgatcctggtgatggaccaggggaacatcatggaacagggaacccatcgggcgctgctggcggcggggggcgcgtatgccgcgctgtacaacagccagtttgccgggagctgaccgaaggggactggacgagggccgccgggggaaccggcggtccttttgcgcggtgggggttttctccttgcgccgttggaacggcggggaacgggggcttcccagccggggccctatttctttgaagaaataggggaaagaacaccaaggggaaggaacctccttccccttggaaccccattctctggtgggaggaacgggggaaggtggttccgtcaggtaggggcctggcctgcggcctctaaaaccaacgcctcatggcccgcccaccggctcgggcgggcgggagaagtggtttgttgacgggaggagaaagcgggaaaccgaaaaggttactctccgccttttcccaaagggtatccatccacgtccccagcccgcccagccggtgggcgggccgttacgggcctttcaatgtgagggccgcaggccaggtaaccagcgagaagtacaacttccccccacacaaccccaccagagaagggagtccagagggaagaacctcttccctctggggttctttcccccatttcttcccaagaaatggggccccggctgggcaagccaaggttccctgccgttccaacggcgtaggaaaaaacctgcaacgcgccccgctcgggagagccccgttccaacggcgccggagaaaacccgcaccccccggccaaaaaccacccccaatagaaccactggtttagtccccgccccccaaagaaaaccacacagccatggcccccggcccccggctgtggtatcctatacagcagagaacacaaaggaggcgattccatggagatcggttcggtcatccgagagaaacggaccgcccaggggctgacccaggagcaggtggccacggccctgggggtgtctgccccggcggtgagcaaatgggagcggggagtttcccatagttaaagataccacaccaaatatgatgaacccacgcttatacactaccagctataataaaccgcaaggacagcaatttgatgatactgctgtcctttcttttataaaattgcagtacacataaaaaagctgtaaaatgataaatatatttgtccttgtaacaattctcggacatttgcctgttatactatctgcaaaaagcaaaggaagtgagaatatggagcagattttaattgtcgaggacgacagttttttgaataagatgttagactataacctgaccgcagacggctacggcgtgacttctgccctaaatgccagaaccgcagccgaagccatccgccagcgggaatttgatttagtgctgctggacatcaacctgccggacgggaacggttttgaactgtgcaaactgataaagccccagcacccggacaccatcgtgattttcctgaccgccaacgatcaggagagcgaccagatacggggttatgaggtgggcgcggtggactacatcacaaagccctttgtgatcggggccttgcagcgaaaaatcaaagctatgttcgccatgctggaacaccacaaaccggccaaggacatttacgacgacgggcggctgtttctggacttctcggagcagacggcttccttaaacggcaagcccctgaccctatccccgatggagtataaaatgctgaacctgttccgcaaaaatccccggcaagtgctgacccgtgggcggcttttggaaaagctgtgggatatagacgaaaggtttgtggacgaacacaccctgacaacctccatcagccggattcgcagcaagattgaagccgacggcggcgcgccctacatcaagaccgtttacggcatgggctatcaatggacggggggcgaggcaaaatgaagtttcaaaacctatcggtaaagcggctgtttggccgggtggcaataggacttgtcctttccatgtccgggatcaccatagccctgtttcttgtgacaaaacagacggcggtgctgctgacaggcggggcgctgctgctgtgcgctcttgtggggatttttgtactgacgcaggcgtttggaaagcggctgtcgcagtttaccgctgacctgtgccagaccttagaccacatgatagccggaaatgaagcgccccagcgcccggaggacagcgaaacccagcttgccagaatcggacaccggctggcaaggctttaccagatcatgcaggagaaccgccgccgggtggacgaggaacggcaggagttacagacccttgtatcagatatttcccatcaggtgaaaacgccggtaagcaatctgaaaatggcgacggacaccctgctggaaaagcctatgaccgaggcggagcgcaccgactttatccggggaatccgcagccagacggataagctggactttctctttcaggcccttgtgaaaacctcccgtctggaaacgggcgtgatccagttggataagaagccgggccgcctctttgataccgtggcgcaggccatgagtgggatcgtgtatgcagcggagaaaaaggaaactgccgtgtccgtggactgcccggaggatttgaccgtttcccatgacagcaagtggacatccgaagccctctttaacctgctggacaatgcggtaaagtacaccccggcaggcgggaaaatcgctgtgttggtggtgctgtgggaaatgtatgtagagatcaaagtgaccgacaccggcaagggcatttccgaaagcaatcaggccgccatcttccggcgattttatcgtgaggaagaagtacacgaacagcagggcgtgggcattggcctgtatctggcccgcgagatcgtaacgcggcagggcggctatatcaaggtgatttcggagccgggcaagggttcggaattttccattatgctgcctacaaaatagaacgcggcggacggccatttccggctgcccgccgtaaatttttttgaaatgtccgagcattgtaacatttcccccccgattttcaatgaaattttttggccgctgtaacatttcgcggacatttgggttttacaatacccttatcaaatatggaggtgatacaactatgacatggccttttgagaacgataccagcgtcattgtaaagaaattagcaaaacgcaatgtatcttcaaatcgtattttttgcttttttaatgttttgaccattgcgctggcaattagtttgattgtgggaatctccttattccaacaaggcagcaaaattagtgaacaaaagattttgaatcaaatgcagcaagctaccatcggggggcttacagcagaacagatagaagttctgaaaaaagaacctgatcttgaagatattgtaccctataagcatagtgatagttttctgatggatgggatcaaatttgaagcggtttatatgccgactggttttggaattataaaatcctatgaattagtcagtggaacctgtccagaacagtacaatgaaattgtaattgataaaaatgttcaattagagctggggtatcagctaaatataggagataccatcactttaccaacggcggggagtaaaacagaggatttcatcattactggttttactgataatgtggaaacaggaacattttacttttatgtctccccagcgtatgcagaacagggtgtgttattatctgatattccatatagtgccttgattcgtgtaaatggtgccacggaaatgggacttattgattttgagaatacagtatatcgtctggctttatcccaagacataagcaggaaccaactttattttaatagcaaattctgttcctcacttattagtggatcaggaatgggaggtgttcttttagctactctttttattgcattttcaagcggaattgtcatatacagtgtgttctacctttcggtatcaaatcaagtgtcgcagattggacagctcaaaactattggcatgacagaaaaacagattaagcggatgattcgtaaagaggggtatcgtttctgcctgttcggaatacctgccggtattacagtaggtatcatatttgcatatttgttagagccgaatggaataacgattatcaatgccatagccacaagtatttttgcaataatattaggtattatcatcgtacaaatttccgtatacaagcccgcacaaatagcttcaaatatttcccctattgaagcaacaaaatatgttggaaacgatccagaactaaaagaaagtagagtgtgcaacaggaaaaatcatattcgtctctcaccgtattctttagccgtattgagcgaaaagcagaatcgaaaaaaacacaatctgacgattgcctcgcttgcaatcggcgggattttatttatggttggagccacttttatatcatcatggaatccagattcctttgcgagaatggggaatttggaagatggagaatattatattacgattaaccacaatacattagtcaatccgaaaccgtatggtatttcggagtatcaagttgatacgcctttttcacaggaactcatggaagaattgcaacaaatcccggaagttaaagagatttatgctacggagagaaccgcagctattattgagtatcacaatgaacaattagaaattcccattattccgattacgcctgataatcaggaagaaattttgaaaacgtttcctgttgattggacatacgaaacattggtggaacaagacgctatggttatattgggaacaagcgtacagaaagaagtctatcatacttgcccgtcaataggagaaaaagtgacattacgatggtttgatggaactgaacacagcatagatgttttgattgccggtacttccgaaaaaagtatgaatgagggcttttatcttccaaaagaaaccatagaaaagttgtggggcgatatggatttaacagcttccttaactttgtccgtacctgaatatgaaaaagtgggtaaatcagtagaaagcaaattaaataaaatactgtcccgacaccctgatttggtaatggaaaccttacaagaggtaaaagcatcttcggcaaatacgattcataataccagcgtacaagtttatggagtatctgcctttgtcattatgtttagcatttttaatctgacaaacaccttgattagtcgtatcagtacaaggagaaaagaatttggaatattagagtctatcggtatgacaaaaaaacagataaagaaaatgctgctgcatgaaagtgtcttactgattattccatgcttgattattacggttgtggcaggaaccttgatgggttatttgttagtacggatattgtctgcgaatggattaacttattttcaatatgcttttccttttattccattactgatttacggtgtctgcttaataataacacctattataatttctgctatctgtctaaaaattcaatgcagaaattcgttggtggaacggatcaaaatggcaaactgattttgaaatgtccgagctttgtaacatttcaccccgattttcaatgaaaatttttggccgctgtaacatttcgcggacatttgggttttacaatacccttatcaacaaaagtgaggaggcgacgcaatggaactgaccccgaccttgattttgaatctggcgctgctgatcgtcccgcccgttgcccttgtgctggtgttccggcaatggctggcccggcacatccgctggacggttgccttgactgctctctgtgatgttctcctattttgggatgaattgttctactatgagagcttcggtctgttcgctgtgctgattctggtgcagttggcggccaccggcgcagcagcgttccacatttacaacaaacaaagaaaggattgaattttatgagcattttacagactatcgacctgaaaaagtattacggcacagagccgaacatcacccgcgcccttgacggcgtgaacttctccgtaaatgacggcgagtttgtggccgttgtgggaacctccggcagcggcaagtctaccctgcttcacatgatgggcgggctggacacccctacttccggcaatgtgattgtccgggacaaagagctgtcgaaaatgaacgacgaacagcttaccatcttccgccgccgcaacatcggttttatcttccagaactataaccttgttcccattctgaatgtgtatgagaacattgtcctgccggtggagctggacggggacacggtggatcagaagtttttggacgagatcgttcacctgctgggactggaagataaactgaaaaatatgccgaacaatctttccggcggacagcagcagcgtgtggcgattgcccgcgccctgattaccaaaccggctattgtgctggccgacgagccgactggcaaccttgacagcaagactagcgccgaggtgctggggcttatcaagcgtaccagtgcggagttccggcaaactgttgtgatgattacccacaacaacgacattgcccgccttgcagatcggattgtccgcattgaggatggcaagattgtggaataaggaggtggcaggctatgacatggccttttgaaaatgataccagcgccattacaaagaagctggcaaagaaaagtttgcaaagcgagaagcgccggaatctgatggtagtgatcgccgttgcgctggcggcatttctgatctgctttacgggaattgtagctacttccctgacacaaatgcagcgcaatcaggttgtcgatacttatgaggcggtctggctgggcgtagaggaaaacgacattgaaaccctgaaaggactgccggagtttgagcgcgtaggcggctactatatgctcggtgaggaactttcggaacagggctatcatgcctcttatgtatataatgacgcagaaatgatggagattgggcgcgaccaaatgaagctattggaggggaatctgccccaaaaagcaaatgaagttgtcgtaagcgaatactttctctccacctatggaaacaatgccaagatcggggacagtgtgaccttagataccgagagttttcatggtgattatgtcgttaccggcattatggacagcgtaaatgaaaaagaagcgaatacctgcgctatcattctttccaaagctgccctgacagaatggaaagggtttgatccggctgggtatcgcgcctatgtccatttcaaaaacagcgaccagttgggcgaggaactgataacctcttattgcagggagattgcagaggaatatcagcttcctaatcccagcatgaacaacaagtattttgcttatgcttctaaatcctttgattttttaccgattgttggtgtgattgttattgttctgatcggcggctatattgtgattcagagtatcttccgtatctccatcaatgacaaaatcaggagctacggacagcttcggacgattggtgcaacgccaaagcaaatcaagcggattgtaaagcgggagggacgcaaactcggcagtatcggaattttggttggtacagtgctgggcgtatgctgcggttttcttctgttttccaagggatttaacgctgtttcctatgtcgttatggtttccctgacactcataagcagttggatcatggtgtctatttccatccgtaagccggtgaaaatcgcggcagggatttcccccattgaagccgtccgttttaccccggtgcaaaaggacatccgcagccggaaaaagaatatcaagctcaatcctgtttcaatgggaattgcgaattttaagcgtgaccgcaaaaagacaatctctattatagcgtctttgagtttgggcggaattatcctgcttgtggtatcctccatggttttgctgcgctccccagaggcacttgcaaggcagatttatccgtatggtgactataaaatttatttacattccgagttggcagtagaagaagctatggcagcgggaaatccattgaatgagaaattgaagcaggaaattttggccattgatggtgtaaccgatgtgattacaaaaaggcaaagccttcatataaattatcgtgccaacggaattgatgaggctggttggtgtgatatactaactgaacaaaattattctgcggttgaagctgcattgatagagggaactatgccagcggatgcacacagcatcataattgattcgcatacaagtaatcgtgataatataagagtgggagaaacggttgaagttacctctgggaaatcaactattcctgttactatatcaggggtgtttgacaacgatagcataccaactgatggacatggaacagtcccagttgactctccacttgaatttgcaacggaagcattattccatgaattacatccagaaatagcttcgtttgactattcatggaacattgcaagtgatccgaaaaaagcggacaatgtagagtctgaattgaaaaatattgtagccactcatactgatattgcgttagaaaatattgacactataattgagtatgaaaaaaatataaattcttttgtatttggcagtatggaggtactttcatggctggtattcctctttggcgttatcaacctgattaacacgaccctctctaatcaaatgtccagaaaacaggaaaacagtgttttgcgttccatcggtctgacccaaaagcagctatgtaaaatgaatatctgcgaggggctgtgctatgcgttctttgcaacattggcgacgctgatcgttgggcttccggcttccatctttgcttgtagcaaatttagtgtaggcgcttttgccggaaaagtagtgccttacaaattcccggttttggaaatgggtctgttcattctggtattgttcggaatggagctgatcttatctgtatggacaatccgcagacagaaaaaacaatccctgattgagcaaatgcgggcgatggaataaccctttgagatcggcggggcggcgtgtgctgccccgcttttttcgccatttctcaaaaaaatttttgaaatgtccgagcgttgtaacaattcagcctgtttttttgtcgaaatcaaaggcacctcggacatttatagttcttccaaaagtttgatgataatattaccattcatggaagaagcaatctgttattgcaataatgcgaaattgacgatagaaagtttttcatatctcggtcagctcaacaattacattactctgctgatacagccagtccgtaaattctttcgggctggccgttcctgtttttacagccttttttctctgtaaggcttctttcttaaagtcggaaaaggaagcctgtattttttccagacggtcagccggaaagcctgcggtattttttacccggtttattttgttgcgccagttctggcattcatttttataaagcaggtcatagttattttctcttgacctctcgtcaaattcccgcttgttttgaagcgtctgtgcttttcggcacttgtcgctgcacagctcataccgctggctctttgccagaaaatattttccacagaccttgcaccgccggaagcaaagcccccagtcattcagcctgttcagataataggtaatcaacgggtagagggacgcataggcagacacacattcttctgtgcgccggttgtccgggaaccagaggtcaagccgggtatcttctgacggtgcgcctttgaaataaaggctgccagcttgaaattgtttcggttttcctgtctccctgtcaaagctcatggtttcgttttggaataccccggtcagtctgctcattttatccatgaagcggtcacaggcagcgttacggtcacggggttctctggcaagcagatagctgttccagatacggaacgccacatacattttcagagggtcgttgctaagatatttctcccaaagaaattcgcttgccgcctgctccagctccggctgtttccatcggttggagtggagagcttgccgcagcggagaaagcccgtataagttccagtctctgtccgtgtcacgctcaaagtttatcaaaaaagttcccagtgggcgtgtcatatcacaaagcacctctgcgttttggctcccgttcagacggaagcggatctgctgttcttccccaatcaaaatccgctctttcattttcttcctgtccagcgtcaggacaaacaaaatcctctcaaaacatggctcatgccgtataaactgattctccatccctatcccctgcctttgtttatggtaattatataatttagttatatccgttacactcatggtatcgcagaatcattgttttgtcaaggatagtacgctatgatgattgcggttggtaatttcgtaccgcacagtaccttgacaagtgaatgaccgtccaaaagggatatgaccggcaggagaagtgacgcattcggcgcaccaatgcagggaaacaccgcaggaatggggcaggaaaacggcttttggggagaacggcaacaggaagcattttaacctatttgatttatgggaggaacagaatgaacgataaaaagagattgaacagctacgaggatttaccgctggttctggatgtggcggacattcagcggattatgggaatttcaagagcgagcgcctatgagctggtacacacacccggctttccagcgttccgcaggggcagacttatcaaggtcagcaaaattgctttctttgaatggatggcaaaaggctccgaaaccgtaccgggaagcgacaaataagcgtgaggtatcattccctgacttgcaatactgccgcactttccaaaggggcatacagagggaaaaaaacttaaaaatgataccgagacgctacatcaaaacagcctatctgcgtacatcagatagaaacggagaaaggagccggttatggcaagaatgagtaacaagcggcggttggaatggtctttcttcttaaatgaccgcagccgtatcacttacaacgaactgtgccggaaatgccagcacgaatgtaaacagagcttccgggcggttgtggttgactgcccgaagtatctttccaagcgttccaagaaaaaggacaagactgccggaaacggcaaaatcccttaggaactaagggcgcacttctatacatagtctaaagaccatgtatcgtgcgtcctgcggagcttacctctgccgctgataaaatcagcaatccgaggtctgcgttcgcttcgctccgacaaggtggctacacccccttgcgccgctaaagcggctatcccctgtgtacccgccgcaaagagaaatccgctctgcggttttcccttttcatcgggttttatagaagcactgacacacggactgtctgcggatggtctttctttatcttatcagcaaaggatgtgagaacatggaaaaatctttggaacagttgaagcaggaatatgaaaaaaccactgtcctgctggaacaggaaaaacggaaaatgcagcgtttgaaaaaccggcaggcgtatctggaaagcggttcccggaaacagaggacgcaccggctgattacccgtggggcagctattgagagcattgcaccacagacaaaggagctatccgaagcggaattttattccctcatggaaagcattttgaatctgccgcaggcggagcatttcatccggtctgccacagagaaccacgcccgtatttccgggcaggagaaaggcggtgactaaggatagcactttatcatttttcaatcgcacagatcaagcgcagcgccggtcagagcgccattgccagcgcagcctatcgagccggggagcgtctttacagcagctactatggagaagtcagcgactacaccaaaaagggcggcgtgatcgcttcggaaatcatgctgccgccccatgcgccggaaatatatcttgaccgggcgaccctctggaatgctgtggagaactgcgagaaacatccaaaagcacagcttgcctattcctttgatattgccatgcagaatgaattgacgctggaagaaaacatggagctggcgaggaagttcgtacaggagcagtttgtgacaaaaggcatgattgccgaccttgcttttcacagcccggagaaagaggacggcggcatccctaacccgcattttcatgtgatgacaaccatgcgccctttgaacccggatggcacatggggacaaaaacagcgtcgggaatatcttcttgatgaagatggaaaccgaatccgggataaaaacggcgattatatgtttaacgctgtccatacaacagactggcatgagccggaaacgctggaacactggcgggagcagtgggcggctgccgttaatacaaaatttgaggaaaaagggctggatgtgcgtatcgaccaccgttcctatgtgcggcaggggcttgacctgatacctactgtccacgagggagctaatgtccggcagatggaagcaaagggcatccgcaccgagaaaggggaactgaaccgctggattaaagccaccaaccggctcatgcaggatgtgaggaagaagatcaaagccctgtttgtctggatggcagaggtaaaagaagaactttccaaaccgcagacaccgagccttgccgacctgttgatcgcttattataaccagcgcaacgcaggggcatggagcaataaagccagaatcggaaacttaaagcagtttgccgaagccgtcaattatctgacggaaaacaagctgctcacattagaggatttgcaggagcgtctttcctctgtcaacgaagaatttgaagcgttaagcgactccatgaaaaagaaatctgcccggataaaggaattgcaggaattgatacgggagggcgagaattaccagcggctaaaacctgttcatacggaattgaacaatatcaagtttaagaaacagagggagaaatttgaaaca

SEQ ID NO: 2230 - DNA, 52689 bp, KLE1738
atcagaattttgttgttaaatgaccaatcccagccgttctacttggcgtttatgctccgcaccgctctccataatatagattcgagtcgtctctacgctggcgtgtcccaaaaggtccgccagctttgccatatccttctccaggctgtaaaacgcccgggcaaacaaatgccggaagttgtggggaaacacctttctctcccccacccccgcctgggtgctgagggcccgcatctcccgccagatgttggaacggtccacaggccgcccggtccgggtgacaaagaccggccccgacgttctcttctgccgccggcagtaattccctaaagccctgcacagcttggctgtcaaaaagatcgtgcggtgtttccccttacagtccacccgcacccggccggcggccagcgcctgcactgtgacgaaacgcagctccgacacccgcatccccgtagaggccagagtctccatgagatagtacagccgccagttctccctcctcttggccgcagcgagcaggcggagatactcccccttgtccagttcccgtcccttatcccggaacaattcccgctgccgccgcagaggcttcacccggcactcccgccatcccaggaaggaaaataggccgttgagtgccgccagtttcccgttgaccgtgctcaccgcgtaccgctttgccagggtctctttccaggccaccaccacctccttggtaaccacgcgattctccggcagcgtggccgcaaacgccctgatctcccggcggtatgtttcgatggtcccctggctccgttcctccccctgcaaataccggcagaattccgcaacatcctcttgcctcatgacacgccttttcatagaaaatcctccttcgcaaggtgctctttttcatttttctgacttaggaaatagtatgcctgttttttgcgtcaaaaagcggggctttcgccccgccagtttttccccttcactctttacaggctccctcccagtgcactttctcaaaatttttcacaatattatcattttgaaacacttttgtccaggcacattctctggcacttgcaagggaaggccagatgcatccatagaaaaaaccggcggtcaagcttaaccgccggttttttcctgggcaaaagttccgatattatggccgccgccgggcattcggattcatccgccggagggtccaatgcattccaatctgatccaacagcgccttccgctccggcgtcatgaggaaattgggattcccccgcatggcctgccgctgggaggacagccacatgcccaatttgactccctcctccgtgacatagttcacagggaggttcagatggccatgggcctggtagtaggtctttgccacctggtatttctcccaccatcgttcccaatacgggtcccataccattccgatctcgtccagcctgtgtttttggtgttcctgtgccgtgcgcaccccctccccggcacctctgcgaaatttccggcgctgctgggcaatccatcgtcccaatgcacgtccgtcctcggtgacataactgaccccaatgcgaagatgtccgtggtcctgataataggcacgggccagggagaacatctcctcccatcggtccggtgacggcggctcccactggacccccaacgcctccaattcgcgaatccgccgggagctcagtgtccccgcccgataccgtttcctctggtttgccagccaagcaccaaggcgcagccccgtctccgtggtacaatccgctgggatatccagtcctcccgtcgcctgatgataggcctgggcagcctgcagatattcctgccgcctggactggttgggcgcccagcagatccccagctgctccaatcggttgacacgctggggcgtcagcgcctgcttgcggtacagctcacgctgatgggccaaccaggaccccaggcgcacatgctcctctgtgacataatcatggggaatccgcaggtccccgtggcgctgggcataggccgctaccagctgatacatccgttgccagcgcgcctcaaagggggcccactgcatgccaagggcctccagcttctgaatttgcagggccgtgagctcattgctgcggtaggcctcccgctgggaatggagccagccggccaaattaaccccggagggactggtcaaatcggcggggatagagagggtaccgtgtctacggtgataacgataaaccgcctgatagctctgatcccaagccctggccgtaacatcccggtaggtttccagaatggctgggcggtcccgggcgatatccggcgcgggatcagggaggttcagccagcgaaacaacgtacagatggcttccgcaaaagccgcctctcccgaatcatccagcacaatcactcgttcacaccgggaggcctgaggcaagccgggctctcgtatgcggatcaggcgaatgccaaagcggcggcagatttccccttttcgctcatccagcgccagcttgttgtgatgccattggtatccatcgtattctatggcgattcgaagggagggaatatagaggtccaactccactcccaccgcctgccattgggaaactttcacaacatcaggaaacggtttcttcagatagaaaaggagcgccttttcccgaaaagaggtctttgccgtggcctgggttccatcccagatcatacccagttcgttgagctgagcaatgcgctctggcgttatggtgccaatgccctggccctccttcccggccagaaagtttttatagcaccgccgctgccgggcaatccagtgtcccagccgcacccccgtctccgtgctataattgcagggaacattgagcatctgatggacctgataatacgccttggcatgctgatacatctcctgccactggtcggtgagcggctcccagaccataccaatcccttccagccgttggatttgtgcttctgtcaagcagccgcgctttcctttctttgccgcccgctgggccagcacccaagtacgcaactctccctccatgggattgagatgcccgtgggccgcataatacgcagaggcttttcgaaaccactgttcccacagctcttccgaatctaccccggcatcccacaccattccaagggtctccagctttcgggtccgttcctcgttcaggaccccctttttgtagttttttcgctgggtgctgatccagcgccctaaaaactggtccggcccactgtccttggagacccgcaaatgcccgtggcgctgaacgtatgcttccgcctgctggtaggccgtctcccaaagggattggtacacgtcccagatcatgccaacagactccagcatacggctcttttccggcgatagctttccggcctgcttggcttttcgctgggcagtcagccactgggaaagccctgcgggcaagggcgcattccgtctctggtaagggcaaaggtgcccatgacactgaaaatatgcctctgcctgtcggtagcggtccatccacgcctgctccggcacatcccatatcacccccagagcctccagcttctgaaggcggtcaggtgcaagtgctccgttttttctgtcctgtttctgattggacagccaaatccccagcttcacgccagcctccgtttggtacgtggcaggcggaaatgtcccgttacaaacaacatagtcctccagcagcgcaaaaaaatgctcccagctctccctgcgcagaacttctggctcccaaaccacgcccagggcctctaactgggcctgtcgcgcctgggacaagcgtccccgtttgtactccatgcgaaccttgtttagccagattcccagcttgaccccctcctctgtgacataggactgagggacccgcgccgtgccatgcttttgcagataccgttccaatgcctggtacattctgttccactgaaactgcctgacatcccagaccataccaatggcattgagtagatccacccgcgcctgggtaaaccgcagattggtacggcttttgtattccatacgctgggtgccaatccaggctccaaggcgttttccttggcagacatagtcattggggaccaagagatccccgtgttcccgtcggtattgttccgcaaggcagtaaaatgccagccaatcccgctcccgctggtctttagctgacaacgccaaaaggaccacctcctctccaacttctcagcagactctccctgaatcgtttccctctggaaggacttcgttttcacccccggctcaaagctctcttgaatatatggtgaccacacctcccatctcataacagcctcccatttgaaacatgtttaacacgtcatttcattgtcattttgttatatctgagcggatacgtcaagtttctttccatcttcgttcttcaaaaatgagcaactttctctcctttcacagagaaggacctcatcaggcggcgcagttcttctataaaaacagttcttcggagagaaaacatagcaggttccctttttccttcttttttgctataattattaaaatagcaataccatttcagaagagagatgattatatggacaacatctgttttgttatcatgccttttggcattggctttgatgatctctatgaaaaagtatatgttccagcgatccagtcgcagggtttatcccccttacgcgcggatgaaatctacgacaatcagccgatcatacgggatatcacccaatccatccaccacgccaaggtcatcctggcagatgtcacagggcgaaacccaaacgtcaactatgaactgggcatcgctcacgcgctgaaaaaggaggtcatcctcctcaccgccgaagccaaggatgtcccttccgactaccgtcatctgagatacctgcaatataaccgcatggatgttgactggaatcaaaccttgtcccaggagctccaggccacactgaaacaagttctttcccggctaagccactcggacaaaacaattccatccacagccccccgccaaagcgcggttctaaatgtccctgctgaagcggaggacaacgagaactggagccccgaggaaacacgcgccatttccaaggccgaggccctgggcatgcaattgcaaaccgcttccctctggctggactgcatgggctgccgcgtcctgttgacatcgcagcatgcgtccctctgcaaactccatgccgcaatcgcctgtctgctgaatgaaagggtccgtgcgctctcccatgaccttcctaagggccacacccttcagatgcgccgcatggactttggagatgctgccccacacacgttttttgtggactatctctatgacgcctctgtgctgcccctatacacgcagcgggagctcatccgacacctaagcaccgagctttgcacgcaaacctttgcccctcaaattcgatacctggaagaacattgggaccaggcaccacggaaggaagagccggacccatatgattccccggaccatctgccccaggagcgaaccccgatctgttttcggcaagatttttatgtggcggacatcaaacgcatattttacaatcgcttccgaggggatcacttttaccagattgacggtctcctgcccacgtctctcctgaaagaggaaccggtttccggagaaaaccattggctggcagattgggatcagaaagaggcccggtgcaaggtgggcgacacggtcagattcaaggttcacaaaatatacgaccttaaagactacactcatacgtcgaacgccagaaacatctcattttcccaactggaagtggtatctaacagctctgaacatgcgttgtgagaagtgggctatctgagcgggtatccctttcttctcctttttgctatttttataaaaagctgcgttttaacctcagattgcaggttgaaacgcagctttttattgaaaagaggcggttaaaatcaatatcctttatacgattgctgatcttttattgtatatccagactcttgtttgatgtatatctaaaaaaatttttggacctttatctataaacgagacaagctgccctaccagttatcactatatcctggtgggcagctatcgtattgatttcatcaaaacaattaagataaggttctatgatttagccaagaatgaattgccttcaggaataaatactcttcttctgaaaaactatagcttgcattactgttattcgcaatcgttgcaaattttgcaatccacgctgtttttgccgtctttcctcctcttatcgatatctcctcgggccgagtatagctattctcaaatagttctgtccagttggaactaaaaatagcaatatctctgcagtttgcaatggtaacacaatcccatatatctacaactttatttataccgttgatgctgttttcataattttgttttcccattaatgcattcgcttgtttataaactctcggcggaatcccacgtgtaagccatttttctccgtactttttctggagcttatcggcaaagtcagatttaattatgagttcaatgtcttgtatcagcgtataggactctgcattgaattgctttgaattatcgcgaatccacgctctaaggccatctggttcaaattctggttgtgcctcgttaataactgactggaaagtacgccaaactcgcgctttgcctccactaccataatttttacggattccttccctctctgtctcatttatagagccaaaataagacacaaggggggccaagtaaggttcaaccttttccaaaagaactcttgtatccataattttaggattgattttatctctttcaatgagaaaatcaattatatcatttagaatgcgaagaagtgcatggatagtattattaattgtaagaacgccagaattagcatctccgagttcccattcctctggtagttcatttttgaaatattggaaagcttccatgagaaatggtaacaaaacaccacgcgtaacatcgttactcccgcgatcaaatgtaccagcttctatttcatgattgtcctttccaaaacgcgttaaaaaatgtgttgattttaacgcattttcaatggtatcaatcgtcaggcagcaataagcagaagtctcattctctcctattatgactctgttaaaaaatggagatgattgtaactcacccaatcgctgggcaatatttaatcgaagtgccttcctttgcttatttttatcctcagacgtccacagcaaatccgcatttaacgtattttggagatttttagaaaccgctttttgattttcattaatttccataaacagctctacctgtttatctttatctaaattaacaaaagcaaccactggaatggtatccttccctgcgtacgcagagtcagcatatccgtacaaacggtgctgtccatcaataatataaacagagcgatacaattgaggcaagtaaagaatgccaatacgagaaatagcattttcaatctgaggtgtagcaagatcaaaccgcagcttttttccgttggtatcaatactaatgattaaggaattaggaaaaaaacctttattatcaataaacttcctaatttccttcaatctttgcttctttataattcgctgatacgtaggcatcatatcactatttgcctcgttacgatgtaaaacataggctaactttaaaagtttctcaggctcaatggaaaatgaataatatgtgtgcccccccatttggccttcaatggcaggaattctattctccattgttccaattttttgccctgcaaaaagtgtccccaaaagttggtatcttgcacaagcccccaaatgctttgcaagttccgcaaagtattttataccgtattcatcaaagtgatagatccccaggtctctcatacggtttcgatcaggctcggttatctcataatttttcgtagcaaaaatatattttacttttttcttcttaaactctttttcccgtcgaacggtcttaaatagaccttctttaattcctttgatcgcctcaaggtcagttttaaaatctccttttttcccagaaaaagcacatttacattctataaaaaggacggtctcctcatccgcagcaaacacatcaatttgcttagtggtattcaaatcttctgttccatatggaatttccagacgtctatccttattcatataagaaaaaccgaggttagaaaacagacaccagacatcatcctcaaattgcctatctaaaggcttgggacgtttcatacgaaccatcgactttagttccttgtcgacaatccacccctcgctttctcgtttctcctggagctcatattcaaatttttcaaatatatatgactggctgcgacgttttttgacccctatcaattctttaccagacacaagcttgtccataaagcccatatttcaaagccccctaaaggttcgtaaaaatatattcttgaatttttccacgttttgcgttttcgccaccaatcaaacttgctctacttaattccaagcatcgatcatctttttcataaaaaatctcatagattgtggcatgtgcagcgtttgttagaatataataagcacctttctttttaataaaatcgattaaagccttgagcctgtattgatcttcgagagaaaacaacttttgattatatttgatgaagccattgtgattatgtgaaaccgtatatggcgggtccagaaataccaaatcaccaggagcaacatttattctaacacaatcgaagtcctctgcttgcaatatagcagattgcagcatttttgatgctgctctcaatttatctgcttcaataaaatcttttgttctatttccataaggaacattatattcaccttttgtattaacacgataaattccattaaatgatgtctgatttaaataaataaatctcgctgcagcctcaataagagtctctggacgcaaggctcgaattcgatagtattcttccgcagtatttacatatttctctaaatgtaaaattacaccatctgggtcatttttaattgcactgtatgtatcaataagttcattattaaagtcagataaataggcagtattcatctttgaagcaaaataaaaaaatattgaaccaccgcccagaaaaggttcgtgataacaattgaatttataatctccgacgatagaatccaaatattttattaaccacgactttcctcctgcccatctcaagaaaggttttggatatatgttccgtttatctgccattaaagcatcacccatctgaaaggatactatcatttcgaccaaaaattctcggaaatactaaaaaacgacatgttatattatatcaatatctttctaaaatgacaatatttattttaagtcgtcttcacctattcccatatatgagaaatcatactacattcaaggaaaacattagcagcgtataaccgctcgtcgagataaatcctaaaatgaaacagtgacagataatttaggggacatcaatgacccaaagtattatcagggactgatgtcaataaaatctacctctacgataaaaaaatgaccgtcctgtgtaatacacaagacggtcactttgatattgaccttaaggaagtgagttcacttaagggtcaattggtggaggcggggggagttgaacccccgtccgaaaacacttcctcgggaacctctccgggcgcagacggttatttacattcccgtgccatgacgcaagccgtcatgcttcatgggttggtagcttcattgtgcatgctggaggcaaagcttactccagtcacgtgcaccacttagatcacgcccaagtccggctcgtggtccttccgggttggacggccgctgatcaagcagcggcgagaacttcgttgtcgttgttctttaatttataagttgcccgtttttcggatgacaggcccatccgcccgctattcccgcacccatgtccccgtcgaaaccagtacgcccccagattgaggctttgcaacaagcccattggttcagcacaggcagaggtgtctcttccccgacacctcgccgggagaccaggggctatatatcggcccctggctccccgggaacggtttggctgcgaaaccgttggtcacttacattttttccggctcagggtactccacaccgaaggtttccaccgtaacctttttcatccgctggtcggccttgggtttgtcgttcaggccggttttggtggccgcgatgcggtccaccacgtccatgccctcggtcaccatgccgaacgcggcatactgcccatccaggaactcgccatcagcgtgcataatgaagaactggctcccggcagaatccatcgcctgggcccgagccatggagaggaccccccgcttatggctgagaggattcttcaccccgttggcggaaaactcccctttgatgcagtaaccggggccgccgatgcccacgccctggggatcgcctccctggatcataaagccggaaatcacccggtggaaaatcagtccgtcataaaaccctttcttcaccaagctgataaaattatttacactgatgggggccatttcagggtacagttccgcgacgattttaccgccgtcctccatttcaatggtaacaatgggattctgtgccatagttctgctctccttttatgtcatagtaaggtttgccggtcagcgccgctgcttcagggcccggtccatctcccgtttggcatccttcttggccgcagcctctcgtttgtcatagagctttttgcccttacacaggccgatctccaccttgacccgggggcctttgaagtaaaggctcagaggaaccaatgtataaccgtcctgcttgatctttgcgaaaagccgcaggatctcccgcttgtgcatcagaaggcggcgggggcggcggggttcccggttgaaaatattgcccttttcgtaggggctcacatgcatcccattgagagtcatttgcccatccttgatggtgcaaaaggcatccttcaggttgacattccccatccgaatggatttgacttctgtccccgccaactcgatgcccgcctcatatttatcctccacaaaataatcatggaaagctttccggttcccagcaatctgctttctgccctctccagccaaaacgggcacctcctctccgccccacaaaacagcggggatggtagatgtttattatccttcattctcccctgtctgtcaagtgcccagacggatcttcccctttgttcaaacattgtttacagaatgaaatttgacaaggccggccagatgtgttacaatttggttacatttgtattgggaagcgtctgtccatcccccggtccgcctgggaatcgacagggcggtttcccccattctatgcgatgacggaggtttttatggcaaacgaaaagatccccctgatgtataaaggtcatcccctgcgccggaaggacaatctgatctattacggcgacatggcagactcccacatcattctgctccagatcatggacaccaagcccgtgggagacatgaacgtagccaccaaggtcagcatccagctgcagctcaccgcccccgacctgaagggccgggaccgggtcgtcaaacgcagcgagaaagacagtttgtacgccgccattgacatcgcctccgtctggctggaacgggcgctggccgctcgctgaccaccccctcagaatggaggtagataccaatgaaccacgtaaaatttgccccccgggttctcgccatgggcctgctggccgcttcggccctgtccatccccgcctttgccgcgccggcagacggcagctccaccgccatccgggtggaccgggaccccgcccccaactccgccagccagtcggtctccgccaatgacagccctgttccggtggaccccagtcaggcaacgggggagattgaggtcgtctatcaggatgccaacggcaaggagcacagcgccaccatctccgctgtggccgctcaggcggagaactacgcctgcatcaatgccggcggcgacccgctgcgggtccgtcagggcccgggtaccaactacggcattctctgttccgtctatgacggagaccggttccccatcaccggcaagaccaacggctggtaccagattctctgcaatgggcgcaccggctatgtttcggccgagtttgtggttgtccaggacaacgacacggttaccaagcccgatggcgacgggagcgacatctctcccaacccgctgggacaggaaatcgtagagtatgcccttcagtatgtgggctatccctacgtctacggcacagccgggcccaatacctttgactgctccggctttacttattatgtgtattcccagtttggctacaccctgaaccggtcctcccgggatcaggtgaagaacggggtggccatttccaaagaggatttacagcagggcgacctggtgtttttctccaccaacggacagtaccccacccatgtgggcctttacatcggagacaacaacattgtccacgcttccaccccccaggacggggtcaagatcagcagtctggacaccagctactacatggacaactatttcgccgcccgtcggattctttgagcgcggcggcacaagagcgattcacggttgaaaacccggtgcactttaagtgcaccgggttttgtctgtgctctcccgccactcttcccagctgagtaaaagcagctgctatgatttggcggcatacttttctttcattcctctgtaacaaatagagagaagcacccaatgggtgctcccctcctctgttttctgatgttcaaccctcgtccttgagctggttcagccgggccttgttggcttcaatgcggccctccacctcttccagctgacggtaaaaggtttcatatccctccggcgctgtggcgtgctcggacacgaaccgttttccgatctccacgtagatccgttttctgttctcctcttccgaaacattatccaagttcagcttggcactctgccccaggtcccgggccttgcccaggccggctaacgtgaggtttttcgccttattgcccaactctttccattctgccatgattgctgcctcctttggtgggatgtaacatatcctttctgcttcttctattatacccattccgagtctctttcgcaaggggcggagccgctgggcggaaaattccccttgcccaccggcctaatctccctgtatactatatgcagactaccctacgggaggttcccatgactgatccacacacgctgcccccgctgtccttcgccccgctggagggcatcaccggctggatattccggcaggttcaccatgccatgtttcccgggctctcccggtattatacccccttcttcgcccccaccgcggacagtcccctcactggcagggggctgcgggacatgcaccccgaccacaaccgcggggtcccggtggtgccccagcttctcaccaaccgggcagaggatttcatcgcctcggcccggctgctccaggacttgggctacaaagaggtgaacctgaacttaggctgtccctcgggcacagtggtggccaaaaagaagggcgccggctttctcagccagcctcaggcgctggcacgtttcctggaccaaattttccagaccctggacgtaaatatttccatcaaaacccggattggggtggaaaatctggaggagtggccccctctgctggatctgttccaacgctatcccatctgtgaactcatcatccatccccgcctccgccgggacttctaccggggacagccccggcgggaggccttcacctacgccgtggcacacagccgcctgccgttgtgctacaacggggacctgttctctccccaggactgttgggacttagcccgccagttcccctcggttgaccgcctcatggcaggccgtggtctggtctgcaaccccgctctgggccgccagctgcagggcgggccgcccctcaccaaggcagagctgcaggcgttccatgaccgtctgctggacgggtatcaatccgtcctctccggggactggcctgtactgggcaagatgaaggagctctggtcctattgggcccgcctcttccccgcaccggagaagcccctcaaggccatgcggaaagccaaaaccctcaccgactacacctttgccgcccagtcccttttccgggaccaggacctgctccccggggctcacttcccctccgccggggcatcctcgtaaatccccgccgggtccagatgaaatacctcccgaatcagccgtagctcctccgccggcgtggtgggggtggcctgtaccaccagcccctgacgctccacctgaaaaacatgcctgcggagggccagcatcccctccggcgtatagagggaggggcgggggaactggttcatattggaggccgggctcttttcaaaaaagaagagcaccggatcaaaatcccggtcgatctggggttccagggtaaaggcctgaatccgctcccagtcatgccccggccggcgctggcactgaacccagccgtaaaattcctcttgctgataccgataggtgcagtgcccgtcccgctgcaccaccccttccgccagcaaaaggggcacacgggcattctccgtggcaaagcccacgtctgtggtatatgtcccacccgccagccgcaccgccaaaatccggtgacggcggaagagataggtgtccggcgagagcatccgggcattgtagctggtcacctgaaaccccaaggagtagagcagccagttatacaacgtgttcagttccgcgcacacaccgccctggcggcgccgaacaattttatcatacagatggggcagctccagggatagggggcgtccagccacaatatccaggttttcaaaaggcaccgtcagtctgtgggccatttggagtttgcccaacccctccaaagtcaggggcaccgggctggaaatcccaatccgggccaggtaggctgtgatctgttcttccgtcatcttcggaccgttgcgggcattgagctccatggttccccttctctctggcaaggcagccgttttccccatcatagcacaagcccgggggggccggcaaccggtcccggccctttctgccgtttcttcgggaaaaattttcccctccccttgacaacttccccgggttttcttatactattttttaatgtagcaaaggcaaggatgggaaggagtacgcggcagtgcggggcccagagaggagacggcggtgcaagtctccccccagcggcgcggaaggtcgtcccggagctgcctgccggaaccacagtacggcaggacggcattcccccgttacgggaaaacgagcgcggacggcgccctgcccgtccgaattcaggtggtaccgcggaaacgattcgccctgagcccccatggggatcagggtttttttgttcccttgacccgggaaaaggaggttgtttatgaacgagtcattgtatccctttgtcaatcacaccacctatgacatcaaggccctctccgccctgaaccggctggcggaggccagtgtccgaaaggaaaaatcccgccggaccaaaagcctgtgctggctgctgggcgtggtgggcctggtgggcggcgcttactgctatccccaccaaaacctggtgggcagcctgctgctgctgtacggcgtgattttgctgctggtggccatctcctggaagaatttccagctacgctcctcccagcggcagctcccccgggggatgcgggagtgcacctatgaatttgatgaggaggaaatcatctgcaacaccgaggccggcatcacccggtactcctatgagcaggctttcgccgtggtatccgaccagaactggtacgtcatctttttcgacatgagccacggcatcattctggacaaggccggcttcaccaccggagacgcaatgtccttcaaagccttcatcggccagcacacccagctgccgatccaagagttctaaggggaaacaatcccccaaaacccagaaaagaaatccgcttccggtgccagagaaccggaatgctgcaacgtgatggaggagaaaccactatgagaaaagaactgtccaaggtctacgacccccatgaggtggaaggccgaatttatcagcaatgggaggaaaacaagtgcttcgccggcgtccgggatgccaaaaagaagccctataccatcgtcatgcctccccccaacgtcaccggccagctccacatgggccacgccatggactgcaccctgcaggacatcctcatccgctttaagcgaatgcagggatatgccgccctgtgggtcccgggcaccgaccacgccggcatcgccacccagatcaaggtggaggaggagctccgggtgaaggagggcctgacccgctatgacctgggccgggagaaattcctggagcgggtctgggactggaaggccatgtacggcgaccgcattgtggcccagcagaaaaaaatgggcgcctcctgcgactgggaccgggcccggttcaccatggatgagggctgctccaaggcagtgcgggagaccttctgtgagctctatgagaaaggtctcatctacaagggcagccggatcatcaactggtgcccccactgcgtcaccgctctgtccgacgccgaggtagagtatgtggacaagcccggtcacctgtggcacatgcgctatcccctgtctgacgggtccggctatctggtggtggccaccacccggcctgagaccatgatgggcgacaccggcgtggcggtaaaccccaatgacacccggtaccagcatctggtgggaaagacctgccttctgcccctgatgaaccgggagatccccattgtggccgacgagtatgtggagatggacttcggcactggctgcgtgaagatgacccccgcccacgaccccaacgactttgaggtgggcctgcgccacaatctggacaccatccgggtgctggacgacaacggggtggtcaacgccaacggcggcaagtatgaaggaatggaccgctacgccgcccggaaggccgtggtggccgatatggaggcgctggggctcatggaaaaggtggaggactactcccacaacgtggggacctgctaccgctgccacaacgacgtggagcccatcatctccgcccagtggttcgtgaagatggcccccctggccaaggaggccatccgggtggtggaggaaggagagaccaagtttgtccccgaccgcttctccaagacctatcttaactggatggaaaacgtccacgactggtgcatctcccggcagctgtggtgggggcatcagattcccgtgtggtactgcgacgactgcggccacatgaccgtctcccgcaccgatcccaccgtctgcgcccagtgcggctcggcccatatccagcgggaccctgacgtgctggacacctggttctcctccgcgctgtggcccttctccaccctgggctggccggagaaaacccaggatttggactatttctaccccactgacgtgctggtcaccggttatgacatcatctttttctgggtggcccggatgatcttctccggctgtgagcagaccaaacagacccccttccacaccgttttcatccacggcctggtccgggacgaccaggggcggaagatgtccaagtccctgggcaacggcattgaccccttggaaatggcggagaaatacggcgccgatgccctgcgctttaacctggtcaccggcaactcccccggcaacgacatgcgcttttacacggagcggtgcgaggccatgcgaaactttgccaataagatttggaatgcctctcgcttcctgatgatgaacctgaccatcgaggacaatgccctgccggagaagctggagctggaagataagtggattctctccaagctcaacaccgtcatcgcggaagtcaccgaaaacatggaccactacgagctgggggtggccgcccagaagatttacgactttatctgggacacctattgcgactggtacattgagatgaccaaggcccgcctgcagggggaggacctcgccgccaaggagcaggcccagcgggtactgtgctatgtgctcacggagacgctcaagctcctgcatcccttcatgcccttcctcaccgaggaaatctggcaggccctgccccatgcggcggacaaccaagtgaagtttctcatgctccagtcctggccccaggcccaggccggcctggccttcccccaggaggagaaagcggtggagatgctcatggaggccgtgaaagccgtccgcgcccgccggtccgagatgaacgtccccccctccaaaaaggcacacctcaccattgccacccaggaagccgatattttcaccgccggcattcccttcctcaaacgcctgggttatgccagccaggtcaccgttaccggccctgccggtctgggcagcgacaaggaggaggccgccaagggcgtggtcaccgtcatcacccacgcagcccgcatcggtatgcccctggctgagctggtggacctggagaaggaaaaggcccgaatcgccaaggagctgaaaaagaaccgaggcgagctggaaaagctcagcaacaaactcaacaaccccggcttcctggccaaagcgccggagcaggttgtcgccgcggaaaaggagcgggcggaaaaactcaccgccctgattgcccagttggaggcccaggaagcctctctgtaagcaaggttttatccctcccttcccccttatgcagccccacccgtcttaaacgggcggggctgcatggtgtttcattgcttttatatagggaatccccgtacgagaatagtaagcgagatgaaacaacagctctttgggcacccggatgggcatatcccggccaaggaagggaagcagattttttcgattttccgcatcccagcacgcacgtgtcagccgctgaatgttccggctcaccccgcccactggtctctctgcccgttccgccattcggtccaccgcataaaccatgtcctttgtactcttatttgttacactaaaaatggtatccacctttttattacaggaacaatttttataatacttttatttattcttattgacatatcatagttaatagtttatatttatatatagattttaatatcaatttggaggtgattcctgtgcagatgtaacatgtcgccactattcaattccactccccaagcacatcagtactctgccaaatatacaacaatcaggaggaaagaaaaatgaaaattcgacgtttcgcttgttccgctttttccctctgtgttttaatgacgtccacgttgttcgccaatgcagcaaatattcctgaagacaacaggatctccgaatatgcaggggaaacaattcagtgtcaaattgttaaatgcactgataacaacacccctgagtcttctgtcattagcgtaaccattcctgaaggcgccacaaaagctcaggaagaccagatcatccaagccgccgcctttaataaaaccagcgacaccgacacatatgctgcccgtaacgttatggatctgatttccagagaaactgacgtatctgtaaattccaacggatatacttttgttggaagtggaaccatccccggccccgattacattactcttgttgttcaatttggtaattatgctaatttcggtgcaaagaaaatgtctgtagtcgtgagcggtggcaaaaacccagatagaagccacacaataacaaccgacatttctcccatgccatccaccacaatcactcttgtcatgtatactgggatgggtaacgtcttcttaactgatggaagcaccgtaacagcaacggcaaagacagatgcgtctcatgtagatgctgactattgcgaaatttgggtcagcccttgggaaatgtctgggggataatatacaccacagctgagacacttttcgtccaaagggggctctcttatgaaacattggaaacgatttctcagcgtttttatctgcttactgttcatgcttagtgccataggagccagcgcaacattttccgaccaagatcaaattcaaaacaccgaggcggtagacgtctgtgtctctctgaatatcatcggcggatatccggatggtttctaccggccggacgggaaggtcacccgcgcacagatgtgcaaaatgatctgtctgctgtgtaatggagggcgggaacccgcattggatacaactccctccaccagcttcatcgacattcagggatgggccacaccttacatcgccgcctgctacgcccaggacatcgtttctggggtcagtgaggaccgttttcaccctgacggccatgtaaccgccgctcaagctgcgaaaatgttgctggtcaccttaggatattccacagattatgagggattcactggggccgcttggtccaccaacgttaccattctggccacacaagctaagctctttgacgggttgaatctgtcccctacccaagtcttaacccgggatgaagccgctcagatgatttggaatgccctaaacgcctatgaggtcacctacaccacccagaccgtcaccgatgccaatgggcaggaaagcataaaagtagtccgtgaggagaaagtcattgcgggcaccacagataaacttacgctgatcaaagacaaatatagtattgatactccgcccacggaaaagaaaacacagccgtgaactttctccgttagggaataaaatccccaaccgacccacgcagaaagcacggccggttggggatttctcattgacgggatggctcaacccgttcccctctgcaccacttccaccatagaagggggcagaacttccaggattgatccaaaggagggctttcctctcccgctttgacaatattttccatcaaaaagcagtataatcgccgtgtaccggacaagctggtacacggcgatgttctttttcaaccaccctcaaaagaaaggggattttctctatggctgttgcctacaccacccataaccgcatgctcaccgtcgccctgtcgggggacatcgaccaccatcgtgtcaaaggcctggtgcaggacctggagcgggagatcgacgaagtgcttccccgccagctcattgttgactgcgccggcatcaccttcatggacagctcgggcattgctgtcctgctccggctctggcagcggatggaggaattggcggggaccatccaggtcaccgggctgcccgatcagcccgcccgggtgctccgagccgccggccttcagcggctcattccactcacctgaaaggagtgctacatccatgcgtaccatcaaatacaccaaccaggtctccctggtctttccctcccggtcggccaacgagtcctttgcccggtctgctgccgccgccttcgccgcccagctggaccccaccttggacgagctgggggatgtgaaaaccgccgtcagcgaggccgtgaccaacgccattgtccacgcctaccccgactccttgggaaaggtcgagctcaagctccgcctttaccccggcaacgagctggagctcattatccgggactggggcatcggcattgccgacgttgaacaggccagggctcccctcttcaccacaggcaatgaggagcgctccggcatgggttttaccattatggagagcttcatggactctgttaaggtccgctcacacccggggaaggggaccacagtcaccatgcgcaagcgattcgccatccgggcgggagggtccgtgtgatcgcgccagacaccgtcaccctcattcaggccgcccaggccggggacaaggaggcctgcggccgtctggtggaagaaaacctggggctcatctggagcatcgtcaagcggtacacacgaaagacggtggacaacgatgacctctaccagctgggctgcctgggctttctaaaagcggtgcaggggtttgacacccagttcggcacccaattctccacctacgccgtgcccaagatcgccggggaaatccggcggtttctccgggacgacggcatggtcaaggtgggccgcgggaggaaggaacaggcactgctcatccaccgggcccgcacccagctgaccgcccagctgggccgggagccggtcctgtccgagctggcccaggtcacagggctcaccccggaggacatcgccgcggctgatctggctgtcgcctccgtggcctccctccaggctgagtccggggagaacggtctgtccctggagggcatggtgggcagtgagtccccggaagagggcatggtggaaaaggtggccctgcacaccgccatcaaccggctgccagagcgggagcgcaagctcattttcctgcgctactacaaaggattcacccaggacaaaaccgcaaaggtcttgggcatcagccaggtccaggtctcccggctggagaaaaagtccatcctgtttctccggggggagctcagtgacgattagagtgcctcccagattccatcgtccacgatccggtctgcctgcccaaccttggaccaggagaattccgggaccaagtcagaggggcgcagggccgtgggccggggaatcagccctgcgagataggccagaagccccaccagtttttccggggtggtatgcgcccgcagatagcccatgtccagatcccggtcccgtttggacaggcgccgccctgcgggacttttgagcaggggaacatggcaataggtcgggacggagtagcccagctgttccagcagccaaatctgccggggggtggaggagaggaggtcccatccccgcaccacccgggtcacccccatccgtccgtcgtcctccgccaccgccagctgataggcgtaaatcccatcggaccgccggagaataaagtccccgcagtcccggtccagcctctcctgctgggggccaaacacctcatccacaaaggaaatgatctctcccggcacctggacgcgccaggcgggagaacggccgctctcttggagggcggttttttcttgggccgagaggcggcggcaccggccggaataaattcgggcgccgtcggcggcgtggggggccgaggcggccaaacgctccttccggctgcaatagcagggatagaccagcccccggctggccagcgttttaaacgccgcctggtagaacggggtccggcagctctgacaataggccgtctccccaggccgccagcccaggtcccagtccagtcccagccagattaggtcgtcggccagttgggataaatattccggccggcaccggtctgggtctaagtcctccatccgcaggagcagctctccccccaggtgccgcacatccagccaggccagcagggcggcaaacagattccccaggtgcattctcccgctggggctgggggcaaagcggccccggaccgttgcattggttgccatggtattctcctcccgctgcattttccccattgtatcacaggtccgctcttccagcaaacctccctttcccttgccattccagggcagatatagtagaataaaaaataaagtccctaaagccccgcgacacacaaataggaggatgccccatgaaaccacttcatccgccccgttttctccctcttatccttgccgctgcggcctgcggcctggctgccctctgtctgtggcaggtcctccagctgaagagtcagctgaaggacaccactctgtcccaggcagaacagctctccgcgatggacgccaccctgcaggccctccctcaccagatggaggacgccctccacacccaggcctccctgctggccaactatgactggcattacggcgacctgaacccggagaccggaaccctccctgtcaccttcaccgccgtgcccaaggagcagaccgccagtgtcaccaccgccacccttgtctgcaacgggaaatcctatcccatggaggcccaggacaccggcagtttcaccgtcacggtagaggttcccctcctccaatccctggcgtttcaacaggtcattctggcagagggtccgcagcagcgaatcgaggcactggacttgcaggaggcggccggcacggaggaattgctccacccgtggatcaccctggacaccaccgcttccctggaaaatgaccagcttgtatatgaagacggttccctttccatcgcacagatgacacccggccaggtccagtctgtcaccatggtggccgccgtggatggcaaagaagtgggcaaaactccgattccctgggaggatgtcccagagggttccgaggcttacttcccctttgacaccgcctatcccgccgcttccggccgtgtctttactctgtccgcggaggttgtggacagctatggcctccgctacgtcattcttgtggaccagctttccctccagcccgattctggcagcgccgtctccacgccggaagacggtccggagggcgccgcctccatgaaagtctactcctcccaaggaagcctgctctgggaaggacgaatggacacctttccatactaatacaacagaaagaaggaaatcccctatgtcaatcgcagccgtacgtgactattttgcccagtttggcatggcagacaacgtgctggagttctccacctccagcgccacggtggagctggccgcccaggccgccggcgtcatccccgcccggatcgccaagtccctgtcctttaaggtggatggcaaggccatcctcattatcaccgccggggacgccaaggtggacaacgccaaattcaaaaacgcttttcacaccaaagccaagatgctcacccccgaagaggtggtggacctggtgggccatgccgtgggcggggtctgccctttcgccatcaaggaagatgtggcagtctatctggactgctccatgaaacgctttccttctgtcttccccgccgccgggtccgccaacagcgccatcgagctgacctgcgaccagttggagcagtatgcccagaatgtccagggctggggggacttctgcaaggggtggcaggcggaggactgagcacccccgtgcgtttgcaggaaatacctgagacagcagaaaatcgcgtacaaaaagggggtgccttcgctggcatccccctctctttttgtccgtccgcagagcagatatccaaccaccaggcgttgccgcaaccacctgttgcttgcctctccccaccggagatggtacaatggccgcgaggtgatgacatggagacaaaggatgtgatcctgcagctacgcatccaaaacggatggacccaggaggaactcgcggaaaaactgtgtgtaacccggcaggcggtgtcccgctgggaaactggagaaaccacgccaaatccagagaccctgaagcagctgtccgccctgtttgacgtatcccttcatgcactgctgggggccccgaggcagctgatctgtcagtgctgcggaatgcctttggaggagtcctccatcagcaaggaacccgacggcacccccaatgaggcatactgcaagtggtgctatgcagatgggacgttcacctattccaatttggaggagctgatcgcatttcttgccggccacctgtccaacagccactggcccccggagcaggtccgcgcctactttaccgagctgctgcccaagctggcccattggcgttccagggaatgatattggacgcagaaaaccccggacgggaatcccgtccggggttttgtctggttggattgcctgggctcaggccagcgcagcggtgatgatggccatcttgtaaacctcatcggcgtcacagccccgggagaggtcattgatgggggcgttcaggccctggagaatggggccgtaggcggcgaagccgcccaggcgctgggcaatcttatagccaatgttgccggactgaatctccgggaagataaaggtattggcgtggccggccaccttggagccggggaacttctgctgccccaccaccggggacacagcggcgtcgaactgcatctcgccgtcgatggccagctcaggagcggcggccttggccttgtcgcaggcgttcttcaccttgtccaccgcgtcacccttgccggagcccttggtggaatagctcaggaaggcaatcttggggtcaatgccgaaggtcgcggcggtcttggcgcactccagcgcggtctccaccagggcgtcctcgtcgggatcgatctggatggcgcagtcccccatgcacaggcgctcgtccacgccgtccttctcccgctggagaataaagcaggagctcacgttgctgttgccgggcttggtcttaatgagctgaagcgcaggccggacggtgtccgcggtggagtaggtggcaccgcccagcaggcagtcggcctcccccatcttgaccagcatggtgccgaagtagttgcccttcatcaggttcttccggcagtcctcgggggtcatctttcccttgcgcagctccaccatcttctccaccatggcgtccatgccggcataggtggccgggtccacaatgcgcacgccttcaatgtcaaagccgcccttctccgctgcggccttgacctcggtctccacacccaccaggatgggggtcaggaaaccatccttcttcaggcgggcggtggcctccagaatccgggcgtcagagccctcggtaaaaaccagggtgcggggattggctttcagggtttcgatcagttttgcaaacatgataggttacctccaaatacaagacggttccgtctttttcttacgaaatcaaccagtttattgtagcactatctcaccgccgatgcaagggccgaaggggaattctcatcccagcaccgcccggcacaggcgggaaaccgcctcctccaccttctcctcctccaggccggaataattcatcaccagcacatgaggacggcggttctgggcggcaacataatattgggacacgaaggagatccgcaggtcctgggcctgggccgcctggagaatctcctcgtcgctgcgctgggtgtccagctccagcaggaaatgaaggcccgcatgctcctcgctgatcttcaccctgcccgccagaggggactgccgcagggccagcaggagcttgtcccgaagtgcccggtagtggttgcgcatccggttgatgtgtttttcaaaatatccctcggagaggaaccgggccaaggtcatctgctccaggcaggagaccgtgccggaataaaaccccagggtctcataaaaccgggtgaccaggtgcttgggcagaaccagatagctgatccgaaaggccggggccaggctcttggaaaaggtattgatatagatgaccttctccatcacatcaatgctctgcaatgtggggatgggccggccggccagacggaactcacagtcataatcgtcctcaatgatataccggttctcccctttggaggcccagctgagaaactcataccgccgactgaccggcatgacaatccccgtggggaagtgatgggagggggtgatgtggagaatctccgcgccgctctcctccagcttctctggaataatgccggcctggtccatgggaatgtgataggtcaccacatcgttcttctcatagatcttactcagccgaagataacccgggtcctccaccgcatagccccactggcgtcccaggagctggatcaggacgctgtacaggtactccgtccccgcccccaccacgatctgctccgggtcaatggtcatcccccggaattgatagaggtggtcggaaatggcctgccggagctgccggatgcctcccgcagaggtatcggtgagcaacgtcgcctcatcctcccccgctgtgacatcccgcagaagctttacccacacagagaagggaaacatatcccgggccacggaactgcccacaaaatccgcccaataggcccgcttgtcgggctcccggggcgcgggccccttgggccggggaggaagcggcgccaccggctcctcccgctccagctcacagacataatacccccgcttgggcagggtgtagaggaagccctccgccaccagctgtgcgtaggcgctctccacggtgatggtgcttacccccaaattcttggcaaaggtccgcttggagggcagcttctcccccgcccgcagctttttctggagaatatcctgcttaatacaccggtaaagatgctcatacatgctctccgtgtcaatgttttcaaaggaataggtgagcaaattccgggcctccttcccacaaactggccatgccacctggcacaaaaatgttttttctcatattatcaggtttattatagtcccacggtatccccttgtaaaggaagggaagccggaaaacctcttcgtcaatctatcagatttttcccacggtttttccccgatgtttggtgctcttttttggtcccattttttggaaaattctgccgaatgatttcttgtgaaaattatgataaaagcccaagggaaagtcccttaaaatttatgataatagagcggaatccccgcttcccctccctctgcccagtgttttccgcccaagccacaggtcattttgacggtttcccctcaggctccttcaccgtcagagtacttgcaaggttttttcttttcgtgtataatgaaacacgaatagaaacacatttgttcttgcaaagtgaacactggcagaggagctgcctcgaaggatatcttgatttctatcccaacacgacgttaagaaggagtttgcttatgagtgaagtacgtatcaagaacttcaagcgagtactggtggcaaaccgcggagagatcgccatccgcgtgttccgggcgctcaacgagctgggcatcacctcggtagccgtctactccaaggaagacaagtacgccatgttccgcaccctggcggacgaggcctatcccctgaacccggagaagggccccatcgacgcctatctggacatccccaccattttgaagattgccaaggaccacaatgtggacgccatccaccccgggtatggcttcctggcggaaaacccagttctggtggaagagtgtgaaaagaacggtatcaccttcatcggccccaccgtggacagcatgaacgccatgggcgacaagatctcctccaagcagatcgccattgcctcccaggttcccatcatccccggcgtggaccacgccatgaagaccgtggaggaagccatggaggtggccaagaaggtcggctatcccgtgatgctgaaagcctccaacggcggcggcggccggggcatgcggatcgtctcccgggaagaggatatgcccaaggagttcaaggaggccattgacgaatccaagaaggcttttggcgacgaccaggtctttattgagaaatacctgaagggccccaagcacgtggaggtccaggtcctggccgacaactacggcaatgtggtgcacctgtttgaccgtgactgctccgtgcagcgccggcaccagaaggtggtggagtatgcgcccgccttctccgttcccgaggcctcccggcagaagatctttgacagtgccattcgtctgtgcaagcaggtgggctaccgcaacgccggcacctgcgagtttctggtggactcggacggcaacccctacttcattgagatgaatccccggattcaggtggagcacaccgtcactgaactggtgaccgacgtggatattgtccgctcccagatcctgattgccgagggttatcccctgaactccccggagatcaacatcacctcccagaaggccatcgaatgccatggctacgcgatccagacccgtgtcacctccgaggacccctccaacaactttatgcccgacaccggcaaggtgagtgtctatcactccggctccggcaacggcattcgtctggacgggggcaacgtttacaccggcgccgagattctgccctattacgactccctgctggtaaaggtctgctcctttgaccggaccttcaagggcgccgcggtcaagtccctgcgtgccctgcgggagatgcggattcagggcatcaagaccaatatctccttcctgattaacgtcatcaacaaccccaccttccaggcgggtgcgtgctataccaccttcattgaggagacacccgagctcttctccctgtcccagagcccggaccgggtctccaagattctggacttcctgggggacaaaattgtcaacgtctccaagggagaaaagccctacttcgaggaccgtgtcctgcccaagtacgacgagaccgccctggtttacggtgccaaggacgagttcaagaagctgggcgccaagggctttacccagaagatcttgggcgaaaagcgcctgtatgtcaccgacacctccatgcgtgacgcccagcagtccctgatcgccacccggatgcggaccaaggatattgtgggcgcggcaaaggcctccaacgtgattttccagaacgctttctccgtggaagcctggggcggcgccacttacgacaccgcctatcgtttcctgaaggagtctccctggaagcgtctggagatcctcagcgagagaatgcccaacactctgatccagatgctgctgcgggcctccaacgccgtgggatacagcaactatcccgacaacttggtgaaggaattcattcggatctccgccatcaagggcgtggatgtcttccgtgtctttgacagcctgaactggatcgagaacatgaagatgcctgtggaagaggccctgaaaaccggcaaaatcgtcgagggctccctgtgctacaccggcgacatcatgagccccaacgaggtcaagtacaccttagactactatgtggaaaaggccaaagagctggaggccatgggcgtccacatcctggccatcaaggacatggccggcctgctgaaaccctatgcggcccagaagctggtggaaaccctcaagtccgagctccacatccccgttcacctgcacacccacgacaccaccggtgctggcgtcgccaccgtgctgaaggctgccgaggctggcgtggatatcgtggacctggccatcgagtccatgagctcctgcaccagccagccctccctcaacgtggtggtggaagccctgaagggcaccgagcgggataccggtctggactttgagggcttggatgagctgagccgctactatgagcatgtccgcaaggtctacaaagccaacgagagcggcatggtctcccccaacgcccagatttataagtatgagatccccggcggacagtactccaacctgctggcccaggtcaccgaaatgggctccaaggatgagtttgagaagatcaaggagctctatcgccaggccaacatccttctgggcaacctgatcaaggtgaccccctcctccaaggtggtcggtgacctggccatcttcatgctgaagaacggcctgaccaaggacaacatcctcaccgagggcgcctccctgtcctaccccgactccgtcatcgacttcttcaaggggatgatggggcagcccgagggcggcttccccaaggaactgcagaagattgttctgaaggacatcgagcccatcaccgtccgtcccggtaccctgctgcctgatgtggacttcgaggatatcaagcatcacctccgggagaagtttgatatgaagggcttctctgacttcgaaatggagcaaaaggcggtcagctacgccctgtatcccaaggtttatgaggactactgcacccacttcgaggcctacaacgacgtcaccaccctggagagccatgtctacttctatggcctgcgcaagggagaggagaccgtcctgaaggccagtgaaggccgcgatattctgatcaagttcgtcggcatgtccgatcccgacaaggaaggctatcgcgtgctgaccttcgaggtcaacggtatcctccgggagctgaaggtgctggataagaccctggaggttctggaggaccggaaactcaaggccgacaagaacaacccctgccacctgggctccaccattcccggcacggtggaaaccgtcctggtgaaggagggcgacgaggttaaggtcaaccagcccctgatgatcgtggaagccatgaaaatggaaaccaccttcgtctccaaggtcaacggcaaggtcgataagctttatgtggcccccggcgaccgggtcaacacggaagatctgttggtttccttcattttggatgaagaggaataatcccttaaatacacctaaaattcccctcgctcaggtgagcgaggggaattttttctattcatttttctgttttccttgggcaagaaattttaacataaagacctcaaaacacgatctgtcaaataaaatttctctatccggttgcggttaaaacaaaaaacgtcccccaccacagtgtggtgggggacgatctttactgattcatcagtggttcacaagggtcaattacttgccctcagcaacctcattgatggacttggacagtcttgcaacagcctcgtcgcagtcaacttcacggatggtcagcggaggcaccatacggatgatgttggcgccaatggcggtgaccaggaagtggttcttgatgcagtgacgcttcacttccacagcgttgatgccgtcttccagaacaacaccaacgaacaggccgcggtgacggacggtcacaacgtgaggcatcttagccagctcagcagcgaagtaatcgccgaccttcttggcgttctcgggccacttgccagccttcagctcacgcagaacagccagggaagcggcgcagctgacggggtggccagcataggtggaaccgtgggtgccggggccgaaagcagtggcgacacggtcggtgcaggcgatgccgccgatgggcataccgccgcccatagccttagccatggagacaacgtcgggcttaatgccataggtcatgtagcacatgaagtcgccgcaacggccccaaccagcctggacctcgtccagcagcatcaggatgcccttctcgtcgcagaacttacggatgccctggatgaactcgtcagttgcggggaacacgccgccctcgccctgaacaggctcgaacatgatggcgcaggtcttgccctcaacataggcagccttgaaggcgtccaggttgttgaactcagcataagtaaagccgggggtcaggtcgccgaagcccttctggatggcggactcgggctgaccggtagcggtcatggcgccgaaggtacggccgtggaaggactgctttgcggtgatgatgtgccaagcgtcgggaccgatgttctcaatgccccacttacgggcaatcttgatcatagcttcgttggcctcagcgccggagttctggtacataaccttgtccatgccgatggtctcgcagatctccttggacaggacagcctgaggaatggtgtagggatagttgaaggtctgcataatcagagcggactgctcctgaacggccttcaccaccttggggttgcagttgcccaggcagttaacagcgatacctgcatagaagtccaggtaagcttcgccgttctcatcatacatatagatgccttcagcataatctgccacgaaatccatacgctcgtaggtttcgatcatgtactttttgacctgagctttcagctcagcggcggtcagaccagtgtctttcagtctcataagaaattcctcccattcaaaaataaatgtaaatatagggatttccaggcctgtgaaccaagcccagtattcacaacagccggctactcattccgtctgttttgaatcacgtgccaggaaatccgtctttcaacgaatcccctgtaacttgtgactataatagcaccaatttctcaaaaatgaaatgcaccttttgcacaaattattcccaacagtttctggcgaaaatacaatttcccacgcaggattttatgcatcgtccgccgcgtccttctttctttttttcttttttccctgaaatttcaggttttatttccctccgcaaggagttttcgtccgtttcctccgtttctttttcaagtttttcccgcttcctttgtcattttgtgcttcgtcgttttgcacaagcaccattttccctgccctgacagcatttggccctttttttctgcccggccagggattgtcccgcccccctccgttgcttttccgcgcggttcttgttacaataagacatctgcaaaggaagtgaagcaaccatggaactgaaacgaatcacccacgcggaaaacgtccgcctctccgacagcgggcgggcggtgcgtattctggatcaaagccggctccccaacgagacggtttatttggaactctcccaggcggaagatctctacgaagccatcgcctccctgcgggtccgcggcgcccccgccatcggcatcttcgccgggtatgccctgtacgttttggcgctgcaaagtcaggaaacccaatatggtccctttttagaggcctgccgccggaaccgagattacctcaacagttcccgccccacagcggtcaatctgcgccacatgctggaccgggtgctggcggtggccgagtccatgccctgcgccgacgtcccctccatccaggcggccatgggccaggcggcccgggccattcaccaggaagacatcgccatgtgcaccgccatctcggaatacggcctgtccctggtcaaggcgggagacggcatcctcacccactgcaacgccggccccctggccacctcccggtacggcaccggcttgggccccttgtttctggccaaggagcggggcatcccccttcacgcctggtgtgatgaaacccgccccctcctgcaaggcgcccgtctgacagcctatgagcttcagcaggccggcatcgactgcaccctcatctgtgacaacatggccagccttgtgatgaaggaggggaagatcaacgcctgctttgttgggtgtgaccgggtggcccgcaacggggacaccgccaataaaatcggcacctccggggtggccatcctggccaagcactacggcatccccttctatgtgctgggcccctcctccaccattgactttacctgccccgacggggatcacattcccatcgagctgcgggacggtggagagctcaaggagaaattcttctccgcgcccgtcgccctgccccaggtcaaatgctacaatcccgcctttgatgtcacggatcacagccttatcaccgccatcgtcacagaaaaaggcatttgctatccccccttcgagcagagcttcgcccaggtcttcggccgcccggaaaaggaggccacatgaaccctccctatccctcagacgcccaggccaaggcggaaattttggacgccgggcgtaaaatttatcagcggggactggtggccgccaacgacggcaatctgtccgttcgggtgggggacaacgccctgtgggttacgcccaccggtgtttcaaaaggcgccatgacggaggatatgctggtcaagctctctctggatggcacggtattggaggggactcggaagccctcttcggagacaaaaatgcacttgcgcatctaccaggagaaccccgccgtccgcgccgtggtgcatgcccacccgcctgccgccaccgcattcgccgcggcgggccttcccctggaccgccctgtcctccaggaggctgtggtgcagctgggcaccgtgcctgtggccccctttgccctgcccggttcccaggcggtggcggacagcgtcgccccctactgccaggcgtaccgggccctgctgctggaataccacggcgcggtcacctggggaacctccatggagcaggcccactaccgtttggaatgtctggaacagctggccaccgtcaccctccacctgcggactttgggcattcatcgcacgatgccggagtccctggttaaggcgttggaggggctgcgccccgcctggggcatccagtgaccccgctgccgttctcctcccttcggagagggtttcccctttccgcccgcttattgggggcaattccacacagcttataccaaacttttcctgaaaaaacaacaaaaatcccaaaatttttgtaaaatctttcaaaagatgatggacagaaccgggaatctgtattactatatcaatgagaatgggcagaagaaaacggtttgtccgctctaaggaagcaacaacttgtcaacagtacaccgatttcggtcgaagttataagtatttcttccttatttgttgtagagaaacgttattgacaggatagcgtttctgaaataatatacttttgagctcactcaaagaaaggacctttctactatggctgaacgaaaacgcgaacgcgcaaaaaccagcgggactcccgcaagtatccgtgaggcgttgaagaaggcgacaactgagatgttggtgctcttcgtgctgcgccacaaatcaatgtacacctacgaaatgatgcaggagatcgaccgcatgagtacagggaagatcacctttaataccctttatcaagccatctatcgtctgcagagtttccagtacattcaagaggaaggtaaggtggtgtccgaagacaatcgagttcgtatttatttcgcaattactgcgtccggagtagactatctcgagaaactgatcgaggagtatcgttccttcaccggtgctgtggatcagatcctggatcaggagaattccaacaccattcgcataggagaatgctcatgatgttagcaaacgacttgaaaacctattacgatgaagttcgccgctacttggactgtcccaaggacgagcaagatcgtctgcttttgagtgttaacaagcaggtgattgagttacaagtggataatcctaatttggactatgacgggatcgttgaatttttaggagaacctgaaagtttagcagcttcgcttatggaacgtttgtctccggatgttgttcagaaattcaagaagaaaaagcgtcgtcttcgtttgagtatcattgcttgtgtcgcagttgtggtagttgctttatctacacttgtcatttatacatcaactattcagtctggtgtcaaaattagtgagaaaaacactatcgttattgacaaagacaatgttcctcctgacatagaagacgcaaagagctacattgaaaattattacaatcaaaaggagattccttaacgatgaatcctgctaaaaagatatgctctactattgtggccttggttttggttttctgtgcaatgcctttttcccaggctcaagcagcaaacgatcctgaaactcttttttatgtagaagacttaggtaatggcattactgtcgaaactactatcacaatttaccccggtgtgactcgcaatcagtcaacaagtgccatttcgagcagtgaatttaaaaacaatggcgtttggatcgctactgtttctttaaaagcctatttcacctacaatggtattactgcgggtgtaacaggtaccgaatactcgaaaagccttgcaagcggctggagctataccaaccacaaaatcacaacgactaatgtctcctccagcagcggtggcacagctactttgactgccacgttaaaggattttcccattaatgtccctgtaagactttccttgcattgtgctcctaatggtgccattaccagaggataattttatctctttgcatctaatataacaacagccgcaacgaaattagtttcgttgcggctgttgttatattttctatatatttagtgtctttcttcccttttcacatctcccgccgtccctccaacgcgcgcataagggtagcatcgtcagcatattctaagtggccccccacgggaacaccataggccagacgggtcacctttacaccgaacggcttgagcatacgggacagatacatggccgtggcctctccctccgtgtcgggatttgtcgccataatgacctcctgaatctccccctgcgccacccggtccaggagggatttgatatacaggtcgtcgggccccacgccattcattggggagagcaccccatggagcacatggtaggtcccgtggtattcccgggcccgctccatggcaatgacatccttgggatcggccaccacacagaccacgctgccatctcgtttctcactggcgcagatggggcacagcccctctccttccgtgaggttctgacagacggggcagagggcaatggaccgcttggcctccaaaatcgcctgagcaaactgctccacctcattctcgggcagagacaggacaaaaaacgccaggcgctgggcagtcttatggccaatgccgggcaggcgggcaaactgttccaccattttttccaatgcgggggggaagtattccatgaagctacctcttccttcttttcttggggatactgctgggcctcttgccagcgtctgcgggccggggttactctccccgcagggcccggatggcctgggcggggtccggcgcgccatagattgcgctgcccgccaccagtacgtcggcgccggcctccaccacctggcgggctgtcaccgggtccacgccgccgtccacttccagccggcaggcggggttacgttcctgaatatagcggcggatggcggcaatcttgggcagctgatcggccataaacgcctggccgccgaacccgggctccactgtcatcaccaaaatcaggtccaccttgtccagatagggcagcacggcctccgccgcggtgatgggccgcagggcaatgcccttccggacgccccgccgctccatggccgccagggccgcctgaatgccggggggcatatccgcctccagatggacggtcagaaggtccgctccggcatccgcaaacgcatccacgtagcgcaccggtttttcaatcataaggtgtacatccaaaaactgatcggtgaactttcgcagagatttcaccacaggcacgccaatgctgatgttggagacaaacataccgtccatcacatccacatggagccagtccgcttcccggacccgctggacatcccggcccaggttggcaaagtcggcggagaggatggagggggcgattgtaatcatgacacatcattcctttctcgtcagccgctggctggacagggccccggccagggcacacatggtccgcccgccgcataggatacggcaagcggcggcggggagcccttccccgcccaggagcaccgggaccgccgtcggtctttccttacgccacggaccggccccgacggcgacgacctggcagcccgccgcatcatatagcctttggaacgggtgccggctctgccggtcttttttgtccggcagggcgccctgttccatgggcgcggagacgcctggggcgccccctcaaacagtcttgggaccctggggcccccgggcctctcccccttggtcgggacattcggccgccgcggccggttctccggcccggcggtttccattctatccgcctttttcctccctgtcaatggaaagcagtccttgacagggcttctttctgcgggtaaaatgttataatattagagtatacaactttctggaaaggacgggtcccgcccatggcaaaattcaaaaagcgccctgtcatcccgatttacgccattgccctggtctgggtgatttttaccctggtgcacccgctgtatcgggtctccgactatgtgacagttatcctgctgtccgccgtggtcttcattgtggcaaagggcattttccccaccatatcctatgaaatgccggacccccaaccccaagcagcgccctctgcttcggaagaggaacccccagcgcaggacgccgcccaggaggcccaggaagaagccccgtcctccacgggagaccccaaaatagatgccctgatccaggaaaaggaccgggccctgcaggagatgcgccggctgaacgacgccattgaggatgagatcatctcccggcgcattgaccagctggaggacaccaccggcaagatcattgatcaggtagtggcccacccggaaaagctctcgcagattcgaacctttatgaactactacctgcccaccaccctgaaaatcctcaacgcctatgaccgcatgggcgccgcgggcgtttccggggagaatattgacagcaccatgcagcggattgaaaccatgatggacaccatcgtcatggccttccataagcagctggacgccctcttccgggacgatgccatggacattgcctcggatatcaccgtcatggaaaatctgctggcccaggaggggctcggcggcgcgcgtccggaccaagactaagaaaggaccggtttcatggcagacgaattcattcccgaactcacgctgaatcccaactctcccctggctggccagggacaggccgccgcggcccccgccccggcggcagcaagcaccccgccggcagaggcgcatttgccggagagcgacctggacgaggccaagctctccccagcccagcggaaagctgtggaggactttgccagaaccattgacatcaccgacagcaatgtggtcctccagtacggcgccgccgcccagaaaaatgtctccgagttttccgaaaacaccttgcagcagattcgcaccaaggacctggggcagatcggagagaccttggccgacctggtccggcagctgcaggaatttgacccggaggaggagaaaaaaggctttgccggctttttccgccggaaaaagaatcagctggccgccctgaaagccgggtacgccaaagcctccgccaacgtggatcaaattgtggaaaacttgcaggcccaccagatcaccctgatgaaggacgtggccaacctggaccagatgtttgagctgaacgccaagtatcagcaggagctgaccatgtacatcctggccgggaaacagcgcctggcccagattcagcgggaggacttggcccagctccagcagcaggccgccgccagcgggacccaggcggatgcccaggcgtacaacgacatggtcagcctgtgcaaccgctttgagaaaaagctccacgacctggagctgacccggatgatctccctgcaaatggggccccagacccggatgctgcaaaataacgacaccttgatgattgaaaagattcagtccagcctggtcaacaccatccccctctggaagagccagatggttctggccctgggactggagcacgcccggcaggccaccgccgcccaaaacgcggtcacggagatgaccaacaacctcctccggcagaacgccgacctgctgaaaacagggaccattgacaccgcccgggaggctgagcggtccattgtggacctggaaaccctccgccataccaaccaacagctgatggaatccctggacgaagtcctgcggattcaaaccgagggaacccaaaagcgcagagaggccgaggcagagctgggccggattgagggcgaactgaaacaaaaactgttggccctgcggacatgatccctccgccccgccctgggggcgcgtgtttcctgccagcgcatcgtttgcgccgcagacggtgatatcgtttggaacacctattctctcttggaggttcctatgaaatttttcaagaaaacatccgtcgccatcctgctgacggccctgctggtggccctgtgctgtgtctggggctactcccgggcctatgaggccagccactccgaccccgactcggtggtgcagagccagcgggccggggagagcggcctcaactactttctcaactggattgatgacggcgccggtctcttttccatggagaccaccgacaccctggcccgaaacaacctggacctaaacaacacctacggatgtctgctggcgctgaagacagtgaactatctcaacggccaggacatcgcatcctattccaaggacctcttccagcaggtcgatctgggccggaaggatatgctgctggtcattgagtccagcagccaggcctggtacctggtctacggcgggggactgcgaacctatgcggagaataacgacgccctggccgccctgctgaaggataacctggacacggattttttccagggcgagagtgacgcggggattttatccctgttcgatgatctggagcactggtgcgcggagacccttcctgttttggatgacaccccggaaccgggcaacccgttcttacagaacgacaataaagttcagattctctcccttggcgatgttttgctggggattctctttaccctgctggtcaatatctggtggattattctgctgctggtggtgctgaacctgattgaccgccaccgttttcgggaatatatcaccaagcacccccccggctccctctccaatcccccggtctttttccgtcccctgctcttctggcacgggcagggctcgtcctggtaccgccgtatgctgtacctggtgtccgaggccccctacgaggacgacgacgatttcgaggacgacggcgaccagccgggccccgatgggaccggcggcgcgcaggagaacgcctacaccggccccgggccggatgtggggccgcaggcctcgggattccggggagacccccaggaagcgttccgccgggagcaccgcggcctctggggaacgtggagccgcctttgggacatggggtgggaatgggtgcacctgctccaggaccaagtcagccgcctgttcggtgggcggcgcatgtagtcccctttcccctttcttttggataccctgggccgaagtttcttcgttcccagggttttttgctcccgctctcaaaaggcaaccccaccggctagagatactctctcgaaccggtggggtttttcgtccctttttggccttctcccctcacgcctccggagtgttcgcttccagtacaggctgggggggaagatcccctttcaccgccacacagcggttgatcttggtgcccatgttatggaatttttcctcatagtcggtcataatcccctggatgccctgggcatggaggtcgtgggtcacctgctctggatagaaaccgcccaagggaaactccgtcacggaaaaggcaaacagccccacgttgtccgtcttgaagtgaatctctccccccgcccgcagcacctgccggtagcgcagcaggaaatcccggtgggtcagcctccgcttggcgtggcgcttggggggccaagggtcgcagaagttaatgtagatgaggtccacctcatccggggcaaaaaacgccggcagattggccgcgtcggcgtcaataaagaagacattgtgcagctccatgtcccgggcccgttccatggccatgaccatggcgtccggcacccgctccaccgccacaaacaggacctccggcgcggcggcggccgtctggcaggtgaagcggcccttgccgcaccccagctcgatccggagctccttggctccgggcagcagggagcgccagttgccccgcagagcctgggggtccgaaatcagccactgggcacaccgctccatccggggcaccagattcttttttcttctcatacgcattgggtttcctcctctgatggcagacgcaaacttgcgaaaccccggggagtttcgtcactttctggctatcataccataagtttctccctttgtcagcgtctttctcccgattttcacccttctccggtcatctttcccttgtcgaaggggcaaaaaagcggtatgataaaaggtacaaaatccggaaaggaaggggcctgtcatgggtgtgcacgaggggcatcgggaccgaatgaagcgggaatttttgcagggcgggctccgccatttctccgagccccgggtgctggagctcctcctattttactcccgcctccagggagacgtcaaccccctggcccaccgcctgctggaggcctttggctccctgtccggcgttctggacgcctcccccgccgacctggccaaggtccccggcgtgggggagaacaccgtggtcctcctgaaactcatccccgccgttgccgcccggtacttggcctcccgaaccagcgccgacgtgatcatctccgacagcgccagcctgcgcaccctgtttctcccctacttctttggggcccgaaatgagatgtcctttctggcctgcttcgacggaaagctcaagctcctgggggtccggctgctcagcgagggcagccccagcgccaatgagatcagtctgcggaagattgccacggaggccctggccttgggcgccaccgccgtggtgctggcccacaaccatcccagcggcatcgccaccccctcccaggaagatatttttatcacccactacatccgggacgcccttcagcccctgggcatcacactgtatgaccatgtcatcatgaccgatgacgacatggtctccctgaaggacagccgtcacttaaattccttttaacccccatctgaaaacaactgtacgggaggtttctatgcctaaatttcaggtcgtcagcgactacaccccctccggggatcagccccaggccatcgccagcctggcccagggcgtggagctgggattgaacgaacagacccttttgggggtgaccggctccggcaaaacctttaccatggctaaggtcattgagcaggtccagcgtcccacccttgtcctggcccacaacaaaaccctggccgcgcagctgtgcgcggagttcaaggagttctttcccaacaatgcggtggaatactttgtctcctactacgactactaccagccagaggcctatatcccccacaccgacaccttcattgagaaggacagcgccatcaacgacgagattgagcgcctgcgccactccgccacctccgccctttttgagcggcgggatgtgatcgtggtggcctcggtctcctgcatttacggcttgggggaccccatcgactacgccaacatggtcatctccctgcgcaccggccaggagcggcccatggagcagctgctgaacaagctcacggagatccgctatgagcgcaacgacgtggccttcgaccgcaaccgcttccgggtccggggggacacggtggaaattttccccgtctacgccaacgaccgggccatccgggtggagttcttcggggacgagatcgaccggatcagcgagatcaacgtggtcaccggcacccccacccgggtggtggaccatgtggccatctacccggcctcccactatgtggcctccaaggaaaaaatggccgccgccatccaggagatctaccgggagatggaggaacgggtggccttcttcaaggccaacgaccagttgctggaggcccagcgcatctcccagcgcaccttgtacgacattgagatgatgcgggagctgggctactgctccggcattgagaattacagccgggtcatcgccggccggcccgccgggtcccctcccatgaccctgctggactacttccccaaggattttcttctgttcatcgacgagagccacgtgaccctcccccaggtgcgggccatgtacgccggggatcgggcccggaaaaccaccctggtggactacggcttccggctgccctgcgcctttgacaaccgtcctttgaactttgaggagttctcccagcgggtcaatcaagtgatctatgtctccgccactccgggggagtatgagcgcagccgctcgggccagatcgtggagcaggtcatccgccccaccggcctgctggacccggtggtccaggtccgccctgtggagggccagatcgacgacctgatcggggaaatcaacgcccgcaccccccggcaggaacgggtcctggtgaccaccctgaccaaaaagatggcggaggacctcaccagctatctccagggggcaggcatccgggtgcggtacatgcaccatgacgtggacaccattgagcggatggagatcatccgggacctccgcctgggcacctttgacgtgctggtgggcatcaacctcctccgggaggggctggacctgcccgaggtctccctggtggccatcctggatgcggacaaggagggctttctccgctcggagacctccctcattcagaccatcggccgggcggcccgaaacgcccagggcctggtcatcctctacgccgaccgggtgaccccctccatggccgcggccatggaggagacccagcgccggcgggaaattcaaaacgcctacaaccaggcccacggcattgtccccaagaccattgtcaaatcggtccgggacctgatcgagatctcccacgccgccgacggcaaggagaggaagggaaagggggccaaggccctcacccccaaggagaaggccagcctcatcgcccagttggaacaggagatgaaggaggccagccgccggctggagttcgagtacgctgccattctgcgggatcaaatcatagaattgaggggggccagcgagaccggctgacccctgaaggaggcttctctatgtccatgcagtaccactgctgtcttttgaccctgtatctcctggcgcttcgctggccgggtccctctgcttgtccccagcaagtaccggtattttggattgacagaaaggagctttcccgatgaagcaaacgaaacaggcgggcgctgccgcccttcccaagtccggttattttgccatggtctgtattctcattgccggctccctgtgggggtgcctggggctgtttaaccggcatttgtccgccctggggatcgccccggagaccgtggtcatgctgcggaatctgggggcctgcctcattctcggcctgatttttctggtctatgaccgcagtatttttcgcattcgcctccgccatctgcccattttcctctgctccggcctcatcagcattctcttttttaccctctgctacttccgcagccagcaggtgtcctccctggcggtggccgcgatcctgctctacaccgcccctaccttcgtggtgatcctgtccgcccttctctggaaggaccggatcaccaagcggaaactggccgcgctggtgctggccttcctgggctgctgctttgtggccggcatcctcaacggtgccctgaccctgacccctgagggcctgcttctgggcattggcagcgggctgttttacagctcctacaccattttcggccggtttgcgctgaagcattaccagccctttaccgtcaccttctatacctttctcatcgccggcattggctctctattcatgacgagtcccggggaccttagcaccaccttccactcccccatggggattctcctctccctggggcttatggtggtggggacagtcattccctatctgctctacaccaaggggctcagcgacctgggcgacagcggaaaggcctccatcctggcctccgtggagcccgtggtggcctccctggtgggcatcgccgctttcggggaaccaatgaccctgggcgtcgttctgggcctggtgtgcattctggcctccgtgtacattctgaggtgatcccatggcaaaaaataaggaagaaaaaaccaacgtggtccgcatattagaggcggcgggcatcccctgcaccgcctatgaggttcccctgcccaagggcaaggtccccgacggcgtcaccgccgccggcctgctgggcaagcctgtggagcaggtattcaagaccctggttgcccagggccccaagggggaacacttcgtgtatgtcatccccgtggccgagaccctggatttgaaaaaggccgcccgggccgccggggtgaaatcggtctccatgctcccccaaaagcagctgctccccctcaccggttatgtccacgggggctgctcgccggtggggatgtccaagtcctttcccacctacttcgcggaagaggtgatcttggtggacaccatgatctgctccgccggaaaagtggggtatcaggtggaggtggcccccgacgatctgatcgccctggtgggcgggcaggtggcggacctcacccagcaataacacaaaaggaagaagatactcccatgcaatctcacattcacgtcaaaggcgcccgcgccaacaacttaaaaaatattgatgtctccatcccccgggataagctggtggtgatcaccggcctgtccggttccgggaagtcctctctggccttcgacaccatttacgctgagggacagcggcggtatgtggaatccctctcctcctatgcccggatgtttctgggccagatggaaaagcccgatgtggactacatcgacggtctctcccccgccatctccatcgaccagaagaccaccagcaaaaatccccggtccaccgtgggcaccgtaacggagatctatgattatctccgtcttctgtgggcccgggtgggaaccccccactgccccaagtgcggcaaggagattcgccagcagtccgtggaccagatcatcgaccagattctctccctgcccgagggcacccgcattcaggtgctggcccctgtggtccgggggaaaaagggggagcacgtcaaggttttggacaacgcccggaaatccggctatgtacgctgtcgggtggacggggctctctatgaactcacagaggacatctctctggagaaaaacaagaagcacaacattgaaatcgtggtggaccgtctggtcatccggccggacatcctccgccggctcaccgactcggtggagaccgccgcctccctggggggaggtcttctgctcatcaacctggtacaggaggacagggacctcaccttctcccaaaactacgcctgcgaggactgcggcatctccattgaggaactggccccccggatgttctccttcaacagtcccttcggcgcctgccccacctgcaccggtctgggcagccagatgaaagccgatccccagctggtcatccccaaccccgccctgtccatcctggacggcgccatcgccgtctccggctggcagaatgtgaagggggattccatcgcccggatgtactttgaggccctgggcaagcaatacggcttccagctcaccacccccttccaggacctctccccggaggcccaggaggtcatcctccatggcacccggggggaaaagctcaagctcacctaccaccgggccgacggacagggcacgttcagccaggcctttgagggaattttacacaacgtggagcggcggttcacagaaacccagtccgatgcctcccggaaggagctggaggaatgcatgagtgagtgcccctgccccacctgccagggccgccggctgaaaaaggaggccctggcggtgaccgtagggaacctgaatatcgacgaattctgccacaaatccgtcaccgacgccctggattttgtggatcatctgaccctgacggaaacccaggcccagattgcccagcagatcctcaaggagatccgctcccgcctgaccttcctgcaaagcgtggggctgtcctatctgaccctcagccgccaggcgggcaccctgtccggcggcgagagccagcggattcggctggccacccagatcggctcctccctcatgggggtgctgtacattctggacgagccctccatcggcctgcaccagcgggacaacgacatgcttctggacaccctcaagcgcctgcgggacctgggcaacaccctcattgtggtggagcacgacgaggacaccatgcgggccgcggactacattgtggatatcggccctgccgccggggtccacggcggccaggtcatcgccgcaggcaccgcagaggagatcatggccgtgccggcatccatcaccggccagtatctctccggcgccaaaaaaattccggtcccctcccgccgccggaccggcaacgggcacagcctcaccattcggggggctgcggagaacaatctggaccacgtggacgtcacctttcccctggggacgttcacctgcgtcaccggtgtgtccggttccgggaagtcctctctggtcaatgagattctcttcaagcggctgggggccgacctgaaccggatgaaggtccgcccaggcaagcacacggcgctggagggggaggaatttctggacaaggtcatcgacatcgaccagtctcccatcggccggacgccccggtccaacccggccacctacacagggctgttcggggacatccgggagcttttcgcctccacccccgacgccaagtcccggggatatgggcccggtcgcttctccttcaatgtgaagggcggccggtgcgagtcctgcgccggggatggactgctgaaaatcgagatgcactttctccccgatatttacgttccctgcgaggtctgcaagggaaaacgctacaaccgggagaccctggaggtcaagtacaagggaaaaaacatccacgatgtcctggacatgaccgtggatgagggactggccttcttcgccaacctccccaagctccgccggaagctggagaccctgtcctcggtggggctcggctacctgaaaatcggccagtcctccaccacgctgtccggcggcgaggcccagcgggtgaagctggccacagagctggcccggcgctccacgggaaagaccatctatatcctggatgagcccaccaccggcctgcacacctacgacgtacacaagctgctggaggtcctggaccgtctggtggaggggggcaacaccgtggtggtcatcgaacacaatttggatgtcatcaagtgggccgaccacgtgattgacctgggtccggaagggggcagcggtggcggccacgtggtgtgcaccggcacccccgaggaggttgcccagtgtgaggcctcctacacgggccggtacttgaagaagctgttaaagtaagccgcagggcttttccacccgggctgcccgcagtcaggtcccaatccgcccgcgccggcatagaatgggctggaggtgttgcttgtggaaatcctgatggccctactgtgcgcggcgctgctgctgtggttcaaccgcctcattttcacccgcctgatctcccccgcccagcagggcacggtccccgtctttgccgtgatccccgccgtgggggacggcgacgggctggagcaaaccctgcgccacctgcactggctgcagggggaaaaactctcccagttcaccctgctcattgtggacgcgggactgacccccgccggacaggacctggtccaggcactccagcgcaaagacacctccctgctcttctgcccggcagaggaggccaccctcatcctgaaaaggaaggacgaccatggatacttctccctctgaactgattttactggacggcaccgtctcctccgtcatctaccgcaatgaggagaacggctataccattctgcgcctggaggccccggaggcaggggaagaggtcaccgtggtgggcaccatgccgggcatcagcccgggggagggcctgtccgttcacggacagtggacccgtcacagcacctacggggagcagttccgggcggagatcgtggagcggcggatgcctgtgggggaaaaggccctgctggaatacctggcctccggggcggtgaagggggtgggggccgccatggcccggcggctgctggatgcctttggggaggatgtgctgacggtgatcgaggaggccccccgccggctcaccgaggtgaagggcatctcccccaaacgggcggagaccatccaccagtccctgtgtatgcagctttccatgcggcggctgctggattttctctccgcccatgggctctccctctccctggccatgcccctgtaccggcggtatggagacctggccctcaccgccctgcgggccaacccctaccttctcacggaggaacccctcttcacccccttccccgccgcggacaagctggccagggagctgggactggaggcggacgaccctctgcgcctggaggcggggcttctctacaccctctctcacaacttggacaacggccatgtttttctcccctatgccaagcttctgaccgccgcccagcggctgctggggacggagtcctccgtgctggaggaccatttggagggcttgacggaccgcgggaccatcgttcgggaggaaattgccggccaggatgcctgctacctggccaggctccactactgcgagacctatgtggccaacgccttgctggagatggagggggaaccgctctgccccccagaggacctggacgcgctcctggaccgaattcagcgggaacagggtctcacctacgcccccctgcaggtggaggcggtgaaaaccgccgcccagcggcaggtgatgctcctcaccggcgggccgggcaccggaaaaaccacctctctccggggcattctgtctctgttcgaccatttgcagctgcgcaccgccctcacggcccccaccggccgggcggccaagcggctttccgaaacctgcggcgccgaggcctccaccatccaccggctcctggagccccggtacgacagccagacggggggactcaccttcgcccacaacgaacgggagcctctggacaccgacgctgtcattttggacgaggcctccatggtggaccttgtcctcatgcaggccctgctggccgccctgcccggcggatgccgtctggttttggtgggggacccccaccagcttccctcggtggggccgggcaatctgctctcggatctgctccgctcccggcggctgcccaccctccgcctgacggagattttccgccaggccgccgcctcggccat

SEQ ID NO: 2231 - DNA, 52861 bp, KLE1738
gggggatgagatgggagaggataccggatggaaccaagaaccctgctgaacgccttggccgtggcagaacggctgaaggggaccacccgccactgctacacttccaacggcaggcgggagagcgtggccgagcacagctggatgatgaccttgatggcctttttcctgcaagaggaattcccggaagccgacatgaacaaggtcattcgcatgtgtatcatccatgacctgggggaggcctttacgggggacatccccagctttgaaaagagcccggcggacgaggatcgggaggagacgctgctgcaccggtgggtggcctccctcccggcgtcctgcgcccgggaaatggaggaactgtacgaggagatggcccagcggaacaccttggaggccaagctctataaggccattgacggattggaggcggtgatccagcacaacgcctcagacctgtccacttggattccgctggagtacacgctgaacaaaacctatgctgacgacaaggtggccttttccgactatctcgtggcactgcggcaggcggtgcgggaggacaccctgcgtaagctgggagagctctgagcgtctctgcccagagaagataccttgcatccacagagaggccgccggcgcagatgcgccggcggcctctctggtttgggtggatgttttcaaaaaagacacggaaatttaacgaaaggatgggggaaaactttacgggcgcctgatacaatcaaaccggaagaatcagaaacgtacagtaagaacgcgggcctgggaggcccagacaggagggaatacggtgcaaacgttacggaataaaaagggattcatctgtgacatggatggcgtgatctaccacggcaaccgtctgctgcccggggtccgggaatttgtggactggctgcagcgggaaaagaaggactttctgtttttaaccaacaacagcggaaagacccagcgggagctgcaagccaagctctcccggatgggattggacattgacgagaagcatttttacaccagtgccctggccaccgcccagtttattgccacccaaatgccgggggcccgggcctttgtcattggggagcccggcctgctcaacgccctgtatgaacagggcatcacctttgacgatgtctccccagactatgtgatcgtgggggagtccagcagctatacctatgacaatatctgccgggcggtgcggtgcgttcaaaaaggcgcccggctcattggcaccaacagcgacctgaccggccccaccgagcagggcatcgtgcccgcctgtcgggccctggtggcccccattgagctggccacggggaaggaggcctactacatcggcaagcccaatccgctgatgatgcggacgggcatcaacctcttgggggggcactcccaggacaccgtcatcattggggaccggatggacacggacatcgtggcgggcattgaatgcggcctggacacggtgctggttctctccggggtcacagaccggtccatgattgaccacttcccctatcgcccccggctggtcttgcagggggtgggggacatcccggacgcggcggaggaggggatcgtgcatctggagtccgcagtgggctaagggcctgcccgccccgggacggtctattcctggtgggagaaaacaaaaaaccctgaaacctctcggcttcagggtttttctggtggacgatacaggacttgaacctgtgacctcccgcacgtcaagcggatgctcataccagctgagctaatcgtccgtctcttgcggaacgagtattattttatcggatttcgggagatttgtcaatagattttttcaaaaaacttttgtgccgcgccggttgtccgccggcccccggggatggaaaaattgacaagggaaggggacttctctataataccattcagttaggaatggcgcgcggcggaatcaggaggggcccatgattgatctgaaccacatcgcccggtaccaagagaacaaccgcattgaggccaaaaaggccgcggggggctttccccacagcctgtgggagacctattccgcctttgccaacaccatcggcggtctgatcctgctgggggtggaggaggcccgggacaaaaccctccgggtcaccggcatcccggatggtccagggtatgtacgtctgttctggcagacggtgcaggaccccgccaaggtcagcgccaacattctccagccccaggatgtcaccctccacaccattgcgggcaaagaggttctggtgatctccgtgccccaggcagagcggcaccagcggccagtgtacattggggacagcccctttaccggcgcgtaccgccgggacggcgagggggactatcactgttccccagacgaggtccgggccatgctgcgggaccgggacgacgcccccgccgacctggcggtgctggagagccgtggaccggaagtcctctccggggagaccctgcgccagttccggctgtgcatggtgatgcggcagccggaccatccctggaacgccctcccggatgaccaattcctgcctgctgccggtattttggggccgggacaggggggaaaactgcaccccaccttggccggactcctgctgctgggcaagcgcaaggcgctgcgggcggtttttcccgcctttcgcctggagtatcgggagacggacaccggattttgcctgtccacccttcgcccggggccgccggaaaatgtgttctccttttacaccatggtctcccggcggctgactgcggtctcctctctgctggcccaggacccgggggagggggaggccttggccggcgccctgcgggaggccgttctcaatgccgttctccacgccgattacttcagccggggcggcctgaccatccagcggaccgccgcggagctcaccgtctccaacgggggtctgctccgggtttcaccggaacaggcccaggccgggcgggcggctgatccccggaaccgggggctgatccagctgttttccctggtccgtctggccacggggacggggcaggggctccatgggatctatgccctctgggcccggcggggctggcagacgcccaccctgtcccaggcgtttcgcaccggcgtgacccagctctcccttcccctcccgccccagaccttctcttcggcggagctcacccaacggcagatcatcgcctacctcaccgaccatgtcaccgccggcgttaagaccctggcccaggagctcggtctgcccgacggagaggtacaggcggggctggatgcccttctggggcgggacctggtggtccggcaggggagaagctaccgtctgcgggcgtaatagaggaacgagggtacccctttttgcctcttcccgttttattaaaaaatcagaagcctccctgtctcagggaggcttcttgcggtttgtccgttctgtggatcattagggtggggttgtctgatccttgaggatgggctggagatgcatgagcaggtccaccttgttgttgacctcaaatttcttataaatgttggcaatatgggtgcggacggtgtagatgctgatgtggagctcctccgcgatctgttcattcttcatgccggaggccaggtagtagacgatccgccgctcctgttgggtcagggtgttgtaggggtgattcaaattcttgggcaggtccttggtctggcaggtgatgagcataaggtgccaggtttggatcaggcccgccgcgctggaggagagaaacgaggtgtgataaaaggtgatgtccccggccggagaagtgaaggtctgactggttccgccctgggtggtcagacgctcgctgatctcgttgatcatggtctggacctcccggaacttggggtctccctggtaattgctccggaggaagtggccctggttgtgccggtactgttcccagaagatttggctgatctcctgggccgccttgttggtctgcatgaccgtcatgtcctggttgaggatcaccgcccccattttcacgtcttggaaaaagagctggaagctgtcatggaaccgggcctccccgctgtggcggagatagttctggtagttggcctccaccagctccgccagatactccagcaggccccgctcctcttcccgaaagccgccctcctctttggtgtgaaagagccccatggaaccgatcacccggtcccccaggaagaagaagaggaccgcctgataatataaatcctcggcggacatgtgaatcccgtagggggtgcgctcatagtcctccagggtcataacgtcctcggtgaaaatcacccgcttccccttcagatgggggggcagagaggaatagcggaagatgtcatccttgtaaatgtgatctttgtagtcatacatggggccataccggatgccgtaggtgatgtagttgctcagggtgttcacccgccgggcctggcccccgggaaaggccgtgtagtgataggggaagaagatgctgcgccgaaagccgaaatgcttgtcgaacagtgccagcacttttttgggaaaattgtcgctgtccctggccagatccagggaaaatgccattgctgcgtcgtgccagggttctggaattctgctgatggcaggtacctcctttccgcaccggaagggtccggatcttgccgtgaaatgacagatttgctgcatcatttcctcggcatcatttctgtattggcgacattatacacattttataccataaattcaatcccttctcctcaaaaagcatcagaaaaatttgtgacctttttgtaactttgccttgacaacccgccttttcggtgtataatatagctaccctatgacatgaattagtgcattttagtataaaatgaacaaatacaagacagtacaggaggatacctcaaatgcaaccgagagatgtagtcattgtcagcgcctgccgtaccgccatcggtaagttccaggggcaattcaaggatgttcccgccagagaacttgccatcactgcggggaaggaagccattcgccgcgctggtgtggacatcaacaccatcgacgaaattgtcatgggcgagtgctataccgccatgcagggttccctgcctgcccgccaggtctccatgcggatcggcctgcccattgagagcagcgctgtcaccgtcaaccagaactgcgcctccggtatgcgcgcgctggaaatcgcctgcaacaacattcagctgggcaagaccgagatcggcctggtggtgggcgtggaaaatatgacccaggcccccttcctgctgcccaaagcccgtatgggctatcggatgggtggcatccccaccgagggcggcgcggagctctatgacagcctgctccacgacgcactgtacgacgccctggtccccggccacatgggtgtgaccgccgacaacgtggccaagctctgcaacgtctcccgggaggaatgtgacaagttggccgtcatcagccacaaccgcgcctgcgccgccatcgacgccggcaagttcaaggatgagattgtccctgtggtgatccacaacaagaaaaagggcgacattgtcatcgacaccgatgagcaccccatccgcaactgcagctatgagaccatctccaagatgaaggcggtctttacccccgatggcgtcaccaccgctgccaacgcctccggcatcaacgacgccgctgcggctgtgattgtcatgtctgcggacaaggccaaggagctgggaatcaagcccatggccaagatgatcaatatgtgctctgccggcgtggagcccaagtatatgggcattggccccgcctatgccattcccaagtgcctgaagggcgccggcatggacttctccgaggtggactattgggagatcaacgaggcctttgccgcccagttcctgggcgttggccgcaagctgaaggaggagcacggctgggaagtggacctggacaagaccaatgccaacggttctggcatctccctggggcaccccatcggctgcaccggcctgcggatcattgtctccatgctctacgaaatggagcgccgcggcgccacagtgggcggcgcctccctgtgtgtgggcggcggccccgccatggcctccctgtggaccaagaagatggactgagtcctctcgtttcccttgtataaaaaattgtgcctggcacaattttccggtcaacaccggagtagatccgattcgttcggttgaaatccagagaaaatgcctgccgcatctgcggcgggcattttttcgtgataggctttcgcggttgcgcacggtttcaaaacatggtaagatggaacccataaacaggcgggcagatccattggcccgcagattggaatgcgcccagtgaggaggaactgcatggatcatagatggctggaaattgtgataaacgcgaggtcggaggaactggatgacctctgcggcaaactcattgccaacggcgtgcccggcctggcagtggaggaagaggaggagttccgggcctttttggaggagaaccggcagtattgggactatgtggacgatgcccttatggagcagatgaagggggtctcccgggtcaagatttatgtcaccgatgatgccgacgggcaggcgcagctgaagggctatctggccggcattgacctgccctataccaccgccgccctccgggagtacgactgggcccacagctggcagaagtattaccggcccatggcggtgggggagaagctgtacattgtcccggaatgggagcgggacaccgcggacattcccgccggcgccacccggctgctgatgaatccggggcttaccttcggcaccgggtcccatgcctctacccagctgtgcttggaggggcttgaggcctgtacccggaagggggaccgggtgctggacctggggtgcggcagcggcatcttagccattgccgccctgtgcctgggagccggtcaggcggtcggggtggacattgaccccaaggctgtggacgtggcctatgaaaacgccgcgctcaacggcatcgggcgggaccactgccggtttttggccggaaatgttatcgcggaccaggggttagttcaggaactggcccgagaaaaagcccaggtggtgttggccaacattgtggcggatgttatcatccccttggcgccggtggttccccaactgctggaccgtgaggggaccttcctctgctcgggcatcatcgacacccggggagacgaggtggccgccgccctggagcaggcggggctgctggtgacaacccgccgggaaaagaacggctggattgccctggaagcccgggtgcgatgacgccatgagagcggttgtacgtcccctctccctgccggcggaccggcgggtgctggtcatcagcgacattcacggcaatcttccctttctcaagggcctgctgaaaaaggtccagttttccaccgacgacattctgctggtcctgggggatattttggagaaatccaccggcggcctggacaccctgcggtatctcatggacctgcgccggacccataccctcttcttcctccagggcaactgtgaaaatgtcaccctggactttctcaacggggcctggcccgaccaggccgccgcccagtatggaaacttttggggggagaagtgcgcctgggtttccatggcccaccaggcgggggtggatgtctccgatcccaaggcatttcccgccgcccggcaggccattgaggcgttgtttcccgaagagctggcctttctccgggccatgcccactatcctgctccatgaacactacctttttgtccacggcggggtccccagagagcaccatttagagaccctgagcgcccgggcgtgtatgaaaaacgacgcgtttctcgaccaggggcaccgctttcagcggtgggtggtggtgggacactggccggttactctgtaccacccggacatcccctcggctaagccccttctcctgccggaccggcacatcgccagcatcgacgggggctgtacgctgaaggccgacggacagctcaacgccctgatcctgcccagagagcccggcggggcattttcctatcgggcctatgacggttttcccgtgatgacggccctggcttcccaggcgccctcccccgatcccctgaacatccgctgggggcacagcgccctggaggtgctctccctgggggaggagttctcccggtgccgccacctggagaccgggcgggagctggatatcctcaccgactacctccgccagggcccccaggggacctactgtctggactccaccgattacctgctgccggtgaccgccggggagcgcctggccgtggtccggcgcaccagccggggcgcattggcgaagaaggacggggtgacagggtggtatttgggccccttgggcgaagggtgagggaaaaggcaaaaaattctgccccttcccttgactttgccgttcctgcctgctataatttcagagccgctttgaatgggtcataagcaggcgtgggcgggacagaccgttttccgccgcgcttcgcccccgacagcgagcccgtgataaaggaaagaggtgcaagagcaatgcatgcaatcattgagaccggcggaaagcagtataaggtcgcggaaggcgacgttctgttcatcgagaagctgccccaggaagccggtgacgccatcaagtttgacaaggtcctggccatcctgggcgacgcgcccaagttcggcgcccccgtggtggaaggcgcttccgtggacgcctccgtggtgaaaaacggcaagggcaagaaggttgtcatctttaagtacaagcccaagaagggctatcgtctgcgtcagggccatcgtcagccctataccaaggttgagatcaagaagatcaacgcctgatgaccagagcttcctttgcaatggacggtagccggattgtctccttcaccgtggaggggcacaccggcctggccgaggcaggagaagacatcctctgtgccgccgtcaccagcgccgttcgcctcaccgagtgcgccgtgaatgacgtgctggggctggaggccccggtgaaggtcaaccagcaggatgcttccgtcactttgaaacttccccgcaatctggccggagaggccgaccaggtgtgccagacgttgctggccgccctgatggtctacctggtccagctgcaggaggaatatcccgaacacattaacgtcatggaggtgtaacctatgcttcatatcggacttcagttcttcgcgcataagaagggcgttggctccacccggaacggccgtgattccatggctcagcgtctgggcgtcaagcggggcgacgggcagttcgttctggccggcaacattctggtccgtcagcgcggcacccacattcatcccggcaccaacgtgggcatcggcaaggacgataccctgtttgccctgaaggacggccgcgtcaagtttgagcggctgggtaaggaccgcaagcaggtctccatcgtggaggctgtcgcggagtaattttcccgtgcatcccaagccccgaacggaccgccgttcggggcttttttccaatcggaccggtaccaaaggaggtgccctatggcaaatacattcattgataccgcccgcatcctggttcgctctggggctggcggcaacggcgcggtggcctttcaccgagaaaaatacgtggcggccggcggtcccgatgggggcgacggcggccgggggggcgatgtgatcctgcaggtggatgaccggatgtccaccctgatggacttccgctacaaacgcaaatacgtggcggagaacggcggcaacggcgccggcaagcagtgcaccggaaagaacggcgctcccctgatcatccgggtcccccggggcacggtggtccgggatgcggagacccgggagatcattcaggatatgtccggggacgaacccttcgtcctctgccgggggggcaacgggggctggggcaacaagcactttgccacccccacccggcagaccccccagtttgccaaggccggtctgcccggcaaggagcggacggtgctgctggaactgaagctcctggccgatgtggggctggtggggttccccaacgtgggcaagtccaccctgctgtccgtggccaccaaggcccggcccaagatcgccaactaccactttaccaccctgtttcccaacctgggggtggtctttgtggaggagggggtctcctttgtcatggcggacatccccggcatcattgagggggccgccgacggagccggcctgggccatgactttctgcggcacatcgaccggtgccgcctgctcatccacatggtggacgtgtccggttccgaaggacgggacccggtggaggattttgagaccatcaacgccgagctgcgggaatacagcccggaactggccggccggaagatgattgtggccgccaataagaccgatatcctggccgaccgcaccctgctggacaagctcaaggcccacgtggaggcccagggcctgcgcttttttgagctgtccgccgccgcccacatgggggtcagggagctgatgaaggccgccgccggggaactggcccacctgccgccggtgattacctatgaaccggagtacgtggagcggcccccccaggtggacaccagtgacccccttaccatccggcacgaggacgatgtgtggatcgtggagggcccttggctgcaaaagatcatggccaacgtcaatttctccaactacgagtcccgaaactggtttgaccggatgctccgcaacgccggtctgtttgaccggctggaggagatgggcatcaaggacggagacctggtgagtctctacaacttggattttgagtaccagagataagcacccgtggcagcgggggatggagggataaccaggtgacaatcgggacagaagaactgattgtacaggctgtggaacggcttttgatgcaaaagaaggtcaaaaagctgacggtgaaagatatcgtggaggaatgcgggatcacacggcagacgttctactatcatttcagagatatcccggacctgttaaaatgggttttggagcgaaatacagatcagctgctgaaggaaacgcttgcccaggggaatgcggaaaagggcctgcgctgcctgtttttgctggcgctgaatacccgaccctatgtagagcatggcctgcggaccaactaccgggacgaaattacgcggatggtcgaggaacagctgtttactttctttctgcaggtggcggaaaggcacggcctgtacgcccaatgcagtcactgggagttaaagctcgttatgcgctatcacagtcaggcggttcttggcatcctcaggagctggtccgaggcagacagcgatgatttggaccatattgttcatgttgttcatcagctgattgtgggggagatttcccccaggcaataatccctctttttgacggaaacgccgtcgtgtaaaatcttttacacgacggcgtttctgtcaatacggacttctttttctgcctattgtccctggcgcccgccctgattaaaatcaaagcatcaaagtggtgaggcacatagccagaagcggcaaggctgccggcagaatttcagaaagcagagggattttttatgtgtactgcaatcaatttcttagatcaagcgaacgaaactgtatttggacggacaatggatttctacgccatcctggacccgcaccttgtctccttccccgcaggagcctcttgggaaaccatgcttgggcagacccttgcggaccagtatggggttgggggaatcgggcgtcacgcccaacatcgctatgtcctgtttgacggcgtcaacgaaatgggacttgcgggcggtgccttgtattttaaggggtatgccgattttccgcagccctccaagcacagtggtcaggtccagctctcggcgttggacttcttgcactacgccttgggcagctgtgcttccctggacgacatccgggaacgcctggccgatctcaccttggtgggaatccaggatggcctgaccggcaccgttgcgccaatgcactggatgtttaccgacttgtctggcaggggtctcgtcgtggagcagaccgcgctgggactgcatatctatgaaaatccagtgggcgttctaaccaacagcccagattttccctggcagatgacaaatttacgcaactaccttggggttgcgccagagcagacagagcaggtggattggaacggtttgcagatggagccatttggacaggctggcggaacaagcgccttgccaggcgggtatacacctcccgcccgatttgtgcggactgtttttcagaagctgcacatggtaccgccaaaggggatagaggaggctgtcgttgctggctttcacattttggagggggttaccctgcccaacggcgtggtaaagacagcgaatgggaccttcgattatacccaatacacagccatgatcgatctggggcagaaggtctattatttcaaaacctatgagaaccctcaggtcatccaagtggatatgaagcccctctggaaatccaaagaaaaagtggtacaggacctgggcagcatccagacgtccattttttatgggcacttgcgttaaaagaaccgttcccgttgttccagcggcaggaagagcgagaaatttttgacggttctccggtgtgcgttgacatttttcgagggagcgcctatactggagattacctacgtgtcgttcaggtctcctcttttccccctccgggtgcggtggggatggcaggcttgcgcataggaggaaaattgagaagtgagaaagaaggtaatcagatgaagaaacgagtcgctggcctgcttctggcgctgatgatggccctgtctctggtcaccccggctgtggcggtggagacggagaatggggtgtctgcggctgcggcctccccggttgtgacctggggagagctgaccaaggatgcgccggacttgaaactccctgtctccgggcaggcggaccagaccgtgaccaaccaagaggccgtggccttcctcctccgctgggcggggatggaagagagccagctgggaacctatcccagggattacaacgccatggcggacagcatgggcatgaccgacgggattgcccagtacagccccaccgatccctgtacccaggcgaacctggcggtgatgaagcagtcggcccaggtcctttaccaggccctgcacggccagacgctggagcctctgttcctcaacggcatggcccagcccattttcccctataccaccggggctgtgaccgagggctatgacaacgccaagagtgacatcatccgttactgcgtctatgtggagaccaactatgacaccgatgccgacggcaagcgggacctggtgaaggccctggtgcagattccccgggccgccatggaaggggattataaggccgccaccatttatgaggcccggccctatatcaccggctgtacctctggagaggcgccctatggcaaggacggctatgacctggaccagatgtacagccagcccgcagcgcggaaggcggcgggaaccgccaccacggcccaggcagcagcccaggcagattcctcggactggtattattacaacccccacgaggagatgtatgactatgaggacctgacgtggtacgactattatttggtccggggctttgccgtggtggagtgcggcggcctgggcaccaagggctcagagggctttgaaacctgcgggagcgacctggagatcgacgcgttcaagtgcgtgattgagtggctcaacggcgagcgggttgcctatacggacaagaccagcaacatcgccattgaggcagactggtccaacggcaaggtggggatgaccgggcggtcctacgccggcaccacccagttcggcctggccaccactggggtggaggggctggagaccatcgtccccgtggcggggattgccagctggtatgagtataccaactcccagggcattgccacccggagcgaccccgcttacagcgactggctggcctggtactgcgccggccggtacctggatgaggcggactggaacaccattgccggcaagtatggaaactacctcaatcaaatccggcaggaccagctggcctccaacggggattacagcgaccactgggccaaccgggactataccctggacgccgataagattcagtgcccggccctcattgtgcacggcctgaacgacgacaacgtgcggaccaaggagtttgacctgatgtaccaggcctatgagaaggccggggtgcccgccaagctcctgctccatcaggatggacacctgacccccacctatccctcggggggcattcagtttatgatcggggcgcagtcctacgatgaaatcctgaaccagtggttcagccactatctgtatggggtggacaacggcattgagaacatgcccgcagtcacggcccagagcaacaacgacaccaaggtgtggaacacctatgacgattggaagaccgaggacgccattaccctgaccggagagagcgccaaggaaaagaccgcgtccatcagcagcgattatgacgccattggcgtgaacaaggacaactgggaagaggtgttcaccggcggctccacagcctccagcgccatgtataccatggatgtgacagcggacaccgtcctcaagggctctgtggcggtgaacttccaggctgccaccaccaacggtgcgatggtggagacccccagaggggagagccggtccgcagtggaccatgacagcgccgtggaccccgctgccctggaccatgacaactacgtgggcgccgccgccaccggcgagaccgtggacaccccggaggccgccctcatcaaccgggacggcctgatggtcagcgccatgctggtggacatcgccccggagggggagaccttccccgccttcaacaccgcgcccacctatgttgaaaagacaatcctggccaaggacggtgcctggatgggcggtggcctggagaacctggacctggtggagctgaagcccacggacgtatcctataaaattgtggcccggggctggatggacctgtgcaaccccggcgcgggctatgattcggcttcggcgcagaacaaggtaaaactggtggagggaaagtattatgactataccctctacctccagcccaacctctatgaggtggaggcagggcaccgactggccctggtgatttacgcctatgagcccggcaaggcgacctacgcccagaactataccatcacggtggacaatgcctcggtgtccgcggagatcccggtggagaaagcccccagcaaccccaccggcctgccctacacggatgtggccgccgacagctggtactatgaagcggtgaagtacgtgaccgaccagggcattatgaacgggacaacgcccaccaccttctctcccatgaccaccaccagccgggctatgattgtcaccatgctctggcggatggaggggagccctgtggtgaactaccgcatggactttaccgatgtgaaggaggacgcctactatgccgaggcggtccgctgggcggcatccgaggggattgtggacggctatgaggacggaaccttcggcccggacaagacggtgacccgggagcagatggccaccatcctctaccgctatgcccaggagaagcagtacgatgtcagcggacgcaacgacctgtccgcctttgcagacgccgcccgagtcagcgcctatgccaaagaggccatgcagtgggcggtggatgccggcctgatcagcgggatcggggacaacctggtgccccagaacggcgccaaccgcgcccaggtggcaaccatgctcatgcgctttgcggaaaatgtgaatcagtaaccccgtttcggacggaacaaaaacctccctggaaggatgcttccagggaggtttttttggtggggtgcgttatggggtcttggcgcttttgccctcccgccgccagagcaaaatccctgtggcatcggccagaaaccaaccgatgggaatggcaatccagatgccgttgacccccagcgccggcagtgccgacagggtgtatgccagcaggacccgggtgcccagggagcagatggtgaggaccaccgacacggcggggcggttcactgcccggaaatagccgtagaggaggaaaagaatgccgatgcccaggtagaacgcggcctcaatgcggagatagcctgtgccgatggcgatcacctccgcggcatccccgcccacaaaggcggccatgagccggggcgccaacaggcagaccagaccgccgatgaccaggcagaagaggaccacccagaacaccgcccaatgggtgccggtgcggatgcggtcccgtttttccgccccgtagttctgggccacgaaggtggagaaggcgttgccgaagtcctgaaccggcatgtaggcgatggtgtcgatcttcaccgccacggcgaaggcggccatgaccgcggtaccgaagctgttcaccaggccctggaccatgagaatgccaaagttcatcaccgactgctgcagacaggtaaaaagggagagattcagcaggtttttcaaggcggcccggtcccaataccggtggcgtttttggacccgcagagcggggaaggcaaaccaggtgtagagaaacaggcccaggccggcgacgaactgggcgatcaccgtggccatggcggccccccgaacccccatgcccaagggcaccacaaagaggatgtccaggccgatgttcagaaccacggaaatccccaaaaagaccagcggggtggcggagtcccccacggagcggagaagattggcaaaaaaattgtacagaaaggtggcgaccatgccggcgaagatccactgcaggtattcctttgtcagacccaaaatatccggtgggatctgcaggaggaccagaatcccgtccagggccagatagacggtgaggttgagcaggagcgtcagcccgccgatgagcagaaaggactgaaaaatcccatttcgcagccggtcggggtcctggcggccgtattgaatggaaaaatagacgctgctgcccatgcacagccccaggagaatggaggtcaaaaaggtcatcaaagtgtaagaggaccccaccgcggccagcgcgccttccccgatgaagcggcccaccacccaggtatcggccaggttgtacagttgctgcaggaggttgcccaggatcaggggaagggcaaagcccagcaggccccgggggatgcttccctgggtgaggtcacgtttggcaaacatagcgacgggagttcctttccaatcagagtgtttttccagtgtatcatgcacggagaaaatttgcaaatggaaggagaggagcgggggaggaaaggtttaaccaaccccaaacaaaaatttagcccttttcggatcgaagggggagaggggccgcgctacaatggagcaaaacggcccgtaccgatcccaccataggcggatctccaaagaaagcgggccggggaaactttttgagaggaaaactacaagaatgcggcatctttttgtaggttttccggccgaaggaggaaacggggaatggagcgaggtatctcatgggaggaccggatcaaaggggcgtatgcctccctgcggccgtcggaacagaaagtggcgtcctttttcctggcccacgccggggagctggagtccctgaccattggggagctggccagcgcggccggcgtgagtgagcccacagtgatccgatgtgtccgtgggctgggctaccggggataccgggccttcaagggggccctgcggggatgggaggccggagaggagagtgcctttgaccatttggggggcttttccctccggccctgggaccggatggagaaccttccgttgaaggccgtgggcacccagcgggaggccttggaggacgtgctgaagtctgtgtcccctgacagcctggcccaagcggcccaaactctggcctcagcccggctgattgatctgtacagtgtggagaattcctgtgccccggccagcgatctgctgaccaaactgacctatttggggctccggtgccgcttctgcaccgacgcgtatcttcagcagatcagcgcggcccatctgaggaagggggatgtggcggtggccttttcccgctcgggccggtctgtggacaccgtgaaggcgctgcggctggctaaaaaagctggggctgctaccattgcggtgacgggcgagcgaaccgccctgctgagccggtacgccgatctcaccctctctgtgggcggggggggccaaaccgtctatggcaacgccattttttcccgggtggcggacctggcggtggtggatatgctgtatatgggcatcattctcagcgactatgagcggttttcccgcaacttggaccgcagcgggcaggtgattgcggaccgggggtatgcacaaacctaagagagacagggcgtcctggtagaaaactacaaggacgcccttctatatttgatgggatttaacccgggcttcacggaggttttacccggggttggtggtaaggggcggcgtggatttgctacactgtccctggaaaatgaaagagaacagaacaggccggacatcccggtgggaaaggagccataccatgttagaactgacccatattcaaaaatcctttgacggggtcacggtgttgaaggatatctcgatgcaggtggaggaaggagagattgtctccattctagggccttccggctgcggcaagaccaccttgctgaatctcattttaggcattgtagaggcagacgcgggaaccatttgctacaacggggaggatttgacccgggctgctatggagaagcggggctttaacattgtcttccaggattatgccctgttccccaatctcaatgtctaccaaaatattacctatggcctgaaaaacaggcctggaatttccacccaaaaggaggtggaagaactgatccatctgttgggcctggaggagcatctgtccaaacgggtggaccagctctccggcgggcagaagcagcgggtagctctggcccgcaccatggtgatgaagccccggattctcctgttggatgagcccctgtctgccctggacggtgttatcaaagagtctatcaaggaccgaatcaagaccattgcccgggagtttcatctaaccaccatcattgtcacccatgacccggaggaggccctcaccctttccgaccgggtgctgatcattgaccagggcaccatcgcccagtatggctgcccggcggacatcatccagaagccggaaaacgactttgtccggacctttatcctcaaccagctggagatcaaacgcaacaacatttatgccctcttcggcgccgatgctgcggggagagccggataatcggtggccctatgaaacgaaagcattgggagcttacgctcattttcatcctgttggtcattctctttgcaacctttctggccattccggccatccggctgctggtcaagtccttttggggcgagactggattgaccacagaattctatacctcggtgctgactgccccacagttcggcacagcactcaggaacagcttcgccgtctctgcggcctctgcgctgctggcggtggggattgcctttgtgatggcctacctcatccattacacccgattgccccgaggctttcggcgggcgatgcaggcggtggcgacactgcccatgttccttcccaccattacctacggcttcgccatcatctactcctttggcaagcagggcctgatcactcgcctgttgggccaccagatctttaacatctatgggtttggcggcctgttgctgggctatgtaatctatacggtgcctgtggctttcctgctgatccacaacaccatggggtatgttgacaagaagacgttggttgtctccaaggccatgggggatggccacctgtccaccttctggatcgccatcctccggccgctgctggggacgttggcaggggcgtttatccagtcctttttcctctgcttcactgactttggcattcctgcctctgtgggcggaaagtatgatgtggtggccacggtgctctacaacgagatgttgggcggcgtgcccgatttcaaccggggcgccgtggtggccatggtgatgctgctgccgtccattgtcagtattctgctgctgcggtttttggagcggtataacatccgttatgaccgcatcagcgacgccgatcttcgccccaaccggggcagggacacggcgtgggggctgtcggggaccgtgttgtcggtgggaatgctctccatcttcgcggtgatctttgtggtacctctggtgcagaactggccctaccagacccagttcaccctggcccacgtccaggcggtttttgcagacagcgagctgcagacggtgtacctccactccctgggcatggcgctgtgtacggcgttctttgggacgctgctggcctacggcgcggcgctgatcactgcccggagcaccctgcccaagtggcgcaagcagagcgtggattccatcgcgctggtgaccaataccatccccggcatggtgctgggcctggcctttctgttcaccttcacgggaacccccctgcagaataccttcccgctgatgatcctgtgtaatattgtccactatttctccactccctatcttatgatgaaaaactccctgtccaagatgaacgcggggtgggagaccacggccatgctcatgggagacagctggcccaagaccatcctgcgggtggtgacccccaatgcggcctccagtctcattgaggtgttcagctactatttcatcaacgccatggttaccatcagcgccctgattttcctggccggtgcccggaccatggttctgaccaccaagatcaagcagctgcagtatgtcaatgaatacaatgaggtctttgtcctctccctgctgatcctctttaccaacctgcttgcaaaggccattttcacctggcttgcaaatagaagtgcccaaacgggaaaacgaaacaataagaagagaaaggaaacgaaaccatcatgcatctgaaaaaattactggcgctgggtctgtccctgaccatggctgtggccctgctgagcggctgcggccagcaagagaccgcggaaggcggtaccccgtcggagcaggttatcatttactccaacgccgacgaagaggcgattaccgccatgaccaacgccctgaacgccggcggctatgcgggccagtatgtcttccagacctttggcacctcggaactgggggggaagctcctggccgaagggaccaacctggaggcggatctggtcaccatgagcaccttctatctccagagtgcccaggagcagaacacaatgtttgtccccctgaccttcccggtgaataccctggaggaggtcccggactataccgcgcccattacctcccaggagggcgccattattgtcaatacagaggttctgaaggaaaataatctgcccatgcccacctgcctgaaggatctggccgatcctgtctatgccggtttcctggcggtgaccgatgtgcagtcctcctctaccgcgtggctgctgatgcaggcgctggtttcggaatatggggaggacggggcacagacggttctccacgacatctatgccaacgcaggggaccacattgagacctccggctctgccccgctgaagctctgtgaggccggggaaatcgccgtgggctttggcctgcgccaccaggcggtggcggccaaggcagagggcctgcccatcgactatgtggaccccaccgagggcaacttctccctgacggagtctgtggccattgtggacaaaggggagagcaccaatcctttggccatgaagatggcccagtgcatcatcgaaaatggccgtgccgagctccaggaaaactaccccaaccccctgtatgagggagagagcgcggacagcgccaacaaatccgcctaccccaagaccttccaggagccgctgacctttgaactgtacgaaaagcaccagcagatctctgaggctgccaagccctgagggatacgatgcagaagagggcgcgaaaggcgccctcttctaatgaaaaacggaaaccatcacagaatataaggagagaaacataccatgaattcctataaactgctcacccccggcccgctgaccaccaccgacaccgtgaagcaggtgatgctctttgaccactgcacctgggatgacgattacaagcagatcacccagaccatccgtcgcacgctgctggcgttgggacacgtgtccgagccggagtacaccgctgtgctcatgcagggcagcggaacctttggcgtggagtctgtgctcaccagcgtcatcggacgggaggacaagctcctcattgcggccaacggggcctacggcctgcggatggcggagatctgccgccacgcggggattgcgtataccctctatgagcaggacaaccacaagcgtccccaggcggacgtggtggcaaagtacctggcagaggacctggccatcacccacgtgtccatggtccatggggagaccaccagcggcatcctcaacgatgtggaggctgtgggccgggtggtaaaggccgccggcaagaccttccttgtggacgccatgtccaccttcggcggcgtggacatcccggtggctggctggggcattgatttcctggtgtccagcgccaacaagtgcattcagggggtgcccggcttttccttcatcctggccaaccgggagaagctggaggccagtgccggccaggcccggtccctggcgttggacctctatgaccagtggaagaccatgaacgaggatggaaagtggcgctttacctcccccacccatgtggtgctggcctttgcccaggcgctggaggaactgaaggaggagggtggggtgcccgcccgccatgcccggtatgaccagaaccagcggctgctggcggagaacttccgcgccctgggctttgtgccctacctggaccccgccgtgcagggtcccatcatcaccaccttccggtatccggcgggcgcccgtttcaccttccagcagatgtatgaatacatcaaggcccggggctatgttctctatcccggcaaggtgatggaggcggaaaccttccgggtgggcaacatcggggagatttatccagaggatattgccaaactcagcgccattctggctgactttctcaaggaggtggcggcatgaagcctcagctggtgatttttgactgggcggggacgaccgtggattatggctgctttgcgcctgtgaatgcctttgccctggctttccagaagtttggggtcaccccgacggtggaggaaatccgggcccccatggggatgctcaagcgggatcacatccgcaccatgctggccatgcccgccatccggcagcagtgggaggagaagcagggcgcgtttgatgaagcggcggtggaaaaaatttacggcgtctttgaagacgcgctcatggagagcctctcccagtatgccgcgcccaaacccggtgtgctggaaaccgtggcagaactcagggcgcgggggatgaaggttggctccaccactggctataccgataaaatgatggcggtggtcacggcggaagccgcccggcagggctatgcccccgacgcctggttcagcccggacagcgtccaggggttgggccggccctatccctatatgatctatgccaatatggcaaagttccagatcgcttcagtggaacaggtcgtcaaggtgggcgacacagtggccgacattcaggagggcaagcacgcgggggtcctctccctgggggtgctggagggcagcagcgttatgggatacacccaggcggagtatgaggccctgccccaggcagagcgccaagcagagaaggaccgggcccgggagatcttcctggccgccggagcggatggggtgctggataccctggatcagctgccccagtggctggagaacgggcaggtgtgaaagcagggattcgggcccgctctcttctgaaacggggaacccggagaccgggagggatagagggaaaaggggcgcggccctattgcatttcccggcttgttcgcctaaaataggggtgccttgcaaagccggggggcttggctgtccttccggagaggcaagagggaacacagaaaggcggcaagcgatgaaatggatgattgcctcagaccttcacggctctgcgtattactgccgggcgttactccaggcgtgggaccgggaacaggccgaccggctgatcctgctgggagatcttctgtaccatgggcccagaaatgatctgcccagggaatacgcgcccaaagaagttttggctatgctgaaccagagaaaggaaggcctcctctgcgtgcggggaaactgtgacagtgaagtggaccagatggtgctggagtttcccatcctggccgactatggggtgctggccctgggcggccggctgctctatctcacccacgggcatgtgtttcataaggaccatctgccgcctctccaggcgggagacatcctgctgcatgggcacacccatattcccggatgggagacattggaggagggacggcagtgctggaatcctggctccgtcgccctgcccaaggcgggcagcccccacagctatatgattcttgagggggcgtgggtccagtggaaggacctgtccggcgggacctaccatacattgacagtcggctgagaggaaaacatcaggggccggagacagctttgctgtctccggcccctgatgttttaggaaagaattcgttccaagcgggtccccagctggctgaggatctcgttggtaatggtgtctgtctggcgggccaggtcataggccgtgatggtctcctggccggcagagccgatcagaatggcctcgtccccgggctggacggcggggaggtctgtgacgtccaccagggtttggtccatgcagatgcgcccgatgatgggggcccggcggccgcccagcaaaacctctccgccggtcagggagcggggcagaccgtccccatagccgatggtgagcacggccacttgggtggggcgctgggccacaaacgccagcccgtatccggcgccggcgccggcgggcagggatttgaccgcggccacccgggcatggagggagagaaccggacgcagcggcggcgcagccgcgttccaatcctgctgggtgctgagcaggccgtagagagcgatcccgacccgggcgtagtcccctgagatatcggggtagttcagcagtccatggctggcctgaagatggaccttggggaggggaatcccccggtttttcagctcctccagcagctgctggaaggcctgaacctgccgctggacataggcgcggtcggcgggggaggggctgtccgctgtgcagaggtgggtgaaaatcccctcgacccgaaggtgcttcatggtgaagatttgaacgatctcctccaggtgatggcagggctcacccaggcggtgcatcccggtgtcaacggccaggtggaccggcagggatttgccggcttggctgagctgcacggcgtgggagaaatccactgcggtttgggtgagtttgtaccggcgcagcagggggacctggctagggggtgtataccccaggattaaaatttccccgcggatgccccctttccgcagctgaatgccctcctccagacaggccacgcaaaaggcggaaatgccctgggcggccagggcccgggctatgggcagggcgccgtgtccgtaggcgttggctttgaccgccggcatcagctggcagccagggggaagcagggagcgcagtgccgacacattgtgggccagcgcatcctggtccagttgaatccaggccctgccgcgggtgggccggggaggacggagacgggccagcgcccaggcgatgaccgcggcggccaggaaggagagcagacaaacggccaggtagtggaccaggctgttgtccaccaagacggcggtgagccccaccgcctcagcggccccccggatgaccacaatcatggccgggtgcaggatatacacccaggtggacacgggccggcagaacgccggggcctggggggaccaggccagcagaaggcggtagaggaagaccatcaccaccggcagcaggagatacatgctgtcatggcgctgcagggcaaagtggcgcagggtgaaagcctccccagtcatcagaaccagggagagcaaaagccccagcccgttgacagcgggccttccggcgggtggccggcttcccagccgggcgcccaggaggagaaacaggggggccataaacaggccgttgcgggtgtaggagaacacctggaagccggcctcgtaggccgctgccagaggcggcagcgcggcggtcaggccataatagctgtccccaaacagaccgatgagatagagcagtcccgtgaccgccagcagccctctgccccgcagcacccgccccagcagatacaccagaagcagccctgtggcgcaggcaggaaaataccagagatggtaaaaggtgccgtcgaagagtaacagacggagggcggacaggggggagagcccctggtagtggccggcgtagagccccacagggaggtagagcaccaccgccaccaggtagagcaggagaattttcttcacctgccgccacagggcggaaaagggccgccggccctggagaaccttgcccaggacaaactggccggttaccatgaagaagaaggggaccgccacccgggccagacttcgggtgagcaggaagtccccgtccggggagtaggtggtcagaggggaggtgtggatggccaccaccaacagagcggcgatgaccttgaaggcgtccaggccgccgtaacgggggggattacccatgggcccgcctccattctgtgatgataaacccgtccacattgtttcctgagatggtacagggcaggtcggaatcccgcttgagaatcgtgggaccgtccgaggcgcccggcaaaaaggagacaatggcatttttttcctggtatcgacaggattcgtagggaaattcccgcagccaggcgatatactcttccagggtcagtccccgggcctccatgatggcggcgtggggctggcccacatagcggaagtgccaaggctcatggccgatgccggtgatctcctctttcccggcggggtaccgctggatcaggccgtaccgggccatctcccggcggaaggtctggcagagcccggtatagggaaagtcggggcggataaagtcgatggacgcgctccggcggcccagatcaatggccaggccggtctgatgctcgctgtggccgggatatgctacgtaagtctgggtaaaggggaggccgttttccgccagggagtcctcccaaatggcctgctgctcttccagcgcccgccagccgctgacgggcacaatctccttccagcctccgatggcggccatcaggctgtctaaggcctgggcggcccggcgctccaagagaatgtccgtgtccgccactgtgaccaggtccggatgggggaggggatggtggggaaaggaagggttgaccagcagcaggtccccctggaacatggcctccggcgtgaggatcagcgtgttcatggggccatcacctgcccgagaatggtgtctaaaatctctgggaaggtcatccccgccgcctgcatcatcccgggaaaacggctgtgctcggtgaacccgggaatggtgttaatctcgttgaaaacaatcttgccctggggggtcaggaacagatccacccgggcaaagccggcgcagcccagggcccggtataggaccttggcggtctgcttgactgcctgggccgtctgggggtccacccgggcgggaacatggatggcggaggtcttcagggtgtatttctccgtaaagtcgaaaaacccgccggagagctcgatctcatcaatttctcccaccagcagttcccgggtgccgatgacggcacagcccacctcaaagccggggatggtctcctctaaaatcacctgattgtcgtactgaaacgccaggtccagggcgggaagaagctcttcctcttggtgaatctgggagatgccgtaggaagagcccgctttcacgggcttcacaaagaggggatagcctgtctgccgggcaaagtctacggcggcctgggggtcctcccccagattgagaaccagggaggcgggcactgccaccccggccagggaggccagcttgtgggcccggtccttgtccatacacagggcggaggccaaggtgccgcagcccaccaccggaataccggccagctccagcagcccctgcacagtgccgtcctctccgttctttccgtggagaatgggcagggcgtaatccacctggatcacctggtgccggggggcggagaaggccaggagcccgtggaccgagcggtcctgggagaccaccacaggggtgaggcatcccgggtcctccgcccaggagtccgtggcgatccgatcataggcgccggtgtagtggaaccactggccgctctgggtaatccccacgggaaggaccgtgtatcggtctgggttcaggttggataaaacagcgtaggacgactgcaaagagacggaatactctggggaacagccgccgaagagcacggcaagggtgggctttttcatgggaatcctcctgtcaatgtagaagaacgaattggggcaaaaaaagaaattcgtcgggaatctgcctgttattgtagcagagaaaagtgattcatgttttaagagaaccttgcggttttcttaaaaagaattgcgtctttcttaaaaaccattaagaagatttgaagcgccggggcccataggggaaaacccggggaattccccctgaaatgtgaacaaaatgtgaataattttagaaattgtattgacaaagggcatggggcgcggtatatatagcggaagtaatcagtgattactaacataaaaacttgtaaaaaacgacacatggaggtcatttatcatggtatttgaagcaattgcagagctggtagcagagcgcgtggaaaaggatgtctccgagatcaccatggagagcaatttccgggacctgggcattgactccctggacaccgtggagctgctgatgaacctggaggacaagctgggcattgagatcgagctggaccagaaggtggagaccgtgggcgacctggtggccttcattgagagcaagcaggcatgattcgcacgccgttatgtgatctgctgggcatcgagtatccggtgttccaggggggcatggcctggatcgccgacggcaagctggccgcggcggtgtcggaggggggcggcctgggcatcattgccgcaggcaacgccccgggagacgcggtccgggagcagatccaggtggccaagtccctgaccagccgtccctttggggtgaacatcatgctgatgagcccctttgtggaagaggtggcccaggtggtggctgaggagaaggtggccgtggtgaccaccggcgccggcaaccccaccaagtacatggccctgtggaaagaggccggcatccgggtgatccccgtggtggcctcggtggccatggccaagctgatgacccgcctgggggcctccgccctcattgcggagggcggcgagagcggcggccacgtgggggagctgaccaccatggttttggttccccagatttgtgacgccaccacccttcccgtcatcgccgccggcggcatcgcggacggccgcggcgtggcggcggccttcatgctgggggcctgcggggtccagatgggcacccggttcctcagcgccgaggagtgctccatccatccggtctataaggagcggattttgaaggccaacgacctgtgcaccatggtcaccggcaagcgcctggggcatcccgtgcgcagcctgcggaccaactttgcccgcaactatgccaaagccgagtacggcggcatggacgacgaggccctggaggccctgggcagcggcgccctgcgcaaggcggtggtggaaggcgatctggaggaggggtgcttcctctccggccaggtggccgccatggtgaacaaaatccagccggcggctgagattgtccgagaggtgatcgaaggggccgagcccgtgctgaaaggagccacacaatgggtaaaatagcctttgtcttcgccggccagggggcccagtatcccggcatgggccaggagctggcccagtgctccccggcggccgcagagatttttgcaaagctggacgccctgcggccgggcacctctgcccagtgcttcgggggcaccgatgaggaactgaaagagaccaagaacacccagccctgcatgtttgccgtggagctggccgccgccgccgccctggaagagggggggctgcgggcggacatggccgctggattctccttgggggagattggagccctgacctacacccgggcagtggacctggagaccggtttccacctggtctgccgccggggggaactgatgcaggcggccgcggaggagcagcccaccgccatggctgcggtgctgaagctgtccaacgaggaggtggagcagatctgcgcccaatttgcgcaggtctatccggtcaactacaactgtcccggacaggtctccgtggcctgcgccaaggagcagctggcccccttctccgccgcggtgaaggcggccgggggacgggctctgccgctgaaggtgcgggggggctttcactcgcccttcatggccacggcagcccagggctttgcccaggtgctggaggaatgccgggtgggacagccggagatgcccctgtattccaaccggacgggggcggtctacgaaggggaccccaaacctttgctgtcccagcagattgcctccccggttcggtgggagaccatcgtgcggaatatgattgccgccggggcggacacctttgtggagctggggccgggcaagaccctgtgcggcctcattgaaaagatcgacaaaaccgtgaaaacctacgcgctgtccacccaggcggacttggagaccatcttgaaggaggtcaaaggatgctgacaggaaagacggcggtggtcaccggtggttcccggggcatcggcgcggccattgtgagaaagctggcctctcaaggggccaacgtggcggtggtctatgccggcagccaggccctggcggaggaactgtgcgcccagtgcgcggcggagttttcgggaaaagccgtggcctaccgctgcgacgtggcggattttaccgcggtgaaggacctgatggcccagattaaaaaggagtttggcaccgtggacatcctggtgaacaacgccggggtgacccaggacggcctgctggccatgatgaaggaggagagctttgaccgggtcctggacgtggacctgaaaggggctttcaactgcatccggcactgtgccgggatgttcctgcggcagaagcacggcgccattgtcaatgtcagctccgtgtccgggatgatcggcaaccccggccaggccaactactccgccgccaaggcggggctcatcggcctgaccaaggccgtggccaaggagctggcccccaaggggatcacctgcaacgcggtggccccgggctttatcgagacggatatgacccgagacctgtccggccaggacaacgggctcctggccgccatcccgctgggacggatgggccagccccaggaagtggctgaggcagtggcgtttttggccaccgcgccctatatcaccggtgaggtgctgcgggtggatggtggcattgcgatgtaacatttttggggggaagggtctggggcccttccccgttaaacggaggaccaataccaatggagaataccatgcgcagagtggtggtaaccggcctgggggtcatcagccccgtgggcaacacggtggaggcgtgctggaacagcttgaagtccggcgtccacggcatcggccccatcactctttttgataccacagactacaagaccaagatcgcggccgaggtgaaggactttgacccccgggcctatatggacaaaaccgaggtactgcgcagcgacgccttttcccagtacggggtggcggcggcctgccaggcggtggaggagagcggcgtcatcggcaccctgccccccgagcgggtggcggtgtacttcggctccggcatcggcggcattcgcacctttaccgaggagcacaataagctcctggcccggggccccaagcgggtctccccctactttatccccatgctcattgccaacatggccgcgggaatgatcgccattcgctttaactgccggggggcggcgatgccctcggtgaccgcctgcgcctccggcaccaatgccatcggtgaggccatgcgggccatccgccacggctatgccgacgcggtgatcaccggcggttctgaggcggccattacggagtgcggcgtggccggctttatcaatatgcaggccctgtccacctcggaggaccccaacgcggcctgccttcccttcgataagagaagagggggcttcgtcatcggggaagggggcgctgccctggtgctggaggagtatgagcacgcagtgaagcggggcgctaagatctacggcgaggtgtgcggctacggcgccacctgtgacgccttccacatcaccgcgccccggcccgacggcagcgccggcgcccgggccattcagctggccctgcaggaggctggccaccaggccggagagcgggtgtacatcaacgcccacggcaccgggacccccatgaacgattccctggagacccaggtggtgaagctggccctgggagaggaggaggccaagaaggcctacatgagctccaccaagtccatgaccggccacatgctgggcgccgccggcgccattgaggccctggcctgtctgaaggccctgaatgagggcgttctgccgcccaccatcaacctcctggaccccgacccggcctgtgacctgaactatgtgcccaaccaggcgatccacacggaggtggacctggttctctccaactccctgggctttggcggccacaacgcctgcattgcattccggaaggtgacacgatgaacgaagcagaaattagaaagtatgccgagctgatgcgggagctggacctgaccggcctggaagtgacggagaacggctgtgtggtccggctggagcgcaccccggccgccccggtgcttcctcgggagacggtggcggttcccccggccccgccagttcccgcggctgcgccccaggaagggaccacggaggtcacctctcccatggtgggggtcttttacgcggccccggcagagaacgcggaaccctttgtcaaggtgggagaccgggtgaaacggggacagaccctgtgcattgtggaagcgatgaagctgatgaatgagatcatggccgagctggacggagagatcgtggaggtctgcgtccagaacgggcaggtggtggacttcggctgtcccctcttccgcatcaaagggcagtaaggaggaccgcgatgaatcgagatgagatcaaaaccatcctgccccaccgggacagcatgctcctgctggatcagctggaccgggagggagagatcgcccatggacagtaccgggtgaagggggacgagtggttcctccagggacatttccccgacgccccggtggtgcctggggtgattctctgtgagattctggcccagtcggcggggattttgatgcaggattccctcaccgaggacaccatccccatgtataccagcatgaagaacgtgcggttccgggccccggtgctgccgggggacctctttgagaccaagtgccgcatcacccgggccaagcatcccttctattttgccgagggagaggggtatgtgggggataccctctgcgtgaaggcggaattctcctttgggattacggagcgcgaagtatgttttcaaagatcctgattgccaaccggggggagatcgccgtccggatcatccgggcctgcaaggagatgggcattgccaccgtggccatctactcccaggcggaccgggacgccctccacgtggccctggcagatgagagctactgcgtgggcggcgcttcccccggggagagctacctcaacgaggagcgggtggtctccgccgccctggtctccggggcccaggccatccacccggggtatggcttcctgtcggaaaacgcccactttgccgccctctgccggaaaaatgggctggtgttcatcggaccctctccggagagcatggaggagctcagcgacaaagcccggctgaaggagatcatggggagaaacggcctggaggtcattccgggcacccaggtgctcgccagcgcccaggcggcgctggcggcagcggcggagatcggctatcctgtgatgctcaaggccagtgccggcggcggcggccggggcatccggctggtgagcgcccccaatgagatgacccaggcctatgccctggcggtggccgagggggaggcctcctttggggacgggtcggtttacatggagaagtatgtccaccccgcccggcacattgaggtacaggttctggccgacgaggcgggcaacgtggtctgcctgggggagcgggactgctcggtccagcgccaccaccagaagctcattgaggagtccccctctccggcggtgagccgttcccagcggaaaaagctcatggagctcaccgcccgggcggtgaaggccatcggctatgtgggggtggggaccctggaattcctcctggaccgggacggacggttctggttcatggagatgaatctccgcctccaggtggagcacggggtgacggagatgctgacccaggtggacctggtaaagtggcagatccgcaccgccgcaggggttccgctgaatttccagcagcagaacgtcgccctcaacggggcctgtgtggagtgccggatcaacgccctgacgccggggaccctctccatgctccacgtgcccggcggcccctttgtccgctttgacacctatctggtcagcggcatctctgtctccccctactatgacgcgctgctgggcaagctcatcgtctacgccggcacccgggaggaggccatgcgaaagatgaaagcggctctgtgtgagctggtggtggagggcattgaaaccaacattgccgagcagctggagctggtcagcgacccccggtttatgaccgggcaatatgatttgacctttatggaaggcaggtgacaccgttgccctttctgaattttattcacaaaccaaaaaatgagctggaaaagggaggccgcacggcggcgctggtccaagaggacgccagcgagccggagaagacctgtcccaactgtcacaagtccatccccctgagccggctgtggtccaactggaacacctgtgcctgcggctatcacttccgcatgggagggcggcagcgccttcggttcctggcggacaagggctcctttcaggagctgttttcccaggtggaggggagggaccctttgtcgtttcccggctaccgggaaaagctggagatggtccgggacgccagcagtgagaaggaagcggtcctctgcggcaccgcccggatcgggggtgcgccctgctgtctgtttatcatggagccctactttatgatggggagcatgggcacggcggtgggagaaaagatcaccagcctctttgaatacgccaccgagcacagcctgccggtggtgggctataccgtctccggcggggcccggatgcaggaggggctgctgtcccttatgcagatggccaaaaccagcggcgcggtgaagcgccacagcgacgccggtctgttttactgcacggtgctcaccgaccccaccaccggcggggtaacggccagctttgccatggagggagacatcatcctggccgagcccggcgccacggtgggctttgccggggcccgggtggtggagcagaccacccggaaagcgttgcctaagggattccaaactgcggaattcctgcttaagcacggctttgtggacgccattgtcccccggcgggaccagcagcaggtggtgtcctctctgctgaagctccaccagagaggggaggcattatgagtacccaagcctatgatattgttaagctggcccggagcaacaaacggcccacggggctggactatatccagaacctgtgcggggattttttagagctccacggggaccggtgctatgccgacgatgccgccattgtggggggcgtgggccacttccgggggattccggtgaccttcgtggccattgaaaaggggcacagcgccaaggagcggatgagccgtttcttcggggcgccccaccctgaggggtatcgaaaggcccttcgtctcatgcgccaggcggagaagtttcaccgcccggtgctctgctttgtggatacctccggggcctactgcggcattggcgccgaggagcggggccaggggcaggccattgcggagaacctcatgggcatgatgagcctgaacaccccggtgatcacccttctcattggggagggcggcagcggcggcgccctggcgctgtcggtggccgaccgggtgtggatgctggagaacgcggtttattccgtgatctcccccgagggttgtgccagcatcctttggaaggacgcgggcaaggccgatgaggcggcccagcggctgcggctcaccgcccgggacgcgctggagctggggatcattgagaagatcatccccgagcgggatctgggccagcccgcgttttatggcctgttggcggaccgtttggaaaaggagcttcacgtgctcatgggacaggaggacctgctccagcgccgctacgcgcgctttcgcgcctttggaagcccaaaacccctggagacccagcccctggtaggggtgaaataagggagtaacctgatgcatgtttatgagacctactgccgggagacctttgatgaaaagggccggctgacccaaatccagctggactacccggcggatttcaactttgcctacgacgtggtagacgccatggcccgcctggccccccagcagaaagcgctggtctggtgcaacagcgagggccaagaggcgcagttcacctttgcggacatcagccgccggagcagccaggccgcccaggtttttctccaggcgggcatccgccggggagaccgggtgatggtggcgctgaagcgccactatgaatactggtttgtgaccgtggcgctgcacaagatcggcgcggtcctgattcccatgacccacatgctcacccaggaggatatcctctaccggctgcgctgcgcgccggtccaggccatcgtctgcaccccccaggaccaagtgccggcgcgggtagccggcgccgtggcccaggcgggcggcgcgtgtaagctgtggacggttcagcaggatatccccggcttctctaacctcacccgggccatggaggaggccgaggacaccttggaccggctccccaccctggccaccgacccgatgattatgtactttacctccgggacaacgggacagcccaaaggggtggtccatgactttacctatcctctggcccatattgtcacggccaagcactggcagcaggcccaggacggcgggctccactttaccgtggcggagaccggctggggaaaggcgtcctggggaaagatctatggccagtggctcatcgggagcgcggtgatggtctttgactttgacaactttgatcccaaacggcttgtggggatcattaaccaatacggggtgacctccttctgcgccccgcccacggtataccggtacctggtgaaaaagggcatcccgcccatgcccaccctccggcacgcggccaccgcgggagagcagctgcacccggagattttccgccggttcacccagagcaccggtctgccgctgatggagggatacgggcagacggagaccaccttgctgttggccaatttgcagggctgggagccccttgagggctccatgggggtgccctcccccctctaccacatccagctgcaaaaccccgacggcacccccacaccggtgggagagatcggggaggtggtcatcctgccccccgagacgggcaagccggtgggcctgttcaccgagtacctgggggacccggcgctctacgcccaggcctggagaggcggcgtctaccacacaggggacgcggcctggcaggatgagaaggggtactactggttccacggccggtttgatgacatcatcaagacgggcgggttccgggtgggcccctttgaggtggaaaacattctcatggaacacccggcggtgctggagtgcagtgtggtggggattcccgatcccctccggggccaggccatcaaggcggtggtggtccctgtgccggaacgggagcccagcaagaccctggagcgggagattcggacgttctgcaacagcaggctggcggagtacaagtgggtccgcaccgttgagttcgtggcggcgatgcccaagaccatcagcgggaagattcgaaaaaccgaactcagaacctgagggagcttctggccgcccaattcaccaggcaggaggaacagaagatggcagagcagccaaaagccaggcgccgcaacaccagggaagagctcatcaaggccggggtggaggagatcaaccgctacggggtggccgggttttccatgcggcggatcgcccagctgtgcggggtgtcctgcggcgcgccctataagcactttggggaccggaaggagttcattgccgccatcatcgacgatgtcaacgcccagtggcatgcccggcaggccgagctcctggcggcctatgaaggggacacccggaagcagatcgtggagatgagtacgggctatgttcagtttttggcggagaatccccacctgcgggccatcctcaccctgaaggaccgggactttgacaacgtctaccatcgggtgcggggggaactcagcagccccacccagcggctgatccagcggtactgccaggaggaacagctggatgaggaaacccgccagcggaaggtctatgtggtccgctccctgatctttggggcggccattcagtttgacaacggggagctcccatacagtgagcacaccttgaaaatggtccacgacagcattgagcgagagctcctgctgccgtgacgggacaggaaccagcgcccccttcggaatatacacgccgaagggggcgctgtgcggtcagggggcggggaggagaggggaaggatttgccgttctctggaaaaaatgcgttgacagggggaggggcggttattataatagaaccagaaaaccagctgggccccctgggcagatcacgggggagctgagctgagaatggaatcagatatggatcggatgatgaaaccgggagatgccgtgcaagcggagccgaaggggcagcggaaactctcaggcaaaaggaccggtttttgacgagactccggagagcgaaggacgcaccgaagaggcaatccgtcccggcggagaatctttcaggttaggttacggaggcactgtatttggcatgggtccagatgcagtgcctccgttttttgaaaacggcgactggaacatgagaaggaaaaggagcgaacacaatggaacgaaaaaccccactctatgatgtccatgtggcagagggcggcaagatggtccccttcgctggctacctgctgcctgtgcagtatggaaccggcgtcatccaagagcacatggccgtccgccagcaggcgggcctgttcgacgtctcccacatgggggagattctcttcaccggccccacggccctggacacgctgaatcacttgctcaccaacgattacagcggcatgcccgtgaacaaggtgcggtacggcgtcatgtgcaatgcccaggggggcaccattgacgacctggtggtttacaagtttggagaggaggcctatctggcggtggtcaacgcctccaaccgggagaaggactatgcccacatggcccagaacctgctgcccggcaccaaggccgaggacatctcggacacggtggcccagctggccttacaggggcccaaggccccggctatcctgaagagcctgctgccggaggaccagattcccaagggatactacaccgccctgccccgtgtggagatacaggggataccgtgcatgatctcccgcacaggctataccggagagctgggctatgagatttatacggccaacgaggacgcccccaagctgtggaagattctccgggaggccggggaggcgttcggcctcattccctgcggcctgggtgcccgggatacccttcgcctggaggcggcaatgcccctgtacggccatgagatggatgagaccgtcacccccctggaggccgggctggactttggcgtgaagctgcagaaggcggaatttattggaaaagatgcccttgtggcggccggcgccccccagcgggtccgggtgggcctggaggtcacgggccggggaatcgtccgggagcaccaggatgtgttcttaggccaggagaagatcggccagaccacctccggcacccactgcccctatctgggcaaggcggtggctatggcgctccttgacgccaagcacgccaaggagggtaccgaactggaagtggaggtccggggccgccggatcggcgccaagattgttcccctgcccttctataagagaggctgagaccagcacctgcagggctgaggagccatggaaacggaaatcatagtaaaatagcgcatacagatcaatcaaaatggaggaaaaaatcatgtctaacattcccgcaaacctgaagtacagcaagtcccatgagtggattctggaggaggatggcgtcttcaccatcggcctgaccgactatgcccagagcgcgctgggagacatcgtgttcatcaacctccccgaggagggagacagcgtcaccgccggggagtccttctccgacgtggagtcggtcaaggcggtctccgacgtgttctcccccgtcaccggcacggtgactgcggtgaacgaggcgctgctggacgatcccgcccaggtgaacgaggccccttatgaggcctggctcatcaaggtatcccaggtcagcgacacggaggagctgctggacgcggagggatatgaagcggttgtggccgcagaggaggcgtaagatgggcagctacattcccgccacaggggaagagcggcaagccatgctccaggccatcggcctgacctctgtggaagagctctttgacgtggtgccggaggcggtccgggtaaagaatctggacctgcccgagggcctgagtgaatgggaggtcagtcagaccatggcttccctggccgagaagaaccgggtctttcggtccgtgttccggggggccggggcataccgccactatatcccgtccattgtgaaaaccgtcaccagcaaggaggaattcctcacagcttatacgccctatcaggcggagatcagccagggggttcttcagtcaatctttgagtaccaaacacagatgtgtgaactcaccgggatggaggtgtccaacgcctcggtctatgacggtgcggttgccgccgcagaggccatcttcatgtgccaggagagaaagcgcaccagcgtggtggtctccggcgccgcggacccccagaccctggcggtgattaagacctattgcgagagccgggatgtcccggtgaccatcctgccggtggacggctgtgccaccgacccggccgccttgcaggcggttttggccggggataccgccgcggtctatgtccaaagccccaactatttcggcgtgctggaggatatggatgccattgtctccgctgcccacggggcgggggcgaaggtcattatgggggtcaaccccatctccctgggcctgctgaaacccccgggggagtacggcgtggacatcgccgtgggagagggccagcccctgggcatgcctctctcctttggcggcccctatctgggctttatgacctgtaaaaaggccatgatgcggaagctgcccggccggattgtgggccagaccaccgacgcccagggcaaccggtgctttgtgctcaccctccaggcccgggaacagcacatccgccgggagaaggcctcctccaacatctgctccaatgaggccctgtgcgccatgaccgcttcggtctacctggccgccatgggcccccggggcctgcggcaggtggcggagacctgtgcttcccacgcccactatctggcgggggaactggccaagctgggcttctccctgcgcagcggggaaaaacccttcttccatgagttctgcacggattgtcccatggaccctgcgctgctctgcgccaagctggaggaacgggggattctgggcggtctgccggtggacggcggcatcctctggtgctgtacagagctgaacaccaaggcggacatggatcaactcatcgcggtcattggggaggtgcttggaaaatgaaactgctgtttgaacggagccgccccggccggggcaatgatctgctccctccctgcgatgtgccggtgacgcagtttgacccatccctgctgcgtggcgccccgctccgcctgccggagattgccgaggtggacctgggccggcactatacggaattggccaagcagacccacggggtcaacgatggattctatcctctgggctcctgcaccatgaagtacaacccccgggtcaacgaagaggcggcggcccagcccgggtttacccagttgcaccccctccagccggtggagacggtacagggggcgctggaggtcctggccacggcggagcgcctgctgtgtgaaattacagggatggacggcatgtccttccagcccgccgccggggcccatggggagtacaccggcctgctcctcatccgcaagtaccaccagtcccggggggatgccgcccggaccaagattctcgtccctgacgcggcccacggcaccaaccccgcctcggccaccatggcgggattccaggtggtctccattccctccaaccaggcgggcggagtggatttggacgccctgcgccaggcggtgggaccggataccgctggcctgatgctcaccaaccccaatacggtgggtctctttgacgccaacattttggagattactcagattgtccacgacgccggcggcctgtgctactacgacggcgccaatctcaacgcggtgatgggacaggtgcgccccggggacatgggatttgactgtgtccacctgaacctgcacaaaaccttctccacgccccatggcggcggcggcccgggcagcggcccggtgggctgcaaggccatgctggagcccttcctgcccaccccgcgggtgaaggaggccgacggcgtctattccctgttcacgccggagcagaccatgggccaggtgcgcagcttttatggcaacttcctggtggtggtgaaggccctgagctatcttttgaccttgggtaaggagggcatccccgcagcctccgccggggcggtactcaacgccaactatttgatgaagcagctcatggaccactatgacatgtcctacaacacccgctgtatgcacgagttcgtcatgaccctccaggggctggcccacgacacaggggtcaccgccatggatgtggctaagcggttgctggacttcggcatccatccccccaccatgtatttccccctcattgtccatgaggccctcatggtggagcccacggagaccgagagccccgagaccctggaccaggcggcccaggtcttcctggatatcctggctgaggccaaggcggacccggagagccttcaccaggccccccgctgctgcccggtgggacggcccgacgaggtgacagcggcacggtctcccatccttcggtattcctttggggaataacgggggcagggagagaccgacatgctgcgccgtttatatgccattgccgcagagggcacagatccctatgaaaatctggccctggaggcctatctcctggagcgggtacagccgggggagtgtatcctgtacctgtggcaaaaccagcgcaccgtggtgatcgggcgcaatcagcacgcatccaacgagtgccggattcaagcactggaagcagacggcggacatcttgtccgccgtctgtccggtggtggggcggtctaccacgacctgggaaatttgaactttacctttctcaccgtccggcgggactacgacgtggccaggcagacggagaccattctccaggcggtgcgggccctggggattccggcggagaagaacggaagaaatgacctgacggcggcaggggggaagttctccggccacgcgtactatcaaactggagagcagtgctaccaccacggcacgctgatggtgtcggtggacctgtcccctctggcagcctatctgcaggtgtcccccttgaagctggaggccaaaggggtgaagtcggtgcgcgcccgggtggtgaacctgacccagttccggccggagctcaccgttgcccagctgcgccaggcgctggtggaggccttcggcagagtgtatggtctgccggtccatccccttcggaccgatcagctggacgcccaggccctggcccggggacgagcccggtttgccgacccggcctgggtctatggagacagccgccccctggcggtgagccgggaggcccggtttacctggggactgctgcgcctggattacagccaggcggaggggagtatcacccaggcggctctctggtcggacgggctggaggcggactttttaagccaagtccccggcgcgcttcagggctgcccccggcagccggcggcggttcgggcgcggctcatggccctaaagggggccgaaaggacactggtggaagacatcctgacactgctcatggaggaggcataacatgaagtacgacattgcgatcatcggcggcggccccggtgggtacaccgccgcggagaaagccgcgaaagcggggatgcaggtggtcctgtttgagcaggatcacctgggaggcacctgcctgaaccggggctgcatgcccaccaaggccctgctccacagcgcggagacctatgcggccctggagcatgcccagaccctgggcatccagacccagggggtatcctatgactttgccgccatgcaccggcggaaggaccaggtggtggagaccctccggcaaggggtggagaagctgatgaaggccaataagatcaccgtggtcagcggctcggcctgcatccagcgggccggcgtgattgcctgccatggggagacctatgaggctgaggatattgtcatcgccaccgggtccaaggtctcctatccccccattcccggcatagatctgccgggggtctacaacagcagggatctgctggaagggggcgggcgggaggtttcctccctggtcatcatcggcggcggtgtggtgggggtggagtgcgcctccatttaccactgcctgggctgcgaagtcaccgtgctggaggcggcagaccacatcctgccctttatggaccgggagattgcccagcgcctgaccatgattctgaaaaagaagggggtcaaggtggaggccaaggccagcgtccagaagatcacgggaatccctggagagatgacggttacctatacagataagaagggggccgagcacaccgtgacagcccaaggggttctggccgccgccggacgaaaggccaacctggacggcctctttggcccagatttctccttggaactggaccggggggctgtggtaggagatgacatgggccgcaccagtgttccccatgtctatgtcatcggggatgccaaggccaaaaatattcagctggcccatgtggccagcgcccaaggggagaatgtggtggcggtcattgccggcaaaaatccgcccctggatctgtccgtggtgcccagctgcgtctacacagaaccggaaattgcctcggtggggctgacggaagagggagccaaggcggcggggatcccggtaaagaccggaaagtatctcaccggcgccaatggcaagtgcctcattgaagggacagagagcggatatgtcaagctggtcaccgacggggccagcggacggatcttgggggcgcagctggtctgcccccgggccacggacatggtgggcgaactgaccctggccattcagaagggcctcaccgccgacgacctgtccgcggttatccatccccaccccaccttcagcgaaatgctcttcggcgcggcggaaggcctgcggctggagtgaatcggattaccctgtgaatggaagggagatcgagccggggatctggcactgggaggaggactatcgggtttactgcaccttggtacagggggagcggctggccatcctctgggacaccggacaggggaaacaggacctgtcggcctgggtggccgcgcaggtgtccacaccctgtatagtgtgcaacagccatggccacagcgaccacattggggggaattttcgcttccccttggtctatgcccatccggcggactggccgctgctggctgcccaggccagattgacagggagagattggtcggctcgtcccctggagccggggcagcggtttgatctggggggacgggaggcgcaggtggtctctctggcggggcataccaggggttccgtgggtctgcttctggagagggagcggctcctcctggcaggggatgccctcaacccaacgctgctgatgctggggccggaggcgggatcattttcccagctgcggcgtacgttggcggcggcagaggcaatgccctttgaccggtatttggccagccacacccctgggccgctgcgcaaaaagcaggtgggactccatctgcggcatttagaccatctgcaacaagcaccctccgcccgtcctggaccctatggctcgggggtatgccggagccagcatcgggaggcggggggaaggtctgtgatttttttcgaccagagccggtggcagcgaccggactgacagaaaaaaccctccggggcagccgcgctgccccggagggttttttagtcggaaccagtgtccgaggaagggaggaaatcatcaaatgcggttttgacagtcggactatcgtcgcaaatgatcaaaacggcatattgatccttggtaaaaacctgggctttttccacccgggcagcttcggcgggaccatattgcaggaagagctttcggcggctttccacatgggcccggagggagtcggcggccttggtcacatccgcggaatcttttaccgcgatgacggcaatctcgtcggccttgccggtggtggagtaagacaggaggaagttttccaccttgtcgtagggaaggtcggagacataggaaaaggtctctttggcgtcggcggcgtcccctgttgtagaggcggtctccgacagggagggcgcggcggccagcatggcctgttggagctgcttcatgttgacggtggcggtgccgctgccctcgttgccgcaggcggccagagaaaggactgcgagcagagcgatgacaagcaatcggattctgtttctcatgggagcagttcctccgcgctgtcggtgaggaattcagatgactcgccgcttccaccgccatcgtccatgcccgcctggatgctttcccaatccaggttggctccaaaggcgtcattgacggcttgctccaccttttgctggtcctcctcggaaatcgtggcctctggggcttcctccgcgtcgtaaccttcgatagagagtcccaagacatacccactgcctgaaatcggcatccaactccagtgcatccagagagcggggccctcgggggactctgcaagggcggtttccacgccgctgatcatggcctcaacgatctgggcgccgttttcatccaaagaggggaagtccaggaagagaccgccctgtttttcctccatcgcctgccgaatcatggcgggaatctgatagatgtcttttacggagactctattctgataagcatagttgtactccagggaagtggcggcggggaagaagtcccggtcccagtcatggctgacagcggccagctcgtcattcatgttgaaattggcgtagctccccaccccttggtcggagtagatgtccacgtgataccagttgccttcgatctgaaccagattccaggagtgatagcgctctgtgttgtggaccaccatacagggaatatccagcatctgcatgaacagacggaaggttgtggcatatcccacgcagactgcgttgtggtatttcagggtcccgtacgggttgtcgcagtcagcggaggtctgcgggacgacttgaagggcgccggtgtcatagctcaattccttggccatccaatcatataccgctttttctttctcatagggcgtcatatcttctgtgatgatttctttcagcacagcggaggccagttccaaggtctccttgtccttcgcgcttaatccgttggtgttgcccgaacgataagcctcagagatgggcagggtggagacaatttcatactggtccagaatgacaaccccatcctcttgggtttccgtctgtgctttggcttccgcccggagatcatacaccgctttggcggtgaaaatactggtgcaggcactgaaaatcacagcgattgtcaagacgacggccagtatggtgagggtgtttttctttgtgtctgtcataaaaacctcgctttctaagatgacacgctctgtcattgagtcgtgcaaactatataggaagcaaaggtttttgtcaatggttttaataaaaacataataaaggttacggcatttttcctaaactgttattgatttgttgttttcttgtaagggatggcggcagaagtaaaaaaacagagggtattccactcggaataccctctggaataagttcgacacgtctacgccacttgatcgtacagggtgtgctgaaatcactgctcctctcctcagaggaacgaaggaagaacaacgtagcttatcacacccaggtcatccaaggaaacccaaacaggggatgcttgcgtagctctctcacatcacacaatcacactgtcgaacatgcgctttctttgcaaacttaaaaggttctatattcaattgagcaggaagaattaccgcacttgcgaaacattctgggggtcatagatcagagatcacagggacaaccgcccaaacagcctttgctggttacaaggaacgaggacagaacccatgtaggaaatatcccgttgctacttgcctcaatgaaggggtgcccatgctctctgaaaggaaactgcatcgcccatgggactcaccgatcctttctttgattcatctgggaggaatcttccggagagtttggaaagcatctttccttctctctgtctaaataatacaagaaaaataggaggttgtcaagagaaaatataaaaattttctaaaaaataaggcgcattcaggcgtctgcgggaactgtcattcgcggtccagggcggataaatcatagggcgtggtctggtagacgtaatagttgagccagttggtgtagatcagctgcccggcagaacgccaccgaaccacggggggcttggtggggtcgtccccggggaagtagtggcgggggacttgaatggtcaggccgcggtcaacatcccgctgatattcctgggccagggtatcccggtcgtactccaggtgtcccaacaggaaaaattggcggctgttttctgttttcactgcgaaaactcccacctcttctgaaacagccaggacctctaaggaggggatttttcggatatcctcttccagcacttcggtgtggcgggagtgaggggcatagaaacggtcatcaaacccgcggaagaggggggaggagggtttgagcacctggtggtcaaacacgccaaaaaccttctgggggagaacgtatttggggatcccgtagtggtaatagagaccggcctgggcgccccagcagatgtgcagcgtggaatgcacatgggttttggaccagtccatgatttggcacagctccgcccagtaatccacggcttcaaagtccatgttttccacaggcgcgccggtgatcaccagcccgtcatagaatttgttcttaatttggtcaaacgaggtgtaaaaggactccaggtggctccgatctacattctgggcactgtggctgacggtttgcagcagctccacttggatctgaaggggtgtgttggaaaatttccgcagcagctgggtttctgtggcaattttggtgggcatcaggttcaggatcaacagcttgaggggacggatatcctggtggatggcccggtactccgtcatgacaaaaatattctcgccctccaaagtggcgcgggcgggcaaagagttgggaattttgatgggcatggggaacctccctcttggtatgcggtggggaaactgggtttccttttcctattaaaaataccatagatcttgggagaacgcaaacctttctcatcgggagggaaagaaccttcgccatgtgccctatggaacggggagacctacacggctgctcctcttgcaatttcattgaatggccaatccggtactgttataataaaatcatagaccatatatgacataatggtgaatttttgtttttctttttgggagaggaaccacatgaggcaaacttacatagcacaagtaaaagcgcatgacaactataaacttgaagttaaaatagattatcctggaaagagtgacggtatagtgatcttttgccatggcagcggcccaaatacttacgataatcccagagaaattgagggaaaacattttaactattttgatttgtttgcggatgaattttgcaggcgaagccttgccttctgccgctggaacacaagggggtgcgctgtgtcaaatcatccccccgacttcgtggccattgacagggcggggtatgaaacctattgtccagcaacttcgattcaagatattatcacggtgaaaaactatgtaaaagcactgccgcagttcagatatgcaaaaatactgcttatggggatcagcgaaggcgccacgctggccccatttgcggcggttcagtgtgatgatattgcggggctgctgcttgcagggttttcctatggaaatatgagggataccttgaactggcaattaagtggcggaagttccatggttaacatgtgcaagtattttgactgcagggaaaagggatttatagagaaggaggattttgtccgtgataaatataacgttcgtccaacactgtttcaggacataccctttgaagccttggacatagacggagacggaaaactgacacagcgtgattttgcactgcaactggcagaatataaaagagaggtctttgaagcgatcgagagaaacgatgatacttggttaagggaaaactatccggttcaaattacatccaagtggtgtaaggaacattttgctttgcctaacgtatctgcaatgctgagcagactatctgtaccgatttatattttccagggggaggatgatgccaatgtcccaattaccgagatccatcatatccacgatgattttcatcgagcggggaagtcgaatttacgtatttttacctttccaaaacatgaccacgatttgaattatctgcattatatttttaacggtatgctatcggaaggcttgcactgtgtttttgacgtggcgcaggcgtgctgtcattcccaagggaatggggagcatcaataagaggctgtttggaagaaatggaggcggttcaaaaaaagagaaagaaaatgaaaaataagggttgacattccaggggaggcgtggtattctatcaaagctgtcgcgagacacgggccgacaagaggtcaggaaatgaaaaaagtttgaaaaaaacggaaaaaatttcttgacaaagcgtcgaagctgtgataaaatacagcttaccccgcagaagcggtgtgcaccttgtaaattaaacaacgtaagtaagaaacacgaagcaccaaaacggacaagtagaagttgtccatgaagcttaaggctttgtggggcaacgttttatttctttgaagctaacgattagcgatcaatgaattgatttgaatagcggtgaaagccgctgtttagataccattttattgagagtttgatcctggctcaggatgaacgctggcggcgtgcttaacacatgcaagtcgaacggaggacccttgacggagttttcggacaacggataggaatccttagtggcggacgggtgagtaacgcgtgaggaacctgccttggagaggggaataacacagagaaatttgtgctaataccgcatgatgcagttgggtcgcatggctctgactgccaaagatttatcgctctgagatggcctcgcgtctgattagctagttggtagggtaacggcctaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaaggaagtgacggtacctcatga

SEQ ID NO: 2232 - DNA, 52101 bp, KLE1738
gcccgtcttcaccgccatgatcgacaccctcacggtcaaccgggccaacatgcgccgggccgccaacggcggttttatctccgccaccgactgcgccgactacctggccaaaaagggcatgcccttccgggaagcctacggcatcgtgggcaagctggtggggcactgtatggacaccggccactccctggagaccctccccctggaggagtatcaaaaggtctccccctatttccaggccgacgtctacgacgccctctccttagaaacttgtgtggaaggacggaaggtctacggcggaccggctccggaggcagtgaaagtccaaatggaacacctcaagcagtttatccaggagcgtgaagcatgaaacctgtgattttcatcgacggacgggagggcaccaccggcctgcaaatctacgaccggctgaccccccgccaggatatcgagcttcttctcattgacgaggaaaagcgcaaggacccggcggaacggaagaaatgcctcaacgccgccgacctggtcttcctgtgcctgcccgacgaggcggcccgggaggcggtggccatgattgacaatcccaacacccgggtgatcgacgcctccaccgcccaccgcaccgcccctggttgggactacgggtttcctgagctctccccccaccatcgggcgaggatcgtctgttctaagcgggtggccaacccgggctgccacgcatctggcttcattgcctccgtgtatcccctggtccagttgggtctgattcccccggaccatcccctgtgcgcctactccctgaccggttactccggtgggggcaagaagctcatcgcggagtatcaggacccccatcgggacccccggcacgcctccgcccgcatctacggcaccaatctccaccacaagcatctgccggagatggtccacgtctgcggtctggccgccccgccggtcttccaccccatcctgggggactatatccagggcatggccaccaccgtcctgctccgcaacgacaccctgcccggccgccccaccgcccaagagatccaccaggcgctgtccagctattatgcggggcaaacctttgtctccgtggcgccttttggcggagatgagcctgtgatctactctgacaccctggtgggcaccaaccagctgcgattgatcgtctgcggtcacgaagcgcaaaccactgtgaccgctctctttgacaacttaggcaaaggggcctccggcgcggcggtccaaaatatgaatctgatgctgggttttgcggagaccgccggtttagaataaccggccgagaggggctcacttccctatgcttttctacaccattctcaccaaggaggtttttctgttatgaacattatcaccggcggtgtcaccgcccccaagggttttcaggccgcgggcatccactgcggcatcaaagacaacttcaccacgccccagcctgacaaaaaggacctggccatgatcctctcctccgtcccctgcgctgccgcgggcacgtatacccgcaatgtggtcaaggccgacccggtgatcctcaccaaggagcacctggccgaccaccaggcccgggggatcatttttgacagcggcaacgccaacgcctgcgcccccaagggcagggagaacgcccagcggatggcccaggccgccgctgccgccaccggcctgcggccccaggacttcgccgtctgctccaccggcatcatcggtgtggagctgaacatccaggccattgagaagggggttccctccctggtcgccgctctggcggacaccccccaggcctccctggacgccgcccacgccatcctcaccaccgacctgaaggtgaaggagatcgccgtcaccgtggagctggggggcaaaaccgtcaccatcggggccatcgccaagggctccggcatgatccaccccaacatgggcaccatgctctgcggcatcaccaccgactgcgccattgacggggccctcctgcaggacatgctccgccaggtggtcaccaagacctttaaccgcatcaccgtggacggggacacctccaccaacgacacctgcgtcgttctggccaacggcctggcgggcaaccccgccatcaccggtcccggggaggactacgacattttctttgccgccctgcgccacgtctgcgagtacgaggccaagatgatcgccagcgatggcgagggcgccggccggctcatcacctgcaccgtgatgggggccgagaccgaggagcaggccgagcagatggccaaggccgtggtccgctctcccctggtgaaatgcgccgttttcggcaccgacgccaactgggggcgggtgctgtgcgccatcggctattccggggcgcagtttgatcccaaggacgtggaggtgaagttcctctcccgggcaggagaactgctggtgtgcgccggagggcaaggggtggccttcgacgaggcactggccaagcgggtcctgtcggaggacgaggtggtcatccaggtgaccctcaccagcggcagcgccacctgctcctgctggggctgtgacctgacctacgactacgtgaaaatcaacggcgactaccgcagctaatcccaaaagagaggactctcccatggacatgaacaattatatggagcgctccaccgtcctggtggaggcgctgccctacattcaaaaatggtacggaaagaccattgtcatcaagtacggcggcaacgccatgatctccgaggagctccgcagcgcggtgatcagcgacatcatcctgctccacctggtgggcgtccgcgtggtgatggtccacggcggcgggccggagatcggccacatgctggaaaaggtgggcaagcagtcccggttcgtggacggcctgcggtacaccgacgaggagaccatggacatcgtccagcaggtcctctgcggcaaggtgaacaagcacctggtctccatcatcaacaatctgggaggcaaggccatcggcctgtgcggcctggacggggccctcttccaggccaagaagctggacgagaagtacggcctggtgggtaagatcgtcaaggtggcccctcaggtggtcaacgacgccctcagctgcggctacatccccgtgatttccaccgtggccctgggcattgacaacgacaccgcctacaacatcaacgccgatacggcggccgccgagctggccatctccctgggggcggagaagctcattctcctcaccgatgtccgcggcgtgctccgggaccccaaggatgacagcaccctgatccggcagatccgcctggaggaggtcccctccctgctctccagcggggttatcggcggtgggatgattcccaaaatccagtgctgtgtcaacgccctggaacacggggtccaccgcacccatattttagatggacggattccccactccatcctcactgagatgctgtcccatcagggaattgggacgatgctgtgggagtgaaagaagaattttgggacccgctgcgcttggctcccaaaatggggagacgacagccgactgcgcgcacggcccctctggggccgcacacttgcggctgagaagtatgtttttcccggcgaagccggggaaaacatggattagaaattctttcccaccctgcggggcgggaaactctgcgaggctttttgtaagaggaaaggagtgtggggattgtgacctttgcagaattgaaggccctggatgagacctatgtgatgcatacctatgggcggtttccagtggacattgaccacgggcagggcgccaccctgtacagtctgtcggggcggaaatacatcgactttaccagcggcatcggggttaattccctgggatatggcaaccccaagtggatggccgccattacagagcagattgggaagctggggcatatctccaatctgttttatacccagcccgggaccttgctggcccagcagctgtgcacccgcagcggaatggacaaggtctttttcggcaactccggggcggaggccaacgaggccatgatcaaagtggcccggaagtacagcttcgataagtacggcaagggccgcagcaccattctcaccctgaaccgctccttccatgggcggaccatcaccaccctcaccgccaccgggcaggagagctatcacaactatttcttccctttcaacgaggccttccgctacgccgaccccactctggagagcatccaggcccaggcgggggacgacgtgtgcgcggtcatggtagaactcatccagggggagggcggcctgcgccccctggaggtctccatggtccagtccctggccgccctgtgccgggagaaggactggctgctgctggtggacgaggtccagaccggcatcggccgcaccggcagcctgttcgccttccagcagttcggcatccagccggatgtggtctccttcgccaaggggatcgccggcggcctgcccttgggtggtatcctcaccaacgagaagtgcgccggggtccttacccctggaacccacggctccaccttcggagccaaccccgtctccactgccgcgggcctggcggtgctggagaccatggaccagcccttcctggaccaggtccgggagaagggcgcctacctccgggcgggcatccaggccatcggcagcccggaactgggggatgttgtgggcctgggcctcatgctgggcattgatgtaaagggcccccggaccaacaaggaactggccgccctgctcatcgaccacggcctgctgtgcctcaccgccggggaccggctgcgcctgctgccgcccctggtcatcaccaaggaggaaatggacgagggcctggccattctgaagcagaccctcatgggataagagaaaaaggagaacacatccatgaaaaaagacctgctgaagctgctggacctgtccagccaggacattctcaccattttagacaccgccgaccagctcaaggccatgaaaaaagcgggcatccagcaccccttcctggccgggaaaaccctggccatgatctttgagaagagctccacccgcacccgggtctcctttgagaccggcatgtaccagctggggggcaacgccatttacctctccgacaaggacagccagatcggccgcaacgagccggtggaggacaccgcccgggtgctctcccggttctgtgatggcatcatgatccgcacctttgcccaggaagaggtggagaccctggccaaatacgcctccatccccgtgatcaacggtctgaccgacttctgccacccctgccaggtgctggctgatctcatgaccatccgggagcacaagggcaagctggccggcctgaagctgtgctacatcggtgatggcaacaacatggcaaactccctcatcgtgggcggcctcaagtgcggcatgacggtgtccatcgcctgccccgatgcctaccgcccggaccctgccgttctggactttgcccagcagtatcccggcatgctccagtgcaccccggacatcctggccgccgccaaggacgccgacgtcctgtacaccgacgtgtgggcctccatgggacaggagggcgagtccagccagcgtaagctggtctttgagggctatcaaatcaacgacgccgttatggccgccgcccatcccggcgccatggtccagcactgcctgcccgcccaccggggagaggagatcaccgcagcggtctttgagtcccacgccgacgagatcttcgacgaggcggaaaaccgcctccacgcccaaaaggccgtgctgtatctgctcatgaaataacggaacctgccgttccatccacgcccgcgcccttgcgcgggcgtggattttttcttataaaaatacccataaaacacgccgctcagaactatgttttttccttgcttttttgaaagttagggttgacaaactccgaaagaggagatatactatgcaagcaattagttagagctaattacttctctttgcttcacaagtcagccggcagttcgcggccggagcatgacccgattattatatttttaatggtgataaaatgaatttaagagatgcagtagaaggtaaggagtatgtcgtccgccaaattgacacggaggacgaggatttgaatgcctttttattttccctgggctgctacagcggagaacatattaccgtggtctcccatttgaaaggcggctgtattgtctccatcaaagacggacgctacaacattgaccatcaattggccgacgccatcatcatttgagcgttgggcgttgttgtgcgtcttcttcttttcgctataagttagcttttgctaatttataataggtatgcgcatccgagagagagtcaaatccaacaaacgacacgggaggaatctgtcatgagaattgccttgacgggcaacccgaactccggtaagaccaccatgtacaatgccctaacaggcaggaacgaaaaggtgggcaactgggcgggtgtcacggtagagaaaaaggaacaccccatcaaaaaagcctattacggcggggaggagcagctgatcgctgtggacctgcccggcgcctattccatgtctcccttcaccagtgaggagagcatcaccagcgcctacgtaaagcacgaaaatcccgatgtgatcatcaacattgtggacgccacaaacctcagccgcagcctgttcttcaccacacagctgctggagctgggcattcccgtggtggtggccctgaataagagcgacatcaacgagaaaaaggacaccaagatcgacgtggacgccctgtcggccaagctgggctgtccggtcatccggaccgtttccacctccgcagagggcctgaagaccgtggtggagaccgccgtggcccgggccaacgagagccagctcgccccatacagcgagggaaacattgatctgaccgacaaaaaggcggtggaaaatgccgaccgggagcggtttgatttcgtcaacaaaatcgtctccaaggtagagacccggaaggtgctgaccaaggataagaattccgacgaccggatcgacgctgtcctcaccaacccggtggcgggcatcctcatctttgccggcatcatgttcctggtcttccagatttcccaggcctgggtcggccccctcatcgccgacaccctggtggcctggctggagaccttccaggcctgggtgggcaccctgctggagaatgccaaccccttgctgtccgccttgctggtggacggtgtcatcggcggcgtgtccgccgttatcggcttcctgcctctggtcatggtcatgtacttcctgatcgccctgctggaggactgcggctacatgtcccgtgccgccgtggtgctggaccccatcttcaagaaggtgggtctgtccggcaagtccgtcattccctttgtcatcaccaccggctgcgctgtccccggcatcatggccagccgtaccatccgcaacgaccgggagcgccgggccaccgccatgctctcccccttcatgccctgcggcgcaaagatccccgtgatcgcgctgtttgccggcgctttcttcgacggagccggctgggtgagcttcgtgatgtatgccaccggcatcgttctgatcttcctgggcgctctgctggtgaacaagatcgccggctacaaggccagaaagtccttcttcatcatggagctgccggaatacaaggccccctccctgtggggcgcctttaagtccatgtgcaaccgcggctgggcttacatcaaaaaggccgccaccatcatcctgctgtgcaacaccgtggtgcaggtgatgcagaccttcgactggagcttccaggtggcagagacagcggactcctccatcctggcctccatcgccggccccttcgcctatctgctggtgcccatcgtgggcgtcctcagctggcagctggccgccgccgccgtcaccggcttcatcgccaaggagaacgtggtgggcaccctggccgtctgcttcgtgggtctggagaacctgattgacaccgatgagctggcgatgctggagggcacgggcgctgagattgccggcgtcatcgccatcaccaaagtcgccgccctggcttacctcatgttcaacctgtatacaccgccttgcttcgccgccatcggcgccatgaactccgagatgaagagcggcaagtgggtctgggccggcatcggcctgcagctgtgcacaggctacacggtggcctacctggtctacaccatcggcaccctggtgaccgccccctccacgctgaacgtcggcgccgctgtggctggtttgatcgctgtcctgattatggccgctgtcatcgtctgcatggtccacagaaccaatcggaagatcaaagaggactatgccctggccggcaatcaggctgccatgagccggtaaagttatggtagacgtcatcattgtggccatcttggtctgcatcatcggcggaatcctgttttacctgtatcgggccaaaaaacggggggaagtctgcatcggctgcccgtatggcagacagtgcacaggacactgcggcggacatggccaagagaccaaacacaagaagaaacattgatccattgacggaaggggatgtgcgccttggggccgcatccccttcccccaaaaaggaggcactgcaatgggaacggaaaatatcatccttctcgtccttgtcgtcgtggttgtcgccatcgggctctggtctaccgtccgtcacttccgcggcaagggcggcggctgctgcggcggcggagattacaagccccggaaaaagaagctgtcccatgtggccggacaaaagaccttccaggtggagggcatgcactgcgagcactgcaaagtccgggtcgaagaagccgtcaacgacatcaaaggcgcggccggcaaggttgacctgaaaaaggggcttttgaccgtgtcatacgccgaatccctggatgatgagcaagtaaagcagaaagtcgagcgagcgggctaccacctgacaggcacacgttaatccccaaaggtgcccctgtctcctttctgtctctttccatttcgaaaacagcaaacccctgtcccaggcaccgtttggcctgggacaggggtttttcacttgggaagcctgccagacgcctctcccctgagagaaggccggcagggcgggatgtagggcaacgtctcaccgggctctcaccccccgttttcccacccgtctgggcggtttggactctgggatggagagcccttccagcctcagcagaaaccgcttgcgctccactccgctggaatagccgcccagggttccgtccgcggcgatgacccggtggcaggggatgagaatgggcagggggttcctcccgttggcctgtcccaccgcctggaacgcccggggagaccccacttgggccgccagctcccggtaggagattacccttccgtatgggatatcgcacaggctctgccaaacccggcgctggaatgccgttccatccgggttgagggggagggaaaacgcttgccgctgaccggcgaaatacgcttccaactggcgctttgcctctcggaagagaggcaggtcgtcataactgccatagtccccatagaccagggcagtcaggtggtcgtcttccgcgaacagggtcagagggcctaagggtgaatggatcacagcttgctccatggcgtgctctctttcttgggcaggacgcggagccctggttgctgggctccgcgtccgtaggcaaagacgttcacaggtttagtttaccaaatcctgtcccgaaagtccagcacttccagggccgagagaagcatttccgccgcctgggcccgggtaagggacgggctgagggacagagacccgtcctcctccgggttcaaaacccccacggcctccagattgaccacggactggtaggcccaggcgggggccgcgtcctgggacaaggcccccgtggccgccacgtcagagacctggagcaggcggttgagcatcaccgccgcctccgtctgggtaatcacccggtcaggagcgaattccgccccgtcgccgtccccgccgcttccctggaccatcccggcccgaagggctgaggccacatagggcttggcccagacggaaatactatcgtcgtcggcaaagccggtcatggtggcctcgggaagggtctccagccccaccacgtccatggccatggccaaaaactcctcccgggtcacaggggcctccggccggaagaaccaggtctcccccatctgttcccccacaaaaatatcccgctccgccagggcaatggccgccttgtgggcggggttgccggccatgtcggaatacgtgaccttggtatccggcttctgaatcttgatcgaaaccactgcgggctgggaaacattcccctccccatcctctgccacataggtgaaggagtccttccccgtcttgttctcatagggggtataggtgaagcgggccgagccctcctcggcaaaggtgatggccccccgggcagggtttttggtcacccggaaggtcaaggggtccccttccgggtccaccgcggaaaaggtcccactgaccgccacatcacggtaggtggtcaaggaaaagttctccgcgatgggcagggactggtctcccctcgcggtatcgtcctggtcaaacagcgcaaacgccggcaggaccatggaaaaggaaagggcggcgaggatcaccaggaaccccagccgccgggaaaaacgggactgtgccattggaatgacctcctctttggaaagttgtccttagtctgtccccggcccgggggcttatgcgcccggccaattgccgcttcctcccagcttctcctgtttcatggacatgacaatccccaccccgccgaaggcggtgagcagggaggacccgccgtagctgaaaaagggcagcgtcacccccaccacaggggccacgtacagacacatgccaatgttcaaaatcgtctgcgcgccaaagacgcccgccacgcccatggccaccgcggcaaacagcgggtcccggcttcggtgagccagccagacgcagcgaaacagaatggcccccagcagggccaggatcagcaggcagcccaccaggcccagctcctcccccgccacggaaaaaatgaaatccgtgtgccgggcgggcagggccgacggggaggggctctgggtctgggtcccctggaggtatccctggcccgtgacctggcccgaaccaatggccagcaggctgcgctcctgctggaatccctttcccaaggggtccagcccatggtcgaacaccaccaaaaaccgcatgcgtacatactccggcagccggggccagagcaaaaccaccgctcccacgcccgcggccacctcccccaggagccagaggggatgaacccccgccgaccagagcatcaccaggtagaccgccagatagaccgccaccatgccaatgtccccggacaccccatagagcagcgcgcacagggccaggacatggagcagcagcagaaacaccgccttgggccggttcaatcccttctcccccagctttctcagctgaagagccagcaggagcagaaaggagattttgaccacctccgccggctgcaaattgaatccgcccccgggcagggagatccagctcttgttcccggttccgtcgtcattgcccagggggaccagcaggagcagaagccccacattgaccacaggcagcagccaccacaacttctccagcagctttctcacatccagcacggacagaagcaggcacaggacaacccctccccccagcgccacagcctgctttcccaccaagccatggagggtttcctcataccgggtggcgctgaaaatcagcgccaggccatacagcgccgcactgaggcagagaaaaaacagcggccactcccgcttttttcgtcccacggcacacgcctcccttcccattctcccggggcttgtcccccagcgggtcgtttctcccttcatcataccctgaactggcaataaattttgtcgcagaggggtgcaactttgctcattttatgataaaataccctcaatctactggcgtcccccatggccgccaggaaaggaacggaactgccatggaacgatattcagcaagcgaacaggaaaccgaggccatcggccgggagatggcccagcggctggccccgggtgctgtggtggccttcaccggcgacctgggggcgggaaagaccgcctttgtccggggcatggcccagggcctgggcatttcccagcgggtgaccagccccaccttcaccatcgtcaacgagtatgagggcggcaccctgcctctgttccactttgacatgtaccgcctgcgggacgccgatgacctgtttgacatcggctgggaggattttctccgccggggcggcgtctgcgcggtggagtggagtgaaaccatccaggaggcgctggaaccggacaccatctacgtggacatccgccggggggcagagacgaaccagcggattctcaccatccggggacccggatggtgaccccccaaaccaagggaaaggacgggtctcatcctgtgaaaatcttagctttggaatcctccgccgtggcggcctccgccgccctgtgcgaggacgaaaccctcattgcccaggccttccaaaacagcggcctgacccacagccaaaccctgctgcccatggtggagcacctgcttcagggctgctccctcaccccggcggacctggacctcatcgccgtggcggcgggccccgggtcctttaccgggctgcgcatcggggttgccaccgccaaagggctggcctgggccgcccagcgcccctgcgccggctgctccaccttggagtccatggcctggaacctggctgggttctccggccaggtctgcgccgccatggatgcccgccggcatcaaatctacaacgcccggtttcaggtggatgggcagtgcccccgccgcctgacgccggaccgggccatctctctggacgacctggttcaggagctggcagggacccaaacccctcaactggtggtgggggacggcgcccagctctgctatgacgcgttgaccgccgcgggcatccccgctgttttggccccccccaatctgcggatgcagagcgcctggggggtggcccgtcaggccctggcgctggcccaggccggccagacgctctcccccgcgcagcttgtgccggtttatcaccggctgtctcaggcggagcgggaacgactggaacgggagcaggccgcccagacgccccatccacaataaatagaaagggagaaatggaacaaatggaaatggtacacgtattggatcaccccctgctgcagcacaagctctccatcctgcgggatgagaccaccggggtcaaggattttcgggagattgtctgcgaaatcgccaccctcatgtgctatgacgccacccggaacctccccctccaggctgtggaggtgcagacccccgtggccaaggcggtgacctaccagctggccggtaaaaagctggccattgtccccgttctccgggcggggctgggcatggtggagggcatcctcaccctcatcccctccgccaaagtggggcacatcggcctgtttcgggacccggacaccctggagcctgtgaaatactactgcaaaatgcccacggacatcgccgatcgggacgtcatcatcctggaccccatgctggccaccggcggctccgcctccgccgccatctcctttgtcaaggagtacggcgtgaaaaacatcaagctgatgaacatcctggccgcccccgagggcatcgcccgggtacggaaggaccaccctgatgtggagatctacgtggccgcggtggacgaccagctcaacgaccacggctacatcgtccccggcctgggggacgccggggaccggattttcggaaccaagtaaggaagcgattccctctctccgccccgggcgggcccggtccgcccggggcggaaaactttttccaaaaaatctgaaaaaagtcgaaaaaatcccttgacagctgcccacccctatggtattataagtctcgcactgaacgagacacggaactccgacagagcaaacaacgcgcgagtggtggaattggcagactcgctagattcaggttctagtgtgcaatacgcacgtgcgggttcaagtcccgcctcgcgcaccaaacagccctaaccaaacggttagggctgttttctttctctcttccctgggcattccccaggttccgctcccaaaggattgacttttccaaccatttcctgtaaaatggcccaccataggagaggacggtgttccgatggacttaaacaagaaaaacatgaagcggatagccctgctcatcgccttcgggctgctgctctattgggggctcaaccaccctgggcaggccggacagatgctttccacggtcttttccatcttcctgccctttctgctgggcggctgtctggcctttctgctcaatgtcattctccgccccgtggaacggggttggcggcgcgcctggggaaaacggtacggcccccggcaaaaacgggcccagcggccggtgtgcctgctggtgagcactctgctgctggtgggggttgtcttcgccatcttcttcattgtggtccctgccctgaaggacagcgtggtaaactttgtcagcctgctccccagccggctgacccatctggagcactggtggaacaacctggcgggttttctggaggcccactccattcagctgccggaattctcgctcaattccgcagagctgcaaaacaacatcacctcctttctctccaagtatggagaggattttctcaacaccaccatcggcatcacctcctccatcttctctctggtggtcaacctggtgcttgccctcgccttctccctctatctgctggcccagaaagagactctgaccggtcaggcgaaaaaggtggtccgggctctcttctcggaaaaatgggcccactggatcaccgacgtggcccgcatgaccaaccggaccttctccaattttgtcaccggccagctcacagaggcggttattctgggcaccctgtgcttcctgggtatgctgatcttccgcctgccctatgccggggtgatctcggtcctggtgggcttcaccgccctcatccccatcttcggcgccttcatcggggtgggcatcggggctttcctgattcttctggtcagtcccataaaagccctgtggtttatcctcttcttcgtcattctccagcagctggagggcaacctcatctacccccgggtggtgggcaagtccgtggggctgcccgggatctgggtcctggccgcggtgacggtgggcggcaacgcctttgggctggcgggcatgctgctggccgttcccctctgttccgttctctacactttggccaggcagggtgtcaacgcccgtttggcccgcaaagggctgtcctcttgacgtgggcagccccttcgatttttccccatcccccttgcctttgggatgggatcgtagtataatggttagcaaacgcaaaccatctaaaagaggaggccgccgatgggggaacaagatcagcagaccagacagcgcctgctgcgctgcgccaaggcggagtttctctcccgggggtttgagcacgcctccctgcgccgcatctgcggggctgccggggtgaccacgggagcggtctattttttcttccaaaacaaggaggatttgttcgcccagatcgtacaggacactgcccaacaactgacccagctgggacatgaactggcctcggaggaattggaacacccagacactggccccgactgcgacctccgcttcatggcctttctgtaccgccaccgggaggaggccctgctcctgctggaaggggccaaggggacgcgatatgcgtcctttcgagaggaactgtatgacacgatgcggtccgccttttccctgttttttcaccggtacggcgcaccggacgcggatgcggaactgatccggattttggtggaaatgcggatgaagggaactctggaactgctcaagggagagtattctatggaacatgtgctgcggctgacccaacagaccggaatttacgccgacggcggttttcggtctctgatcgctttcttacaaaaaaacagcaaaggctaaagcccggagcgaatgctccgggctttttacataacaaaacataacaaccgttatctaaggaggaacacacatggatcagaagaaaacagactatgggaactgggtccccctggccctcatgaaaaggctggccgccatagccggtgcgcttctggcgggcgaagtcctgctgattgttctggatggccccacggcacttacgctccttgtggggggattgctggccgccgccgtgatactctggctgtacatgcttcgctgccgcgttctgttcgacttcaaccggggcggtctcatgggacaggtccaccagtatttgacggaccatctgccctgggacggccggggcaccctgctggacatcggctgcggctccggcgccctcaccatccgctgcgccaaacggtttcccaacgccagcctggtgggggtggactactggggcgcggcgtggagctacgccaaggaacagtgccagcagaacgccgccgccgaaggggtctcccaccgggttcgcttccaaaagggggacgccgcccacctggccttccccgacgaaaccttcgaggccgccgtcagcaactttgtcttccatgaggtccgcacccagccggacaagcgtgaggtggtacgggaagccctgcgggtggtcaagaaagggggctgcttcgccttccaggacctctttgagaaggaatccttgtacggagacatgacggactttttgtcccagcttcggcaggcaggggtgcaggagctccattacatcccccatgtggagcggcagggttttattccccgctatgtgcaggccccgtggatgctctctgacgtgggccttctgtatgggaggaaatagccttctctttccttcccctccgggtcccggaggggaaggttcttgcgcttttgtgtagaatatggtatgatatgatgtcttaaaagcaattcagtctgaacaccttctggtagatcgttttcatcccagaacggttgttctccttttgggaggctcctgagatgctgcagaaaaacgttttagactatttggactcctcggccgcccggttcccccataaattggcttttgccgatgaagcccgttccttcaccttcggccagctgcgggcctgcgcccggggcctgggcaccgcgttggccgatctgggtccccagcacaaccggcccgtggcggtgctggtcaaccacaccgcggccaacctggccgccttctttggggtgttggaagccggacatttctatgtccccctggaccttcaaatgcctctgccccggctgcgggggattctggagaccctctcccctgccgcgctggtctaccccgccggggaggagaccctggcccaggccctggcggacctgtgcccggtgctgtgtgcggaggagggatttgcccatcccccccaggacgccctgctggatgcccgccgggggcgggtgctggacatcgacccggtgtacgccattttcacctccggctccaccggcacccccaaggggatcgtcatcgcccaccgcagcgtcattgacttcaccgagtggatggccgacgcctgtcagtttacccaccaggacgtgatgggcaatcaggcccccttctactttgacctgtctgtaaaggacatctatctgacgctgaaatgcggggccaccacccacatcattcccaagaaggatttcctcttccccaccctcctcatggatttcctggaggaaaagaaggtcaccgccctggtgtgggccacctccgctttccatctggtggccaactccggcgtgctggagaaaaaggttccctcccacctgcgtaccgtcattctgggtggagaggcccttcaggccaagcagctcaaccgctggcgggccgccctgccagcggtgcagtacaccaacctgtacggccccacggaagtcactgtggactgtacctggtaccccatccagcgggaattcgccgacggcgagagaattcccatcggccgggcctgcgccaacaaagaggtctttctcctggatgagcacctccagcccgtgcccccaggacagccgggggagctctgcgtccggggcatcggtctggccaagggatattttggccagtgggacaagacccggtcggcttttattcaggacccccgcaaccccaactaccccgatcttatctaccgaaccggcgacctggcggtgatggacgaagcaggtctgttcaccttcctgacccgacaggacggccagatcaagcacatggggtaccgcatcgagctgggtgagatcgagaccgtgctcaacagcatcccctccatggaagaggtggcctgcctgtttgacccggaaagagaccggattcactgtatctacaccggcagccaggagagcaaggacatcgccaagctggcccgggccagcctgccccggtatatggtgcccaatctctaccataaggtggcggtgatgccccacaatcccaacggaaaaatcgaccggcccaagctgaaagaggaatggattcatggaaacgatcaccgcctatgaggacctggcccgactggtcaccggacacttccaccggggcgtgcggaccaacaccatggtcagcccagaggaatatggaccggccattgccgccggcacccttcgggcgcaggccaccccggcggggctgctgctgctgcgggaccggggggaccacacccgcctcaccttttatctgggggatctgaccgttcccctgggcgcggagctgccccctcccaccgtcaccgaagtggctttccgcccccgggacacaggacttcgggagaccgtctcctatctgaccgcccagggctttgtccctgtgctggagcggcttcgtctctcccgccccgcgggagagacgggagagccggctctccccctttctaccccggcgccggaggcgctctcctctgtgcaggcctttttgcagtccaatttctcccccctgaccggctgccttcccaaccgggaagaactggaccgggacctgcgccagggccgtgtactcaccttggaggaagggggcgcgatcacaggtctgctccacttttccctggtagggaacaccggagaaatccgtcatttggcggtccgatccgatctccggggcaccgggcgcacccgccctctgctggacgggtatctccgtgccatcggcggtgtcaaaagtgttgtgtggacccgctctgacgatttggccgcccaaaccgcctatcagcggcggggcttcgtcccggacggacgccgctccgttgtgctgtgctatcctgagaaagaaggtatgaaaccatgaaagaagaacttctccaaatcttgaccgaggcagtgcccggcgtggactttgaggctgaaaccgccttggtagacgacgaaattctggaatccctggacattgtcaccattgtctctgagatcaaagacgtctttgacgtggaaatcacggtggatgacctggtccccgagaattttaactctgtggaggccattctggccctgatccaggcccgaaaagcgtaaccatgtcctttaccacactcccctttctggtcctggtggccctgtcggtggcggcgtattacctgctgccccagcgcgtccagtggatggccctgctggcggccagcatggttttctactgtgtgggcgggggcaagaccgtcctctatgtcttctacaccgctgtcatcgtctatgggtcggggcttctcctggggcggttcaatgacctgcgccgggccgcccccaaagaggagaaaaaggcgatcaccgcgcgatacaaaccctatcgccgggctgtggttctggtcgcctgcctggcgaactttggcctgctctatgtgctgaaatactggaacttcaccgcggacctcttccagcccctggccgaccagctccgccccgggacccaaatccccctgtctgagctggttctgcccctgggcatctcctttttcatgttccagtctgtgggctacgtcatcgacgtctaccgggacaagtacgcgccagagaagaacttcgccaaacttcttctctttgtctccttcttcccccagatggttcagggtcccatcagccggttcaacgacctggcgccccagctctttgcccggcgcagtttggattacaccgatctaaagtacggcatccagctgatcctttgggggtatttcaaaaagatggtgattgcggaccgggccgccgtgctggtgaacaccgtgctggacgacccctggtcttacagcggcagcattctcgcggtgggtgttctcttctactgtattcagctgtacggggatttctccggcggcattgacatcacccgtggggtggccaggctgttcggcatcgacctggcggagaactttcgccgccctctgttctccacctccctgaccgacttctggcggcgctggcacatcacattgggggcctggatgcgggactacctcttctaccctctctccctgtccaagccctttggcaagctgggcaagttcacccggaagcatctgaagggcaagctggggaaaattctccccacctccctggccactttcctggtctattttgtcatcggcatctggcacggcgccaactggcggtatgtggccttcggcttctggaacggcggaatcatcaccctttccctgctgctggccccgtattttttgcgctggaagcaggccctacgtatcaacgacaagtccaaaggctggcatctgttccagctggtccgcaccaatcttttggtctttttcggccggtacatcacccgggcgccccggttcctcaccgcggtttggatggtgaaggagacctttctccaccccaacctgcccgacctttggaacggcaccctgatgaccctgggactcggcggcggagactttctgatcctctttttgggcgtggctaccctgctgctggccgaatggtatcaggagaaaaaaggccccatccgtcccatgctggaacggcagtcccccttcctgcaatgggtggccattctggtgccgctggtggtcctgttctgcttcggcgtgctgcgggccgactacatctcctcggattttatctacaagcaattctaacaacaggaggttcccatggattccaaacgatggctggcctgttttctggctacggttctgttgctgggggctgccgtggtcgggttcaactactgggtggacccctttggggtcttttcccataagtccctggagtggccctcctacgagatgaccataaacccccgcaccgccaaaatcacctatctgaaagaccatcaccaggactatgactcctatattttaggctgttcctccaccagctccttcccggtagagtccctcaattcctacctggacgccagcttttacaacatgattatgtacggtgcggacatgctggatgtggaagagcaggcgttctacctggtggagaactatgaagtcaaaaatctggtggtcaacgtctatctggacaacgcgaaagactacaacaccgagccagaccctctgtcctacgccatgcccccggagaccacagggaaaaacgccgccgcgtttttgtccaaatacctcttcatggacccccgccacagtctggacaagctgaaggccctgcggaaggacacctacctcacccagaccttcgatgtctttgaccctgttaccggcgcctacgacaaaaaagtacgggatgccgagcccatcggaaatatggaccgatacctggaggcatatcccgttttcgccaactaccctgaggccaccaacaccaccaacgaggaggccatcaccggaaccctggagagtctgacccgcatccgggacctgtgccaggagaacgggatcaacctcattgtcctctgcgccccggtgtacgcggattacatggactatttttcctgggaccaagtggccgacttttacacccgtctggcccaggtcacaccctactgggatttctcttacagctcggtcagctttgaaccccggtacttctacgacgagacccacttccgcaactgcgtgggtgagatggctctggcccggatattcggggatgactccctgtacattcccgatgacttcggtgtctatgtcacctcggacaacgtccaggagcaccttgcggacatggcccaggccgcgcctctggccgcacagtcctataccgcggaggttcccgtgctcatgtaccaccacatcgaccaggagggcaacgactccaccgccatgacccccgcgctcttcgaggcccagatcgccgccctggcccaggcaggctacaccgccgttttcccggacgacttggccgcctatgtgaaccagggcaaggccctgccggacaagcccatcgtcatcacctttgacgacggctacctgagcaactacgaatatgcctggcccattttggaaaagtacggcatggtggccaccatctttatggtgggggccaccacgggaaataccgagcactacaaagacaccgcgtaccccattaccccccacttctcctacgagcagggggcggagatggtggcctccggggtgatctccctgcagagccacacctatgacatgcaccagtggggcccctacgagtccacagaccagccccgggagaccatcctgcccttagagggggaatcggaggcggactaccgggcatccctctccgccgactgtcaaaaaatccggcaggccattcagaacggcacgggggaagaaaacgtccacgttatcgcctatcccagcggccggtacaattcccttgcccaggtcaccttgctggaaaacggctttgacatctccttcaccaccgaggagggcaccaataccctcatcaaggggcagccccagtctctgctgggcttgcaccgctacaacatgaaccagtctgtctccgtggaacaactgatggaatgggtttccccggcacggggatagtccctctctaaccgtgaaagagcccccagcgcccttctggcgctgggggctctttcggttttcttcgccgcaaaaccctgattgattattcatactgggaccagtcgggggtctcccgcagctggatccaggtctcatagatgcctgtggtgcgttcatagtcgtggctgttggtggcctcctggatggccaggtagtaccactggctggggtcctggttgtccggccaggtaaccatgtccttcagcaggacctcggggctctggggattgcgctggaggacgcggttgatcatggtcaccgcctcagcccgggtgatggccttgtccggccggaaggtgttgtcctcatagcccataatccagcccagggacaccgcccgttccacttcctccttggcccagtggcccgccagatcggggaaggtggcgccgtccgcgttctccccggtgtcaaaccgggcgcagatggccgcgaattccgcccgggtgataggggcattggggacgaaggtatccggggtccggcccctcaagatgcccagctccgccatggtggagatggccgtgttgtaccagtcaccggcgccaacgtcagcaaaggcgctgtcagtggtcaggttctcctggcgcacctggtcctggagcagccggaagaagatggtggccacttcggcccggctgatgttcccgccggggcgcactgtgccgtcctcatagcccaccacataagcgtagtggtcctctccattgagcatgccggggacatccgtctcttcccaaccggcgtagaccgttttgttcgaggtcatcttgatctccgtgatggcctgggtcagttccttgtcggcataccagccggtgaaggtatacccctcccgggtgggcaccttgtccagttggaccacagtatttctgacgtaccgttcgtctttgtactgcatgcccccgttggagtcataggacagggtataccgggtggtcacaccgccccccgaagattccttcacccaggtcagcgccatggcaccgatggagtaatttttctcactggcaaaatcggcaggcacggtaaacttgatccctgctttctcattcgtgacctcaactttccgaatggaagtctttttaatattgtccagcgcgccttctccgctgtctgcctgggtataggtgcggttcaggtcgtcgaaacgatagagcgcaaattccgtgttctggtcggttcccgcaggatagggcagataaatgtcatacgccccctgggcgcaaaccagcaggttgctgtcgttggcgtcaatcaggtccaggtatttcatggcgtactggcggttggggtcggcctctaccttgacatcacttgttgtcgcaccctccagtgtgccctccagacgctgctgcaatactttcataaaggggtcttccgccgccgcagcactgagcaattcgtcgtggagcagacgaatatccgcgtctgcgttcggtatctggcccgcaaggttgtttaccaggtagttcgtgctatccggaatcaccgcggtcgcgtcctttaccgcgccggtcggctcgccggactgaatcgcgctggcgaactgatcgatattctcaataccagctacgtcggaaacattgcggatgtgcagcagactgtcttctgtcttgatcttgcagccattgatcgtaatattggtaagcttaattccatcgctcggctccactttggcaacataggtgcccggcttgtggtcatcttccagcagggtgccatctttatcgtaatagttgattacgaacggatattggccatggtgctcagacttgttccaaacattgccattcactttgatctctgcatcctcatccaagccaacaaagcgcggatcagggaagcagttggaagctgttggatcatcgtggttgtgctcgccgcccgcgatgtacttggtcagctcgattggcttgaggataaagggcttggcggccagcttccactgatgcttggccacgagtagagcggtgctatcctctgccacaagctgagggctgatagtcgtaccctgcgggaaagcaaagaatgtaccgccaacatcgtgggcagtcttggaatacagaaatacacggccatcacggataggacgatcgtagccagtcgtttcaccattttcatccgtttcaaatgttacgccatccgccgttgttaccgtgccgccaacagtaaaataatttgcaccggcaatatacagcgtgctgtctttcttcatatcaaacgcgccgctgatttcattaccagaaccagtgaggttcagtttagcaccttcacccatgttcacgttttcattcaatactctgtcatgcttatcaagaagagtctcttccgaactatattgctgcaaagtactgccatttgtaatgttaacgtgctggaagcctctcaactgtgtgagcggaacattgccactgatatgaaccgttgcattaggatgtcgttgggcaataccataggaagtatcgctgttataaatatattcggcgttactttcggtagagcctcctccattaacaaaaatctcaaccttgttagcggtaccagcgccgtcaccggtggcgtgaatatagttacacttgcattcattcagcgtcagcgttgcgttgcccagaaccatgtctccgccagcttggtttttattctgcccactgacaaagataccgcgatgcatataggctccgtttgaatccgcgccgatgctgtttgtcagcgttatattaacatcgccggtgaccagaggcaatgcggctgtgataccgcagccaccgccatagagatactgtaccgtagaatggtccacagtaatctcaacgttgcctttgacctgaatgtctctgttgttccctccccaggcaacatatccgccgccaaaaatacgatggaattggctttcaaagcggcaattatcaatgtcaatcttgactggccccgtcgtgcccgtaatcttctctgcgttcgacttgcccgcgtcgtagcatccgccgacaatacagtccaccaaattgccggtgattccattcagagtaatatgtacctcaccgccaacgttggtcgtcgcggttttaatatcagaattggtgccgatcatgctcggatcattgctcaaaatgtggccgccgcccgcaacagcaatcttatctggttgagaggaagatacctcggtatcgccggcccacgcgccaccgctgatggtaatgttggtgtttttgccaacatttgcggccccttcatcctcatccaccaggccgccgccgacaacggagtacacatgaacgccttcgcctttcagttcgacgttggtgttgccggatacgtcgctgcatcggccgccgccatagacatatacgatggatttttcgtttttaagttgcatctccaaaatcagatgcgtgtcgccggtaacatcgttctcccggttgccgccaccgaaaatgtataccgaggacttcaccatattggagctggaactattgggggagcttttccattctggtgtatcgatcacagaggactctgtcaggtgaagcgtatggccgtttgcaaaaataaaagtaggaagcgacgctccgccattcgcttgtgcgtattgctgcttggagaatgccagggtcaaattttcaactgtgagatctccctgtaacgaaagccaaacattttctttgccataatacccggcaaattttaatacagcgttctcgttcgcgccgcagatcgtaatatctttctccggcgtcgtccagttctccatttctaccgtgccgacaacgacgaacacattgccatctttggcattggccattgcttcatcaaatttcaacgcgctttgggcagattggccatcgccgtctgcaacaccatcctgcgacacatagatcgcccctgtgggaatatccggcgcaggcccctcctccgccgcaactgccacagtcggcaccatcgtcagcagcatgcaaaacaatagcaataccgataaacctctctttttcattgcttcctcctccatttttgcagctgtcaaaacgtgtaccttttgacagtgttgacaatctggcgaaatgacatgattgtttaatcaaaaatgataatttttcaggagaaaactcttgcattttctgccattttgttataaaatcatcccaacaaaaacagctatcaaaaggtacaccttttgatagctgttctatctttctgacacctttccccttcggacacgcaccccactcccttaggattcctctccctgcaccaaggcccgccgccagaccccagtccgttcatagaggtaccccaggggcaccgaggaggccggcgcgatggcgcaggcccagaaaattcccaccaggccatagaaatggttcaaaatcagggccaggatcacccggaccacaatgcagttgagcaggctggaccccaaggcaaacatggtatgccccgcccccatgggcagggcgttgtacaccataaagctggcatagaaaatctgccctaaaatctcaatgcggagattcctcacggcaatctccatggtcccctggtcggggtgaaacaccgacagaatctgcggggccaggagttcaatccccagaatgagcaccgccgtaaccgccagggacaggcgcatggccacatggaccacccggctggcccggtcaaacttttttgcacccagacactgggccaccatggtggtggccgcagtatagagggcgatggttaccagcagagccacgtcctttaccttggcgcagatcccgctggccgcggaggcctccaccccgtaggcgttgataagaaaggtcatcgccagccaggacagccccaccaccgtcatctgcaccgcgcagggaatccccagcttgagaatctggaccatcttatccttgtggaaagaaatctgccgccgaaccaggccaaacaagtcccggtgacgcagcacatacaccaggcagaccacaaagctggcccactgggcaagcaccgtggccagggccgcgccccgcacgccccatcggaagccccccataaacagacagtccagcgcaatgttgcagcccgctgtcacggccacacagtaaaagggctgcttggagttgcccacagagcggagcatggccgccaaggcattgtatccgaagatggcaatgagaccggcggaacacacctggagataggccgtagcctcctccagcgccggcgcccggagggccgccagaatgggacggctaagcaggaagagcagcacggacagaagcgcccccgcagacagggcgaaaccgaacatcgtccgattcgtcttgacccggttggaccggtccttgctgccaaaatactgccccatgagaatgttgcccccggtggtaattcccatgataatttgggttaaaatcatcataacctgactggcgttgttgatggcggaaatgccatccttgccaataaaccatccggccacaatcaagtccgttatggagtaggccgactgcagcagggaagagagcaccaccggcccggcgtaaaggatcaattttttccagatgacgccctccgtcaagtccatttgatgcataatccttcccccctgcttccacatttctcagggcaaaccccaacctcttctgtatcataacacagtttttctctttttcaaagaaaaacccccgttcccgcccaaagattggacagcttcttaattgcttcttaatcttatctgtgctatgataatacaatctttatgcgacaactttctcatttcagcgggttccctcccgcttttggaaaggcggatctgctttgaacattcttatcgtcggggcgggcaaggtgggctccactttggccgcctatctctcccgggaagaccacaacgtgaccatcatcgaccaaaacgacaccgccatccaccgggccagcgacaccctggatgtgatgtgtatcaagggccctggcgccgctccctccgtgctgcgggaggccggggtggaggatgccgatctggtcctggccaccaccaacctggatgaggtcaacatgctctgcgccctcaccgccaagcgtctgggcgccaagttcaccatcgcccgcattcgggacctggcctacaccgacgacctgcccgccctgcagaaggacctgaacatcgacgcggtcatcaaccctgaatatgccaccgccctggagatttcccggctgctccgcttcccagccgcagccaacgtggacaccttcttccggggaaaggtggagatgctgggcattcgtgtgcaggagggagaccctatggtggggattcctctgtccgaccttttccgtcgggccagcagtctgtcgatcctcttctccgccgcagagcggaagggagaggtgatcatccccaacggagactttgtaccccgggtgggggacaagctgtatgtcaccggctcccccaaggacctctcttcctacctgcgcaccctgggccgggacctgccgggaatccactccgcctttctcatcggcggcagccgcatcgcccattacctgtccaagatgctcctctccatgggggtgcgggtaaccttggtggagagcaacgaggcacactgccgccggctctcagagtccctcccagaggctctcattctccacggggacggtaccgaccaggagctcttgctctcagagcacttcaccaacaacgacgctttcatcgctctgaccgggcgggatgaggacaacctgatctccgccctctacgcccagcagcagggactgcgcaaggtggtggccaagtgcaaccgggtcaactactcctccgtggtccaggccgccggtctggactgcgtggtggcccccaagctcatcaccgtggcccggattctccggctggttcggggctttgaggataagagcggcagcgtcatgacggccctgtaccgcatctccgacaccgatgtggaggccgctgagttcatcctccacgaaaatacccctcatctgggcattcccctgaaggacctggaaattcgaaagggctttctgatcgtcgccctgctccacgaaaatcaagtggttgtcccctccggcggcacggtgctctcccctggggatcgggtaatcgtcatttcccatggccagggcatccagaccttccgggatatcttcttaaaaccatagcagtccccgtcccttccactttctcggagtcgttccgcccctcccctgcggtcaaagggcggcccctccccgctctgtctgtgacatagattatgaattacaaactgatgctgcgcacgttaggacgtactttgcagctggaagctctgtgcctgctgcttccgctggtggtctgcctgatttaccgggaggaccccaagccttttttgtataccattggattggttggcctgctgggcagcctgctggttcgccttcgggcccggccggatttcttctcccgggagggcttcgccgtggtggggctcatctgggtttttctcagcttgttcggcgcccttcccttctggttctctggagaattcgcctcttttgccgactgtttctttgaaattgtctctggtttcaccaccaccggcgcctcgattctcactgaggtggagtccctcccccgcggcattctgttttggcgctccttctcctcctggattgggggaatgggggtattgatcttcaccctggctttcctgcccaaggtggggggccggacccaggtgctggtccaggcggaggccacaggcccggtgagcaacaagctggtgcccaagaccgccctgtccgcccgtatcctctatctgatctacatctccctcacccttttggaaattctcgccctctgcttggccggcatgcccttctacgacgctgtggtcaacaccttcgccaccgtctgcaccggcggcttctctgtgcggaatctgagcatcgcctcctatggcctgcccgcctgtgaggtcatcatcacagtcttcatgctcctatgttccctgaattttgccgttttttttctggtcctcaccgggcggctgcgccaggcgctgggcagtgatgagctccggttcttccttctcgccgtggcgctgtcctcggccattgtctttttcaacgtccttcccctgtatgaatccgccggccatgccctgcgggacaccctatttcaggtgtcctcagtggtctccaccacaggcttttccacggcggacttcgccctctggcccaccgtctcccagtttgtcctggtgctgctgatgttcctgggcggatgcgccggcagcaccgccggcggtctcaaagcctcccgggtgctgttgttgctccgctgcgcccgccgctccctccgccggctctcccatccccgggcggtgaaggtggtcaagctggacggcaaggcggtggatgaggagaccctgaacaccgtctttgtcttcttcacctgcttcttcctggtcctgggcgggacctgtttggtggtgagcctggacggcttttccctgaccacctcctgctctgccgccctggcctgcatcagcaacaccggccccggtctggaggcggtggggcccttgggcaattttgccgccttttcttccctgagcaaagtggtgctctccatggccatgctggtgggacgtctggagatcttccccatcttgattcttttccagccctctacctggggccggaattgaggggaaaaagagcccggaattccctctttgtaactctgccctttttcgccaattcctccctctcttttttgtggtttttgtgaaatttatttgaattcacaaaaaaaagagggagagacttgcaaatcctttcggttatgctaaaattggtgtgttattcgtttccgcattgtctttcccaggcaatgtgcaaaaagaaaaggagtgtcgttcgtggaaaattatctgtggatcggcttcatcggcgctgttctggcgctgctgtttgccgcaatccaacgcaagaaagtcatgtcctactcagagggcaatgccacgatgcagaagatcgcgcagtccatccgcgagggtgccaacgcctatctgaagcatcagtactccaccgtcgcaaaggtctttgctgtggtctttgtggttctggtgatcatcgcctttgccagcggcggcgagatgctgtccaaattcacccccttcgcgttcctcaccggcgggatctggtccatgctggccggcctgatcggcatgaagatcgccaccaattccaacgcccgtaccgcccaggccgcatcggagagcctgaaccgcggtctgcgggtggctttctcctccggcgcggttatgggcttcaccgtggtgggcctgggcatgctggacatcagcatctggctgatgattctccacttcggcgccggcatcaccgatcctgtccagctgggcaacatcatcgtgatgaacggcatcggcgcctccttcatggctctgtttgcccgtgtgggcggcggcatctacaccaaggccgctgacgtgggcgctgacctggtgggcaaggtggaggccggcatccccgaggatgacccccgcaaccccgccaccatcgccgacaacgtgggcgacaacgtgggcgacgtggccggcatgggcgccgacctgtatgagtcctacgtgggttccatcctggccaccttcgcgctgggtgcctgcgccggctacggctggcagggcatgctgctgcccatggcgctggccgtgtgcggcatcatctgctccatcatcggctccttcctggtcaagaccaaggaggacgccacccagaagagcctgctgacctccctgcggaccggtacctacaccgccgccatcctctccgccatcgtggccgcccccctgtgctacttcattctcggcccggagaacaactgctggggcatcttcattgccatcctctgcggtttgatcggcggtactctcatcggctacttcaccgagtattttacctctgataactataagcccaccaaaaagctggccgccgcttccgagaccggcgccgctaccatcatcatcggcggcatttccctgggcctgatgtccaccatcgcctccatcctgatcgtggcggtggccatcctgatctcctacttcgccgcaggcggcaccacctccatcctggatgagatgggcggcttcagcctctctttcaaccagggcctgtacggcatcggcatcgccggcgtgggcatgctctccaccctgggcatcaccctggccaccgacgcctacggccccgtggcggacaacgctggcggcattgccgagatgtccggcctgcccgaagaagttcgtgaccgtaccgacgccctggactccctgggcaacaccaccgctgccaccggcaagggctttgccatcggctccgcttccctgaccgcgctggctctgctggtctcctatgtcaacattgtacaggaccgtaccgtggagaacctgaacttcaccctgaccagccccactgtgctggttggcctgttcatcggcgccatgctgacctttgtcttctccgccatgaccatgcgctctgtgcagaccgcagcccagtccatcgtggtagaggttcgccgccagttccgggagatcgccggtatcatggaaggcaagaccgaccccgagtacggcaagtgcgtggcgctgtgcaccaagggtgccctgcatgagatggtggcccccgctctgctggccatcattgttcccatcatcaccggcctgatcctgggccccaccggcgtggtgggcctgctgggcggcgtctccgtcactggctttgccatggctgtgtttatgtccaacgccggcggcgcttgggacaacgccaagaagtacattgaacggggcaaccacggcggcaagggttccgagcagcacaaggcagccgtggtaggcgacaccgtgggcgatcctttcaaggatacctccggtccctccctgaacatcctgattaagctgtgctccaccgtctccattgtgttctccggtttggtgctggcattccatcttctgtaacagaaagcttaacatgagtaaaaaacggaccgtcctttttggacggtccgttttttactccatacgggtggcaaaatcagccgacatccctcagccggcgcaccaggataaacggggtcatctgttcctcttgtcccgccggattgtcgcggatcacctccgtgagccaagtctccggcgcggtgatgcccgatgactttcccatcagctccacgcccaggccgttggcatcgacgatatagctctgcacccccgttttttcatagacctggtcacacagcaggtccggctccgtgggaatgcggatgcccaaatccgcataggcggggatgtcctccccatagaacccatccagtccccggacctccggccccagcagacggtaaaaggtcccatgaatccctcggagcttgtccaaccccgcccgcaaggccgcccacaaaacccgggcccgtccctcctggtccagggcaaactgcatcttgaccggcagtcccatgcccgggccggcaggcgtctggcggacacacttggccagcaggcgggccagccaggtcacttgaatctcctgccggtggatcacccgtccctggcacagggcggccaccttttcactcaccgccacccagtcccctggccggtagaccggcaccacatagcggcgaaagaggtccagatagtcctcccccacctccacaaagtgcgtccgaatgccatgacggaggtaccgttcccccgccacctcaatttccagcgccttaccgggattgtgatagtattccatgtaacattcctcctgggattgattgcttcccaggataccccgcctcctcatcgggacgtcaccggagtttcctccaaacgcaatccagaatcttatgtttttctttcctttcttaaaactttcttgcttttttccggcttttccttttacaaacttgacggcctggggtataatgaattaccatccgatatcttatgaaaggagggagccgatgagacgaacctgcctgctctttttgggtggcctctttctgctgttgtccgcctgcgcccccaaccccagcgacggaacagaagacagccggacccaaatcgtcgccaccacctaccctgtgtatctcttcgcctgcgaggtgacccgcggcgttccggactgcaccgtcaccctgatgatcgaccagcccatcggctgcctgcatgactacaccctcaccgtaaaagatatgaaggccctggaacgggccgacatcatcgtgtgcaacggcgccggcctggaggagtccatggaaagcgccttggagactgtgggcgatacgccccagattgactgcgcccagggcatccctctgctggagggggaggacgcaggacaccatcacgaagggggaatcctccctgccggccatgagcatgaggcggacgcccacatttggatggaccctctgcgggcctgctccatgttggagaatttggccggcggcctgtcccagctggacccggaccacgcggctctgtatgccaccaacgcgcggctggcaagggaacagctcacccaggcctatgacctgatgaagacctccctggaatccctctcctgtcgggaacttatcaccttccacgacggattttcctatttcgccgacgccttcgacctgaccatcctccgcgccatggaggaggaagccggcagcgaggcctccgcccgtgaggtggcggacatcgtggcggagatccgccttcaccagcttcccgccatctttaccgaggtcaacggggccgatgccaccgcgcagatgattcaccgggaatgtggtgttcccatattctccctggatctgatgatgagcgaccacgggcaggaccccggcatcgccgcctatctggcgatgctgcaaaccaatgtcaacacccttcgggaggcgtacgcatgagattttccaaacagaaccacagccgcatccccatgcccggcaaaccggggacctgccggctccaggtccgcgacctgggcgtgaccctggagggggagagcatcctgcgggatatcaccttccagctcaactgccgggaaatcatggccctgatcggccccaatggcgccgggaagtcctccctgttccgcagcatcctgggccagattccctactccggttcgatccagtttcagctggccgggggatatccctcccaccccaaaatcggctacgtcccccagagccccagtttcgaccggggctatcccatcagtgtcctggatttcttcgccgccgccatcagccgctggccggttttcctgcctgtccccggccatctgcgggacaaggtaaccgagtgcctggcccgggtccacggtgaggcgctgattcaaaagcgcatcggcaccctctccggcggggagctccagcgggtgctgctggccctggcgctggagcccattccgcagattctcattttggacgagcctctgtccggggtcgatgtggggggagagcatctgctgctggatatgctggacgagatccggcagaaatatgatctctccatcctcttctccacccacgatttctccaccctgcgccattatgctgacaaggtcatcctccttcagcaggccattttgaaggtgggaacccctggagaggtcctccactccccggaatttcaggcggtcttccacttgaacctgggagaggaaggggggtgtgcccagtgaatttctggtattggctcctctcctggctcccctttgaatgggccgccccggacaccatgctctttatgaaaaatgccctgctggcagtcctggtggtcacacctctgttcggtctgctgtccaccatggtggtggagagccgtatggctttcttttccgacgctctggggcactccgccttcaccggcatggccattggggctctctgcggcctggcacagccggtgggcgcggcggtcctcttctccgtggtcatcgccctgctctttaccctggtccggcagaaaacccacatggccagcgacacagccatcagtgtcttctcctccgctgccgtggccctgggcatttttttgagcaccttgggcggccagagctttaccaaattcaacaaccttctcatcggcgacattctcagtgtggcccccggggaaatcggcctgctggctctgattctgctgggcctgctggtgctgtggatcacttcctttaaccagatgatgctctcttccgttcaccaggccctggctgacagccggggcatccgggtggtctggaaaaacttcctctttaccgccgccatcgccgtggtggtgaccatcaccatgacctgggtgggcctgctggtcatcaacgccctgctggtgctccccggcgccgccgcccggaacgtggctcggaacctgcctcagtaccacctggtctccgtcctgggcggggtggtatgcggcatcggcgggctgatagtctcctactacctgggcacctccaccggcgcctccatcacccttctgctggctctgtggttcttcctaaccctcctgctgaagcggacccgctgaccattcttacgaaaagaacagctcggactatgtccgagctgttcttttcttgacatacctcgaaacacaaggtacgctgtttttagatagaaacggtcgttctttttcaaaggaggtgttcccatggacacgcccttccgtacctacacccaacaagtcacctcccaccttcgtcatgtcacaccccaggaaaaagcagccctgcaagaggaattggaagcgcatctggaggaccacaccgaggcccccgcctccttctgtgccattgtcttttgactgaccatccctggaacggaggttttctcatggaacataaacaatcgctggagcactcatctttgccgcttctttccctgctccgggaccaggaccgatatggctatgaaatgatctcagagctggagcgccggtcggatcatacctttcaaatgaaggaaggcaccttataccccgtgctgaaaaagctggaagccggcggctgcgtcacgtcctacccggcggaagccaatggccgcacccggaaatattaccgcatcacccaacggggccttgtccagctggcccaggaaaccgccgcctgggagcgatacgcccacggcatccactcggttttagggaccacaccgggatagttccccctttccccaagcaaaaacaataacgcccccagccaggccggctgggggcgttgcgcgtttcttgtccgattattcctcgtcctctgcttccgcctcgtccaccaaatccatggagaacttgtcgccgcagttggggcaagtgacctcaccaatgtccaggatgctctcgtcgatgacaatgtcctcgccgcagctggggcactcgatttcaaagaaatcgtcgtcgtccagagaggagcagcagcaaccgccgccgcaggcgtcctcgtcgtcctcatcctcccaatcctcaaagaccatggtctccacatcggacaggtcctccgccacggattccacctcgtcggtgagggcttccacctcaacctccaggtcctccaccgcgaaccccacgtcctccaggatatcaatgatcttggcaatgagctttccctccttggagggcttttcctgcaggtccaggccatcggccagtcccttcagatacgcaaccttttccgaaatcgtcatcgttgcaccatcctttcccatgccgggactcagcccttggcacgctccagatactcgcctgtgcgggtgtcaatcttaatcttgtcgccggggttgatgaacagaggcaccttgatctccgcgccggtctccaccgtggcgggcttggtcacgttggtggcggtgtcccccttgaacccggggtcggtctcggtgacctccagctccacaaaggtggggggctccaccgcgaagaccttgcccttgtagctgttgaccttgcagggcatgttctccttgacaaaccggaagttgtcccccagcagctctgcggcaatggggatcatgtcataggtctcctggtccataaagtagtacaggtcgccgtcgttgtagctgtactccatgtccttcttctccacatacgcattctcaaacttggccgtggggttaaaggaggtctcggtcacagcgccggtgatgacattcttcatcttggtgcgcacgaaagcagcgccctttccgggctttacgtgctggaattccacgacctgcataacctggccgtccatctcaaaggtaacgccattccgaaattcgccggcagaaatcatagttcttcatcctccaaacaaaattgccgtatcggcgtcccgccgacggctgacatcctcggcaggccccctttgggagacccgccggcaaagcggcaaaccgcgccgcttttattccataagcgttctctattttacaatacctttctgatttttgcaagggaatttcccctccccaggggctttcctggggattttctttcgatttctcccttctcagccctccgccgtctcccccaaggcccggagataggcccccttcatccataaggcgtccacatcctgggtcccggcgctctcacagatcactctgggggaccagcccctgcgggccagcgcctcacagaggggcgccgggtccggaccaaaatcaggctggtcaaaggttaagtgccgggcctctcccccccggggcgtataggcaatcttggaaaaatggctgtgaaactggctggcccgggccacccccagttcccggaccatctggtccagcatacgctccaccgcctccgggccgtccaacgcccccagggagcgggcatacaggtggccaaagtccacgcagggcagcaggccctccgcctccgtgcagagggtcagaacctcttccaggtcccccagctgattgatctttcccatggtctccgggcacaagaggatatcctgatacccctcctcgtcacaccggtgccgcagcgttcggaagcactgccgcgcggtggccaaggccgcctggcgggtccgtttctggatcgccccggtatggaccaccacccggtccgcccccatccaccgggccacccggcaggcggccaggacataccctgcggtcttggcctggctgtccggttcgggattggccgggttgacaaagtagggtgcgtggagggagagggcaatccccgcctgagcagcggcctgcccaatggcccgggcagtggcctcccccaccgtgaccccttttccgcactggtactcataggcgtccagtccccgctcccgcagccagccgggcatctgcttggactgtttctttcccgcggcataaaacccctccgggttgccggcggtgccaaaccgcgccctcacagccccgacccctttccggctccggcgcggaagggggtctccaaaccgtaacgcaggcctcgaaacacggtgccaaactggatggggtggaccagcagcgtcagcacaccggcccggttgcccccccagatatccgtaaaaatctggtcccccacaatggctgtctcctccggcgcggcccccatccgggccatcgcccgctgaaagccccccaccttgggcttgcccgcatggccctcgtagggaatacccagagcctccgcgaatcgctgggcccggccgggcttgcggctgttggagagcagaaacagggtgatccccgcctggtccagcgcctgcttccaggcccgcaccggctgggtgggggtgtggactccatagggcaccagggtgttgtccaaatcggccagcaggaggcgaactccccgggcccgcagccgggccaaatcaatggcgtggatgctttcaaaataaaaatcagggaccaacggaaatttcacggcatcaccttctaaacaatctcttgtccgcatacttttggagcagacgtttggtgggggaaccatctgttccctgattatacacgaaccgaaaccaatggacaagggggttcctttttatgatgtatccttccccgcggcaattcctgctcacgccgccccaatccttggaccaggcccaaacttggggtcttcctctggcccacatggcctatcaactggatgagactggtcaactttgccaggcccctctcccgccccatggcaagggtggtttgatgttggtgggggtacccacctctcctgctggacaatgtgatccccgccgggcagtccgggacattcttaccgtctgccaggggcgcggcttcggcggcgtcattctggacctggagcagccgcccacccggttcctctcccagctcatctgcggcctggaggaggggctgacccagcggaaacggacccttttcctgcctgagtcctatggaaattacagcgaccgggcgtccatctatctgacctccgccatctccggaggttctttgcggcggcggttggaggaggccatcgacacctacggcccccaccggctggttctctgcctccggcgggcccgggacgatttctttctcccctccgtcaaggggcagggccggcccatctcccaggaaaccttagagcggctgcagcgccgcctgaacccctcggtgttcttctccccggacctctgcgcccactacttcacctacatgagccgggagaccggggcccacttcatcctctttgacgacggggaaagtctggagaaaaaacggacattggcccaggaactgggcatctcccggtttttcctgctctatccagagatcgcggaattcctgcccaggctggtccgccaggaggcttgagcatacgcaggctgtctggagccgacgcaggttttccccggggcgtacgccatgaaaaaaccctgtccgggcacaaccggacagggttttcaagctattaataatactttttacgattcttccgcgctgcttcggacttcttgcggcgcttcacgctggggctttcgtagtgctctcttttccgcacctcagccaggacgccagacttggcgcagctgcgcttaaaccgtttcagagcgctttccagagattcattctctctcacatggacttcagacattcgttttccctccctccgaagtggtggactgtatcttccacgcaccaaagggccatcgtaaaatatggctttaacagtggtattatatgcaatttacagaagattgtcaaggtgtattcctaagaattttatcatttcccgcgcataccaaggaaataccccttccatattcgccgccttagaggcgacccctcgtcatgccttgggcttcaggatcagattcaccagcttattggggacatggatgaccttaacgagctccttcccctccatcagcttggcaatcttggcctcggcggtgaccgccgccaaaacggcatcctggtcgctgtccgtggccacggtgacggtggtcttcagcttgccgcccacctgcaccgcaatggtgacctccgaggccaccgttttgctctcatcataggccggccaagcagaggtgctggccatgccctcccagccaaaccgctcccacagctcatcggccatgtggggggcaaagggcgagaggagctggagcatggtgcggaactccgcctggttgacccctttatcatagaactgattggtgagggtcatcagcgcggcaatggccgtgttgaacttcatgttctcaatgtcatccgagaccttcttaatggtcttgtgcaggagggcctcgttttccttgccgtaggcttcggccggcgtaacctgctcggccagattccagatgcggtccaggaaccgtttgcagccctttaccgcgttgtcagaccaagcggccgccttctcaaagtccccgatgaacatgatatacatccgcatggtgtccgcgccgtactgggcaaccacgtcgttggggttgaccacgttcccccgggacttggacatcttctcgccgccctcgcccaggatcatcccatggctggtccgcttgtgatagggctccgcatagggaaccacgcccaggtcatagaggaacttatgccagaaccgggagtagaggagatggagggtggtgtgctccattccgccgttgtaccagtccacctggccccagtagcgcagcgcctcctgggaggccaaggccttgtcattgtgggggtccatgtaccgcaggaagtaccaggaagacccagcccactggggcatggtgtcggtctcccgctgggccgggccgccgcagcaggggcaggtggtgttcacccagtcggtcatggtcgccaggggggactccccgttgtcggtgggctcatagctgctcacctcgggcagcagcagggggagctgctcctccggcagaggaacccagccgcacttgtcgcagtggaccaggggaatgggctccccccaataccgctggcgggaaaagacccagtcccggagcttatagttgaccttctcatggccaattcccttctcctccagccacttcttcatcactggaatggcttccttcaccgtcaggccgttgaggaagtcggagttcaccatgatcccggtgtcgtccttcagggtaaaggccgccttctcgatgtccccgccctggaccacttcaatgatctcacagccaaacttcttggcaaattcccagtcccggtcgtcgtgggccggcaccgccatgatcgccccggtgccgtaggacaccagaacatagtccgagatgaaaatcgggatcttctttccgttgacggggttgatccccgcaacgccctccagcttcaccccggtcttttccttggccagctcggtccgctcaaagtcagacttccgggccgcggcctccacataggcggtgacctggtcccagttgccgatggcgttcttccaccgggcaatgtaggggtgctccggcgagagcaccatgtaggtggcgccaaagagggtgtcggggcgggtggtatagatgaccaggtcatccccctgggtggtggggaaggtcacctccgcgccggtggagcggccaatccagtttttctgctgaatcttcacccgctcgatgaagtccacctggtccaggtcgtcaatcaggcgctgggcatactcggtgatcttcagcatccactggctcttctccttccggatgacctcggagccgcagcgttcacagacgccgttgaccacctcctcgttggccagcacgcacttacaggaggtgcaccagttgacgggcatggaggtcttgtatgccaggcccttcttgaacagctggaggaaaatccactgggtccatttgtaatacttggggtcggtggtgtccaccacccggtcccagtcaaaggagtagcccagcatcttcagctgcttggtaaagttggcgatgttgtcgtgggtcaccttggcggggtgaatgtggttcttgatggcatagttctccgtgggcaggccgaaggcgtcatagcccatggggaagagcacattgtagccgtccatccgccgcttccgggccaccacgtccatggcggtatagggccgggcgtggcccacatggagtccctggccggagggataggggaactccaccagggcgtaaaatttgggcttgtccccgccggtctcggcatggtaacagttctccttggcccagcggtcctgccatttgcgctcaatgcggttaaactcgtacttcaatctgatcacactttcctgtttttataatcgagtcgatttcaaattgtcacgtgacagccagccggggggcttccccggccgggggattcactctccgggctggagcacctggctcaggtccaccaccttggcgtcctcccacaggcggtccaggtcataaaaggcccgggcctccttgtcaaacaggtggaccaccacgtcgccgtagtcctgcagaatccaggttcctccccggtgcccctccacgtgatgggggaggatgcccgcctccttcatggctctctcccctgcgtcggccagcgccttgagctggggggctgaggtgcccgtacacaggacgaagtagtctgccagagtggttacgctgtcggtctccagcacccggatgtccttgcccttcttgctgtccagtgcctgggccagcagcagggccatctcttttggtgtcataggctcttcctttctcatcgctgggcccgccctggcgggcggaggtcccagcggtttagtctgtggtctgtccttgggcggcatcccccgcagcctgcccggtctgggctgtggtgtcactctccacaggcagattgttcaccgtggtgtcctgaaccacatgctgcatgtccggggtgatgtcctccagataggggttcatatattggttgatcaggtcccgcagggcactggagttgacgaagacataggactggtaattctgataggtggggctccacatggtgcccgtatagtctcctggcaggttgtggaagcggatgctcccctccttcagtcccagggcccgttccccgaaccagatcatctctccatagtccaggttgctctccaggtttcggtccacaatgtccacgatctcgccgatcttggtcagggtccccaggctcaccatctccttggccagcgcccggaggaaggagtgctggacttcaacccggcccacatcccccacggagaggctctccccgctgttgtttttccgccagcgcaggacctttaccgcgtcctctccgttcaggtgctgcattccttttttgtaatgaatgtgcaggtcctgggtggggtcatcgtagtccatgttatagggcacctcataatccacgccgccgatggcatccaccagctccgccaccgcgtccagctccaccacgaaatagtagtccggggtatagccgatgaggtttttaatctgcttctggaccccctcaatgccctgtcggttgtacaccgagttgatcttgggaatctcccccggcacatccaccatggtatcccggtagatgctcagcacgtccaccgtgccgtttttcacgtcgtaacagcccaccatcatggtgtccgtgttgccgccgccgccttggccatcatcccggcccaccagaaggaaggtatacacgtcttcccgccggccaacccccaggctgccgggatcggtccccgcctcctggttctcatgggtggggatatccggcggccggacatagatctggtggatcacaaacccaatggccagcagcgccagcaaaaccagcagcaccgtcaccaaaatcttccgccgccgcctttttcgggggggcggaccgccggcccctctggggggaggtccgccgcggccgccggttcctccggcaggagggggggactttcgctttcgctggggcgccttctgtccccccggccgcagttccgggagcggctgccactcgtcagaggcaggttccctgtcctgggggggcggggccggccggctggggcgccggggcgggtcaaccgggggctctgaccggcggtctccccggcttttgggccagggatcatcccagagctcctcctgaatctgccgccgctccgccgcccagtcgtcgcccttctgggccgcccggcggtcctggtcatacagccggtcccgggggtcctcccaaaaagctgcccggtaatcctcgggcatggcatcctgttcctgatagatgcgggaatagaccccccgctgggcctcgcggtaggcctgctcctgcttgcgcaggcgggagcgttcttccttctctctctgtctcatctcttcctcggaaaaggatcgattgttcaccgcagcttcctcctcaggtcatccagggtcccctgggtgttctgatggaccaccgcacctcgttcccgcagctcttccacggtcatctccagccccaaaatcatagcctggtccaagtcctcccaaaccagacggcgcagctcctccaccccgtcaaaggcccggctgggctccatataatcggccagatacagcactttgtccagcttggtcatccccggtttgcccgtggtgtggcagaaaatggcgtcgtagacatcatcaggctccccaaacacatacttggccagggcagctccggtcttggcgtggaggaacttgaccgaaacccgctccaattcatccagcgcaatcccatacttgtcacaggccgccacctgagtctccaggtcccaatacttggtgcagtcgtgaaggatcgccgcccggcgggccttttccgggtccacaccccagaacttggccagagccaccgccgtttcctccgtccccttgatgtggggcaaacgtttggccttgaccatggagtaggagatggcccgaaggtgcttgtcgctgaggtgccgcaaatccgcctgggtgccgaagagcttttcccgcagaatatatccatagaccggcgtccatagatactgggcggggtccacgttgcccccggtccactcagaggccagcatacgccgcaggtcccgggaggcgatctccgtcaccttgggcaggttcaccaccgtggtccgggcgtgaaaggtctctgctaagtactgactctgctcctcaaagagcgcctgggtatcttcctcactgcgggagaaggccgccacgccggcatactggaaaatccgctcaggctgataccagttttgcacggtgaggaacatgtccgttcccatgagcagccacagctcatcctctggaaaggtctcatggagggcctccaccgtgtcggcggtgtagctctttccctcccggcggatctccaggtccgagacctccgcccgggggcccaggccatcggccatgagggcggccatctccagcctctgctggggcgtggccgcctcctcggccaggtccttgtggggcggttcgcagtcgggaatgatgatcagccggtccaggttcatttgttccagggctgtccgggccgcctccatgtgtcccaaatggggcgggtcaaaggtcccgccatagattccaatcttcatgaagtgattccacctgctttcccattatgtttgggtcggtttcttccggtccttcaccaacacgatcttgtcttttttctctctgctatggctctctcgataaagtacaaatttggtcccaatgacctgcacgccttcgcttcgggtgcgtttggccagctcctggcaggcctcccgggcggtgagcatggcgctctccagcacccggcatttgatgagctcccgggcctccagggcctcattggcctgctgcaccagattgtctccaatgccgtcctttccgatctgcacaatcgtgtccagaccgttggccatgccccgcagctgggctctctgtttactggtcagttccattgtgtcgtttctcccattccgtctgaaatcccgccagggcacgggcccggtgcgagatttgatttttttcttccggggtcagctgggccatggtcttgcccagttggggcaggaaaaagatggggtcatagccaaagccccccgccccgctgggtccctcggccagaacgccggggcactctccccgggccagaatttcagacccatcgggaaaggcgcagcagatcacgctgacgaaccggcaggtccggtgggactggcccgccatattcctcagcagcagctgccaccggccggtgtcgtccaggccggggccgccgtaccgggcggaatagaccccaggcgccccgtccagggcatccaccataaggccggagtcatcggcgatggcgggcagccccgtggcctccatcaccgccttggctttgattcgggcatttgcctcaaaggtggtccccgtctcctccggctccaggtccacgcccacatcccgttgggagaggacttccacccccatctgggagaggatggcccgcatctccgttatctttttggcattgtgactggccagtacaaccttcatagggcgcctccttccagaaccgccgcctggatggccagaagctcccgaatccccttggcgcacaggtccaccagctgacgctgttcctggatggtaaaggcccggccctcgccggtgccctggagctccaccagatccccctcccgggtcatcacgcagttgaggtccaccatggcgccggagtcctcctcgtagcacaggtccagcagggggacatcgtccacgatgcccgcggacaccgccgcaacctgggtggtcagcggcatctcccggagcaccccctcctccatgagcttccggcacgccagggccagggccacgtatcccccggtcacagaggcggtccgggtgccgccgtccccctggagtacatcgcagtcgatggtgatggtccgctcccccagcttcctgctgtccaccgcggcccggagggcccggcccaccagccgctggatctccgccgaccggggcgccagcttgagcttggagatgtcccggcggctgcgctcccggttggcccgggggagcatggaatactctgcggtcacccagccctccccgtcgggcacatggggcggggtgcgctcctccacgctggcggtgcacagcacatgggtgttgccccagcgaatgaggcagctaccctcggcaaacttgttgatgtgaggaaggatctccacagggcgcaacgcatcctgcgcccttgcatccatacgagccatattggttgctcctttctatcctcgactccccgtctccggggaatccccaatgacttataccagggcctcggcgaaggccgccgggtcaaagggctggagatcgtcgatcccctcccccaggcccacgtacttcaccggtacgcccatctccttggcaatggccaaaaccacgccgcctttggccgtcccgtccagcttggtgagcacaatgccggtgatcccggcgctctggctgaactgcttggcctggatcaggccgttctgtcccgtggtggcgtccagaaccagcagaacctctttggagctgctctccccttcccggtcaatgacccggcggatcttgttcagttcgttcatcaggttctgcttgttgtgcagccgtccggcggtgtccaccagaaccacatccacccgtctggcccgggcggcgttcatggcgtcaaagaccacggcggcggggtcggacccctcctcgtgcttgacgatctccacctgggcccgctcggcccagacagacagctgctccgcggcggcggcccggaaggtatcccccgccgccagcaggacccggttcccatcggccttcaggcggttggccagcttgccgatggtggtggtcttgcccacgccgttgaccccgatcatcaggatcaccgccggcttgccggacaggtccaggccgggctctcccaccgccagcatttccaccaaaatctcccgcaggcaggcttttacctcctccggctctttgatcttccgctcctttacccgctcccgcagggtctccaccgcctccagggtggtctccatccccatatccgagaggatcagggactcctccagttcctcaaaaaagtcctcatccacggagaacaggccggagaaaatattgagcttcttaattttattaaacaatcccatggggatgcctccttgttcggtgtcttttaggccggggcgccgtccagcaatgcttccgcttgatgcaggtccagcttcagcacccggctgaccccctgccgctccatggtgacaccatagaggacatcggcggcctccatggtctcccggcggtgggtaatgagcagaaactgggtctctgaggccaccgcccgcaggtagcggataaaccgggcgccgttggcctcgtccagagccgcctcaatctcgtccaccacgcagaagggggtggggtgaatcttcaaaatggcaaagtacagggcgatggccaccagggaccgctctcctccagagagaaggctgatggcccgcagggtcttgcccgggggctgggccctgatctcaatgccgcagcggagcacgtccgtctcgtcctccagggacaaggtcccctgcccaccgccaaagaggtccgcgaaggtctgggaaaaggccgcctgaatccgggcaaactcccgacggaaaatggcctccatctcctgggtgatctcctggatcactccctccaattccctttgggcggtctccacgtcgtttttttggtccttgaggtagccataccgctcctccacccgctgaaattcctccaccgcccccaggtttacagtgcccagggcctgtatggcctggttcagctgaaccgtgcgccgctgggcctgggccgcgtcctccacagggacccggaccgccagcgccccctggtgggtcatgccataggtgtcccacagccggtccaggaggcgtttttcctccatgccggcctgcagctttctctgctccagcaccccggcctctcgctgcagccgcagctgcaggtcattctgggcccgggccgcccggtcattctccacccgggcccgctccagggccagcttttgaccggtgctctgctccagctggacagacagtgcccgccgggcagcctccagggtttccaccttggcctcccgctgggcaatctccttttccagcgcctgggtttgctggaccgtgtcccggagcagcccgtcctggcgggcctggtctgcctcagcggtccgcagctggtgccgcagctgggcaagcagcggagagaatgcccccatggtgccccgtaaagatgccagttcctctcccagggtccgaagggtctcctcctggtcgttctggctgcgaagcaatgtttccggcggcgtggggccggcactttggcgggcctccagggcctccgccgcccgctgggtttcc

SEQ ID NO: 2233 - DNA, 62606 bp, KLE1738
cctgttccgccatggcgtggaaaaggcacgactctacatgatgattttctttgtggtcttgctggccctggtggccgccttggccggcctggctggggcggcgctgccccagggcagcatcctcttccttttgggcgcaccggcagccctggtgttggccctgctgctctgcctggcctcggtgcctctgtccgtccggcagtatgtaaaacggctggggtaacccttccttccccgcctatgttggtaccagcggcacccccgatctcgccgtcggcagccatccatccaatgggaccgcagccgtccaactgcgggaaaattagtgcttgacaagccctctgttttggtgtaaattgaaaggcaacaatgaaacaccacaaaggcaaggaagagaagagtacatcctgtgcaaagcagcagagagccccggccggtgaaaaagggcgcggcgtgctggatggaagatggtctcggagccgcgcaccgaccgaaggagtttccccttcgttaggctgcgacgggagcgcccgtcatcgcgccgggggtgtgctggcaccctttaaggccggctccgtgaggggccgcgcgaaccaaggtggtaccacggctgcatcagtcgtccttgatgaacatcaaggacgacttttttgtttgctcccatgggagccatacacccaggatgccgcccagacagaaagagtacattcccgcgctcccggaggggaacgggacaaggtaaggggagagaattgtgagccaacccatcattcagattcagcatctgaacaaaaccttcgggaccggccccactgcggtccacgccctggaggacatcaacttagagattgaggcgggggagatcttcggcatcatcggcctgtccggggcgggaaagtccacgttagtccggtgcatgaacctgctggagcgccccaccaccgggtctgtcctggtggacggcaaggacctgaccaagctgcgggacaagcagctgcgccaggcccggcaggacatcagcatgattttccagagcttcaacctgctcatgcagcgcaccgccctggacaacatctgtttccccctggagctcatcggcaccaaacgggccgacgcggtgaagcgagcccgggaactgctggagctggtgggcctgggcaaccgggccgacgcctatcccgcccagctctccggcggccagaagcagcgggtggccatcgcccgggccctggccaccaaccccaaggtcctgctgtgcgacgaggccacctccgccctggaccccaccaccaccctgtccatcctggcgctgctgaaggagctcaatgagaccctgggcgtcacagtggtggtcatcacccaccagatgaatgtcattgaggaggtctgccaccgggtggccattctggaccacggcgtggtggcggaggagggcaccgtggcggagatcttctcccagcccaagacagacattggccgccagctggtctaccccaacggggtgcagatcgaccggctgcccccctcccgggtcatccgtgtggccttcaacggcggctcctcctacgagcccctcatcgcctccctagccattgactgcggggtgaaggtcaacattctgggggcagacacccggaacatcgagggcaaggccttcggcaccatgctcctgggcctgcccaaggagcccgaggaggccgccaaggcgctgcgctacatccagagccagccagacatcaccgtagaggaggtaaccggccatgcttgaatccctgtccgctttctgggccgagtacggcaccctgctgctggagggcacccgtgacaccttgattatggtgggcctttccaccgtttttgcctatctcatcggcctgcccttgggggttctcctgagtatcacccagccccatggcatttggccccacaaatggttcaaccgggtgctgggctggatcatcaacgtgggccgctccctcccctttatcattttgatgatcgccatcatggacttcaccaagctcattgtgggcaccaagatgggggtccccggggccattgtccccctggtggtctccgccgccccctttatcgcccgtatggtggagacctccctggccgaggtggacgccggtgtggtggaggccgcccaatccatgggggcctcccggctgcagatcgtctggaaagtctatctgcctgaggcagtcccctccctgatcctgggggcctccatctccatcatcaccatcttgggctacaccgccatcgccggcgcggtgggagccggcggtctgggcgacttggccatccgctacggctatcagcggcgggttccagagatgatgtgggtgaccgtgatcttcatcatcgtcttggtccagatcatccaatccctgttcagttggctgtccaccaagttggacaagcgtctgagataaattctttcattttattttaaggaggaacccatcccatgaagaagcttcttgcactggccatggcgctgaccctgtgcctgggcctggccgcctgcggcggcacccccgctgaggaccccgccgatgaaaacacccctcagactgagacatccggcgaaacggttaccctgagggttggcgccacccctgccccccaccaggagattctggagcaggtcgtggacaccctggccgcccagggcatcaccttggagattgtcccttacaccgactatctcacccccaacgttgctgtggaggaaggggaggatgacgctaacttcttccagcacatcacttacatggaaacctataacgcagaaaacaacacccacctggtgaacgccggctccatccactacgagcccatgggcatctacgccggcaaaaccacctctttggaagagatccccgacggggctgtcatcgccgtgcccaatgatgccaccaacgagggccgtgccctgctgctgctccaggacctgggcctcattgagctgaaggaggacgcgggcctggaagccacccccaacgacattacctccaatcccaagaacctggagttcaaggagctggaagccgccatgctgccccagaccattgaggaagtggacctgtccatcatcaactccaactatgccctccaggccggtctgaaccccaccaccgatgccctggcctccgaggaccccgagtccgatgccgcccaggcctacaccaacatcatcgcggtgaaggaaggcaacgagaacaacgaggcaatcaaggccctggtggccgccctccagtccgatgaggtccgggagttcatcgagagcaactacaacggctctgttctgcccatgttctaaggaggattttccacatttcccatcctcttccatatcgaaggaaaccaagagaggaggcgccaaaagcgcctcctctcttttgtccaattcgaccattgacagattattttattgctatacaatatagatttgctatgtaattgttatttttttgtggaaaaatgaggaaagtgaactatgcagaacaacaacccttccaacacgcccgcagaaaacaagatgggcgtccagcctgtggggcggctgctggccggcatggctgtccccatgatgatctccatgctggtccaggccctgtacaatgtggtagacagcattttcgtctcccggctcagtgagaacgccttgaccgcagtctccttggcctttcccctgcaaaacctgatgatcgccgtctgcgcgggcaccaccgtgggcatgaacgccctgctctcccggtccctgggcgcaaaagagcaggacaaagcggaccaggccgccaacaccggcatctttctggctctgtgctccttcgttctcttctgcgtcattggggtatttttctcccgcaccttcttccagctccagaccgacgtaacggagattgtatcctccggcaccatctacgcccaaatctgcctgggctgctccatcggcatcttctgccagttcacctttgagcggctgctgcaatccaccggccgcacccacctgtccatgtgtacccagcttctgggcgccctgaccaacatcatcctggaccccatccttatcttcggtcttttcggcgcccctcgcctgggtgtggccggcgccgcggtggccacggtcaccgggcagtgtgtggctgcggtggccgcgctcattatgaacctcaagtgcaacccggacattcacatcgtcccccgtaaaatccgctttcatggacccacggtaaaaaacatctaccgcatcggcttcccctccattgtcatgcagtgcattggctcggtgatggtcttcggggtcaaccgaatcctcatctccttcaccaccaccgccaccgctgtgtttggcgcctacttcaagctccagagctttatcttcatgccggtcttcggactgaacaacggcatggtgcccattgtcgcctacaactacggggccaagaagcccgaccgggtaaagaaaaccatcaaactggccattttctccgcggtggctattatggccgtgggcctggccgcctttgaactggcccctggggccctgctctccctcttcgacgcctcggaaaacatgctggccatcggcaccccggccctgcggatcatcgccctctccttcgtgctggcaggcttctgcatcatctccatgtcggtgtgccaggccatcggcaaccccatatacagcctggtggtctccgtctgccgtcagctggtggtcctgctcccggtggcgtggctgctgtcccagacgggcaaccttaccctggtctggctggccttccccatcgccgagctcatgtccctgaccctcagcgccatcttcctgcgcaaaacccttcgcatggccgagcgcgccatgacccagtccgcctcctaacccaccgcccctgtctttgaccgtaaagatgggggcggttttcttggccgtagctccggcagccgtctcccgtcgctctactgctggtttcccaccgcctcgacctctcgtcggttgccattttccccgccttctgctatgctatggacacacaaaacaaaggtggtgcctccatgaaggattcttccctcggcagctttctccagcagctgcgcaaagagaaccagttgacccaaaaagagctggccagtcagctgcatgtcaccgacaaggcggtgagcaagtgggagcgggacctgagcgccccggacatctccctcttgatcccactggcacagattttaggggtctctaccacagagctcctccagggccggcggatggccgatccaccccaagcggagactgaaagcagcgtggcggaagcactccgctactccgacagacaggtccggcaccgcttgcggcggctctgggcccacgccctgcttctcttctccgccctgtgtctgctggcagccggcatctgcctgctgtgtgatttctgtctttctggacgtctctcctggtccctgatcgttctgctctccttggcgctggcctgggttgtcaccgtccccctgttccaggcaaaggtccatcgggtgcgcgcctgctttctggccctctccctggcgctgattccctacctgttgggtctatggactctgcttccccttccactgcccttcaccctcgccacggcggcggtgtctctggctggtctctgggcggcgtacggcgtttgccgaaagctccgccaccgtccgtggcgggccgctggagccgttctcctgctcaccattcccgtaagtttcctcatcgactccctgtttcccgccctgctgtccccgcctgtccaggcctttcccaccccggaggcagggttctccgccctgaccaccctccttttggcgctggcctgccttggcattgactacgcccggacacatcataccccgcccgcataaaagaacaagcgccctgcctggcaaaccaggcagggcgctcgctccttcatggcacccccatgggcagcagatcaccccttgcacaccgtggagagctctcctgtctcggtgtcgatgacataccctccaatccggacatcccggggcatgagggggtggttgcggatggtgttcaccgtgtcggtcaccgactgttccacggtgtcaaagcccgccagccagcgttcaaagtcgatgccgcagtatttcatcaggtcaatggacgcctgggaaaccccccgctgcttcatgtgggcgatcatgctctcactgtcgatgtgctgcaccccgcagtctgtgtgtccgatgaccatgatttcctccacgcccagctcaatgatggccaccagcagggagcgaatcacactgccaaagggattggtcaccaccccgccggcgttcttgatgattttcacgtctccgttccgcaggcccagcgccgcggggaggagctccaccagccgggtatccatacaggtcaaaatggcaatcttcttgttgggatatttgctggcggcatactgttcataccgcttctcctccacaaattttcgattgtatgccagcagttcctcaatcatagcagccttctcctttcatcgcacaggggtgtactggatcaccgcctcctcttccgtggcctccagcttaaagatcacaggccgcaacccatcgttgcagctgcagatggccacaccaggccgtccaatccagtccccatagtaaaataagccctctcccgccccatgggccagggcaaaaacatactgatacatggctttccatgcctcgtcacacaggccctcgggcttggcatagtccccataaaagacctgccccgcccgcagcatgggacatggccccaggccgtccgcaccgtactccctagccagttcctcgtccagggtggtcttcagcacggtgatcttcactttcttcatctgcatcctccttcctggggcgcttccacagggacacttcctcccgcccactcccctgaaaaaagggacgccaatcatccctgactggcgcccggttccctgttgtacttctcttacttcagcaggaggtcctttttctccagaattgccgctgccgccgcgcaggccgggcagtcacaatacttggcgccagcggccttgatctcccgcccatgggccgccaccccgggcgccgcttccgcgccaaacacctggcgcccctcgtcggactcggcaaaggcgatcagctggtccacagtgaccagatcctcctccagctcctgtacatactttcgggtctcttccgcctcccggtcggttccaagggcagccagccaagcttgggccgcctctttggcctccccgctgcaggaaaaagcctccatcagccggtgggtttgctccaccacataatcccgtacggtttgatccatggtaatccgccttctttctttgaaaatgatacctattttaccacactcctcccaccgttgcaacgccagaaatcgtctgcttcctcttgattcggcacacgttctctgctacaataggggccatctttcccaacctggtgtgcaggattgctggcccgttccctttgccgaaccgcctgaaattttcctcttgacattgttcccggcacaccatataatggaagagaagtatttttaaggaaggattgtgccgcctgccatggacgacagcgacaacagcgacgccaaccagtttttgcatcatttctatggaatgtgaccgagcataacccacgcccttcgggtggtgggctatgcttttttgttcttttgtctggcctccgccgcaaggcggtcagaatatgaaatctcaaacaacgaaaggagtggtggatccaacatggatcatcccaaacccaagccttggcacgcccagcccctctcccaggtctatgaaacccttcattcctctgaggacggcctgcgggatgccgaggcaaccgaacgtctgcaaacccacggacccaatacgctgcgggcaaagccccccaagtccattctccgcatgctgaaggaacagctgctggacccgatggtcctcattctcatcggtgcggccctgttctccgccctgctgcaggagtggaccgaggccattgtcatcggaaccatcgtggtggtcaacgcggtcatcggcatcgtccaggagaaaaaagcccagtcctccctggaagccctgcgaaacatgcgggcgcccaccgcccgggtcctccgggagggggaggagagcattctccccgccagtgagctggtcccgggcgacattgtcttcctccgggacggcgacatggtccccgctgacctgcgcctggtggacgccgcgaatctcaaggtccaggaggcctccctcaccggggaatccgtcccttcggaaaaggatgcggatgtcctgctggcagcggactgccccctgggggaccggtgcaatatgctctacgcctcctccattgtcacctacggacgggccaccggcgtagtggtggccaccggcatggacacccaggtgggcaacatcgccgacctgctggacaatcaggacgaactggacacccccatcaagcgcaagctcaacgcagtgggcaaaaccctcacggtcatcgggctaattgtctgtgtcctgatcttccttctcggtgccctgtaccaccggcctttgattccacagttcctggtggccatctctctggccatctccatcatccctgagggcctgcccgccaccgccaccatcgttatggcgctgggcgtgcagcgtatggccaagaaaaatgccctgatccgcaagctgcccgcggtggaaaccctgggcagcgccacggttatctgcagcgacaagacaggcaccctgaccctgaaccaaatgacggtcacccacatcgccgtcaacggggactttgcagccggccagggcacccctgtcgcggaggcggcccagcgtcaccccaaggtctatcaggaattgatctatgccgccgccctctgcaacgacgccagcctggaccccgatcacccgggccagatcatcggcgaccccacggagggggcactgatctacctggcccaggccttcggcattgaccatgaagacctggaggaaacctatccccgtctgttcgagcagcccttcgactccgaccgcaagcggatgaccaccgtgcaccgaatccaggaccggaacatcgcttacaccaagggcgccgtggacgaactgctccccctctgtacccacatgctcactgcggcaggcgtccggcccatgacagagaccgaccggcgccagattttgtccctgtgcaaccagatgtcagagcaggccctgcgggtgctgggttttgccatgcggaccttggagcacatccccggggaggaggacgactccgtggaatgcgatctgacctttgtgggcatcaccggtatgatagatcctccccgcaaggaagtggcccgctccgtggccacctgtcagcaggccggcattcggaccgttatgatcacaggggaccacaaggtcaccgccctggccatcgcccgggagctgggcatttaccggccgggcaacaccgtcctctccggcgacgaactggatgccatgtccgaggaggacctggacgccgcggtggggaccaccacggtcttctcccgggtctctcccgcggataagctgcggatcattcaatccctgaagcggaccggagaggtcaccgccatgaccggggacggggtcaacgattcccccgccctgaaggccgcggacatcggcgtggccatgggggtcaccggaaccgacgtggccaaggacgcctccgacatgatcctgctggacgacagcttcaccaccatcgcctacgccatcaaggaggggcggcgggtctaccgcaacattcaaaaggtcatccagttcctgctggtgggcaacatcgcggagattctcaccctgttcctggccaccgcgctgaactgggaggcccccctgctggcagtccatatcctgtgggtcaacctggccaccgccaccctgcccgccctggcgctgggggtggacccggccagcaaaaatattatgaaacacccgccggtgcggtccggcaccctgtttgaacgggacctggtccgccgggtggtgacccaagggatttttgtggccctgctcaccaccgcggcctactggatcggcgtccgtatggcggaccacaccaccgggcagaccatggccttctgcgtgctggcactgtcccagatgctgcgggccttcaaccagcgctccaacacagagcccatttgggtgcgggcagaaggcatcaacccctggctgatcgtttcctttggcgtctccgctctgctcatggccgcgatcctttggattccccctctccagagtgccttccagctgaccaccctttccggcctgtcttggctggtggtcctggggctctccctgctctccattcttcaggtggaagtatccaaagccatccgacgcctgggcatctaagcgcattctgcggcccggcagcctttgaggccgccgggccttttcccgtccatcggagggcgctgcccggcgggctccgtcacacaaagacaaaaatctgttaaaaaaagaccaatcttggaacccgtggtcaaaaacttttttctccttgtgagcctttttgtgaatttcttgccttgatctttttccctccgactcccataattaccataatacccatctgggacacgatttttatgataaggaggcagcaatttatgggagtttatgtggtaaccggcggctccggcggcatcggcggaaagaccgtggagattctccgcagccagggccacgaagtggtcaacgtagacctgaaagacagcgacatctgtgccaacctggccaccaaggagggcagggacgaggtcattcacaccattcacgcccagtaccccgacggcatcgacggcctgtgctgcaacgccggcgtttccggggcctgcggcaatttgaagctcatgatcagtctgaactacttcggcgccaccaatctggcccacggtctgttcgatctgctcaagaaaaaaggaggcagctgcgtggtgacctcctccaacaccatctcccagggcgctgcccggatggatctggtggatatgctcaattacagccagaccaaacctgtcaatgaggaacgcattctgaacatcattgagaagttcgatgagagcagcctggctgtgggcaacagcatctatgtaaccaccaaatatgccctggcccggtgggcccgccgggtctccgcctcctgggccgccaacggcgtgcggatcaacaccgtggcccccggcaatgtctccacccccatgaccgccaccatgagcgaaaacgccaaggccgccctggccgccttgcccatccccatcaactacggcaccgataccctgatggacccggaggacatcgccaacgtcatcgccttcttggtctctcccctggcccatgggatcaacggcaatgtcctgttcgtagacggcggcaccgacgcgcttctcaactctgagaaagtctattaaggagggttttcatgactttgattaagcagtatgtgcaggctatgctcaaccaggactcggtggccctgagcaagctcttctcccccaccgcgatttttgtggactactgccccaaggacgccggccagccgcagctccacgcttacggccccgaggggattgacatgtttttccggaaccgcttcctgttccggcggtttgaaatcaccgatcccctgatcgtcagtgacacccaggcctattactacgccgtctacaacggatatcacatccgggcggtggccaccatccaggatttcagtgaggatggcgagattcagcgtttggtggtccgtccggcctgagcccagcacacccgcccccattgggaagcgtcgccttcccaatgggggctttttttcctgttcttgcatggaatttcctcccatcttgcacattttcctctcatttttctgtctattctgcataatttctcctctcttttttcattttctctattcttttcgttttaatctacatttttgttatacaatttgtcaattatttgttcacttttcatcttgacgtttctgaaaaaatctaagataatagccacgttctccggtaagggccgcagcccttgattctcaagggttttctacttcagttgcaataaatcttgcattttacttcgcgtacgtccgcctgtggttccttccttcttttccacggcgtgactgacataaatccttccattattactcaccaaaagagcctttcgggtcactcccgaaaggcttttttggtactctctcaatctggttatgccaaataaaacaggattggccatagccacaaggccagttctgtgttactctatggctgtcggcggcgagagccgcccatcgcaccgggacagagcctctgtcccaatacaaggaggatatttcatgaagcgcgttgtttccattcaagatatttcctgtctgggcaaatgttccctgacagtggcccttcccatcatctccgccatgggcgtggagacctgcgtggttcccacggcggtcctctccacccacaccggcggattctccggctttaccttccatgatctgacccaggaggtggcgcccatcgccgaccactgggcaaaggagggcatctcctttgacgccatctacaccgggtatctgggctcctttgagcagatccatctggtcagccaattctttgaccggttcggtggccaggacaccctaatctacgtggaccccgccatggcggacaacggcgtactttacactggttttacgccggagtttgccaaggaaatgggcaagctgtgtggcaaagccgatgttattgtccccaacctcactgaggcctcctttatgctgggggttgactacgtgggggaggactacgatgaagcctatatccgggatctgctgaaacagctcaccggcctgggctgcaaaaccgccgtgctcaccggcgtcagctttgcccccggccagatcggcgccatggcctatgacgccgccacagacacgtatgccagctatttcaatgaaaagctccctgtgagcttccacggcaccggcgatgtgttcgcctccgcctgtgtgggcgccctgatgaatgggaaagacctcgccggcgccttgaagatcgccgtggactatactctggagtgcatccgggagacccaaaacgaccctgacgcccgttggtacggtgtcaactttgaatccgccattcccatgctggttcacagcctgggacgctgatccttctcctttcccgcccatctctggggccggcctgcaggccggccccagaatttttttgaaaacctaacattttttgaaagaaattccgcctcagctcgtgtacgttaagcagagaggcctttttgccagagagaaaggggggaggcttttgaacagcgccgaggccagctggctccacaccctctatatcacctatgccgaaaccttataccgaatcgcctgttaccggctccaggacgccaaccgggcccaggacctcctccacagcgttttcctggccgcggcccaaaaggtccccgccctgcaagcccacgaaaatcccctgggctggctgctgcgcgccctgaactatgagctgagccacgagtttgcccggcaggccaagcagaccgcccaggaacagcccctccatccctcccccgccggtctggcaccgacgccgcccccgtccctggggctggccgaggtgctgccggtccagctctccccccgggaccgggaaattctgctcctgttctacgaggaagggctgtcctaccaggagatcgcccagcgtctgggggtgccggtttccacctgcggcacctggctctcccgggccagaaagcactgccgcgcctatctgtcccattcccccggttttcccgattgagaggtgtttcgatgtctcatactacttcctccgcccgccgcgccgcggcgcagcgcctgctcctggagacgaccttattccaggaggaaacctccctgccccgcctccaggcgcttctgacgaccctggaggaccagccgccccccgctttttccgccgaggcatcttggcggcagctgcaggccacccatccagattgcttcccccttcgccgcgcccgcgcctggaggcgatgggccctggcgggaagcgccgcggccctggccgccctggtcctccttctccccgcccagacaaaggagagcaccgccccggcccccgccctttcccaggacgccgtctcccaggttatccccacgtctgccggtttggcggcgctgtatgacctggcctacctggagaatctggcgcccccctctgcctgcccggacgtggagaaccttccctttttcctccccggagacaccgccccgggccatcttccctttgacccagaggacaaaacccaatctatctttcttctggaggacgctcccctttccccggcccccttctcccaggattctgttcaaaacatcccgtcagagcccgcctcaccggaaacgccgtgagcgattccctgcccactcctttcaaaaaagcaaagaggacgcgcccgccggggcgcgtcctctctccttcctctttatagcgtttctccctctgaaagtacaaacttctcaatggccagggccacgccgtcggcctcacaggaggccgtgacaaagtccgcccccgccttcaccgcttccgtggcgtttcccatggccacaccgatgccggcggcctggagcaggggaagatcactgccgccatcccccatggccagcacctcctcaggggcaatgtccagccggtccaggagataccgcagggcctctcccttgtcaatctccccggcaatcacctccaggtcattgggaaagggatcggcaaagccgatgcccggcaggtccgcgaggcactgccgcagggcctgcttggtctggggactgtcggtgaggaagaaaagctcctccaccgggcgggcatccgccgccaggaattcctccaccgttcccggcaggacctgccgggtatccaggtggtactgcagcatggccgtccccgcgtaccgggcccggagggtctcatagtccggccgggagagatagcccacccccgcccggaacacctgccggatcatgggaatgtgggcgcaccgggccagcacctgcaagcagagggcaggggccagatgcttttccagcagcacccgctgctccaccaggtcccgaatggtggccccgttggaggtgaccgcgtaccgcagccccggcagggacagcaccgccggcggcagaccctgggccgggcggcctgtcacaggcaccatcagaaccccctgctgcctggcccgctccagcgccgcctgggtccggggggtgatctgcttggccccgttgagcagcgtcccgtccaggtccagcgccagcagccgaattttctttcccatggccaccgcctcctgtcttgtttgataccggtattgtaccacggcccggcgcgaatggccagagggcaggccccttctttccaaaatatccggccagcccccgccccccttgcatgcccgggagaaaaccagtataataggagtcccattcttttcaaatccacaaaggaggcccacgccatggccacacgtccctatcccattctcaccgtcaatgaaaaggccgcccgggccatccgggccgggcatccctgggtctacggggtggagaccaccggtcccgaccggccctgtgaaaacggagacctggtggatgtggtctcccagaaaggccgctggctgggcacggggctgctcaacgatcactcgaagattcgggtccgtctgctctcccgaaacaccaacgaccggtttgatgaggccttttggcggcggcggctccaatacgccctggactaccggaagaccgtcatgggggacgacttttcctgcgcccggctgatcttcggggaggccgaccagttccccgggctcaccgtggaccttttcggggacattctggtcacggaggttctctccctggggatggaggtccgaaagtctctgctctattcccttctggtggaactgctggccggttacggcgtggcggtgcgggccatctatgagcgcaacgaggcccccctgcgggacaaggaggggctgccccgggagaaggggttctatcccctccccggcctggccaccgacctggacggccacatcaccttggtggaaaacggaatctcctacgatgtggactacatcaacggccaaaagaccgggttttttctggaccagaaatacaaccgccgggccgccgcggccctggctccaggccggcggattctggactgctgcacccacacaggggctttcgccctcaactgcgccaaggcaggcgccgcccacgtcaccgctgtggacatctcccaggacgccgtggccctcacccggcgcaacgtggcccgcaacggcctggaggaccgcgttgacgtggtgaaggccgacgttttttccctgctcacagagctggcccgggagaagaaacacccctacgactacatcatcttagacccccccgcctttaccaaaagcggggccacggtgaaaaatgcctaccgggggtataaggagatcaacctcaaagccatgaagctcctcccccggggcggctacctggccacctgctcctgctcccatttcatgacccccgacctcttccgccggatgctctgggaggccgccgctgacgccgccgtctccctccggcaaatcgcggaccggcggcaagccccggaccaccccattctatggggcgtgcccgagaccgagtatctcaaattttatctcttccaggtcatttgatctcccgacccgctccccttttccggggcgcgggttttttcttgacaacgccagtctaatctgttagactaacgttgtctaaaacattcgactggaggtatgtcccatgaaatctcccccttccctctccctggccgaccaccgtcttttggacttggtctggtcctctgagcccatctcctccccccagctgtgcaagctggcccaggcacagctgggctggaagcgcaccaccacctacaccgtcatcaagcgcctgtgcgacaagggctgcctgaagaacgaggccgccgtggtcacctccctggtggaccgggccactgtgcagcaggcggacgggcaggaggtcctgcagcgctccttccacggctctctgcccagtttcctggccgcctttctccgggccggcagtgtcagcgaccaggaggccgctgaaattgagcaaatgctggaggaataccggcagtcccattgacaccctttcccactcccccagaaaggaggcccttttatggacacgttcctttccacccttctgaccatgtccgtcaccgccgccctggtggccggcattgtgatgctcctgcgcctggtcctgaggccgctcccccggtggatcacctgtgccctgtggggggtggtgtttcttcggatgatctgtcctgtggggctgtctctgccggtgagcctggtgccccaggccatcaccagcggggcctatgtccagcacctcctccccgccgagcccgggccggcccaggaaacggtccccgtccaagacacgcccgccccggccgagcacaccctttccgccggagacgggaccccaccggccccagccgcgccagcggatattccacggcccgccttgctcaccggggtgtgggccgcgggggcaggggccgccctgctttgggccgcagtctcctacgccagactccgctggcaggtggcggaggccgtgccggtggagaaaggggtctatgagagcgaccgcgtctccacccccttcgtctgcggcttgctccgccctcggatctatctccccgcctccctcccagcggaagaccgtcactatgtcctgctccatgagcgggcccatctgcaccggcgggaccactggaccaagcccctggcctatctggccctgtgcctgcactggttcaacccccttctgtggctggcctaccgcctgttctgccgggacgtggaggccgcctgcgaccaggcggtgatccgtccgctggggcgagaggacaccgcccggtacgccgccacccttctgcacctggggtgccggtccggcttccccgccgctgttcccctggcctttggcacggaggacaccaagggacgcatccgggctgtgctctcctaccgcaggcccgctctctggctcattctggccactgcggcggcctgccttgcggccggtcttttcctgttgggggacaccaacggccgactggagggcaggcccgttgacgaggggatggttttctcctatggggagactctccccctcccagagcccttgctggaggagctgctggctctctgcaaccgatatgacggagatctggagcccatgtcttccctctcctttgaaacggacaccagaatccttctctcgggcaagaaagaccactgggaaatttttcgcggggaccaccctctcctggtccatacgacttcctccggcggaaaagaccgggaatcccaaccgtaccgtatgaccggtcagctggagcaggcctatctggcctgggaagcttccctggaagaatatctctgggtcacccgcccggacaccctctatacccgccggggctgctccctccagacaaagcaggcggcggaacaagtgctggaggaattgaacctccgcgccttcacaggcccctatacggttgaggttttccagggcgagtcccccgatcccacgattctgaccgtctatctggacaccccgcccgtcctggccaccgacgcggcccgcctgatcccctatctggacctggcctcttccgccctgttcgctctggacgatacgctcttctacatcgactggaccttcggggcccagggctccctccacgggactgggagctatatgacctatcccgatggcctctccggccaggacacgcccccgcaaacccaggaggccttccgggagacctaccggcagatgaagcaggccggcagcgccgctcagatcaccctcttcggccgctaccgagacaccgaacaggtgctctactgcgcgcccgggtatgacggccccttccccctcgaggcgggccgctcccatggcatcttcagcgaactgtggagtgatgtttttgccctcacctccttctccgacagccagggcgtgcactatgatactccctactaccgttggcagccccaggcggccaacgaccaactcacccgctatggcgtggaccccgcgcagcaccagggagaagcccgttggtgcattgtggaaaatgtctttacccaggacaccggctaccgcctttatgagtgggacgggaacgtcttcctgggctataccaccccggggcagccggcgggccccctgtccttcctggtccagttggagagcacgccccactgacccatcccctgaaaggaggtccccatggaccaaattctgcaaacccttctcaccatgaccaccaccgcctctgtggccgccctgtgcgtgatgggactccgtctgcttctgaaacgggcgccccggtggatcacctgtctgctgtggatggtggtctttgtccgcatggtctgtcctgtgagcttctcccttcccgtgagcctggtccccgcccccatcgcccagggcacctacgtgcagcaggctgggcaggcgctggaggcctcctcccgcgcccaggcgcctgccccggcggacaccggcggcccggcagaccaaggggcctccgccgggccggaccggaccgatgtggtggtcggactctggggggccggcaccttgggcatgctcctttgggggggcgtttcctacctccgtctgcgccggcggaccggggaagccatccggctagagggcaacctctatgagaccgatcagattgccgccccctttgtctgcggtgttttctcccctaaaatctatctccccgtggggctggacccccaggaccggccctacgtccttctccacgagcaggcccacctgcggcggcgggatcacctgaccaagcccctggcctggctggcgctgtgcctgcactggtgcaacccccttctctggctggcctaccgcctgttctgccgggatttggagaccgcctgcgaccaggccgtcatccggcgctttggcgccaaggacaccgcccaatacgccgccgccctgctgcacctgggacacagcggcaagctgccccaggcggtgcccctggcctttggggaggaggaccccaagggacgcatccggcacgtactggactataaacggcccccggtctgggtggcagggatcgcgctgctggtgtgtgcggccaccatcgtcctgattctggccaaccccggggtaccggaggaccagatggaaggggtcgccatcacagagacctacctccagctgcgcggcaccccggtgcgacttcctgaggaactccagacatccttggtctcccttcttcgggactacgaccaagaggactacactcccctggcgcagttctccctgccgaacggcgccctcctcctcaccaacgccaaccgggggacccagttttgtctctttcttggggagaccggggcccctgttctggtccgcctcaaccacgacggctattctgcctcgcaaaagaaggcggtcctcccggaatccctcctccaggacccccggtggcgcgcttttcagacctccctgtcctcctatctgagagagggatgggcggaagacctctatgccctgaaaaccccctatctgggcagcccctcggcctgcctggccattctggaggaactgcacctctcccaggcagtgggcccctaccagatcgccctgcagacggaacgcgctccctatgggatcaccctccagttccaggaagcctgtccccaaggcgccctctcctctgccacggaataccttcgcttctgcggcaccgtcttccaagccctggtgggcaatggggatcgcttttcgtgggagctgcccctggaagggtcggacacccctgcccggggcaccgtggaaaaaacaccatgggacaccacctctctcaccgcctttctgcccgcttggcagcaggccctggaggagtggctccaggaaagcccgctgttccaaaccacacggccggagtgagggcctgccccgtcgtcccctgcccatagaaaaagccgcacagccaactttggctgtgcggcttgcgttttcatctcattcgttctcaccggaactgtcctgtcttcggcagcaccgactggcttttctgctccttgcgctcgtaagaggcgggggtccggcggtagaaaatctggttatcctcaatgtaggcctccaaatagcccagcccccgcagatagttgatataggacaggctggaggtggcaaagtaggacagatttctcaggtccccggcatcaatgtgataggtccggcagatgtccgcagccatcttggccggggtggtggggccatccaccaggtccagcaggtccaccatccgctcggcaaagaaccgggcctccatatccaccagagggagaatctcatcatagatgccgtaatgggccacgatgaatttgtccgccggctcggtccgcattttccgcatggagtccagatagtcccgcacgcagaaggcaaaggggaatttggagtggtggagggtgcggccggtcatcatggcgtcccccaggtacaggacattgtccggtgtacgggtacagatgtggtccaccgtgtggccgggggtgtggatgatgtcgaaggtggccccgcagaaggtgatccgatcctctgtgggcagaatgatccggtcggccaggcagggggtcccgtgcagcggcggcgactccaccacgtcctccggggacatgaggtagttggtgatattcaggcccaggtaggacatctggtgccccgcctcccccagggacatggccagttgggtgccgtaggtctgtttgagataggccacattgcccatgtgatcaatgtgggcgtggctgcaaatcacacccacgggcgtgagccccgcttcccgaaggcttccctccaggtcttcccgctgatcgttcagaccggtgtccaagagaatacaatggctgtcgtccagcttgtaaaaggggatgagctcccagcttttcagcacccaggtattccccttgacttgttctaattccatagcgattccctccttatcctacaacttcacgttcctcccgccgtatctcttcccctatcgaaaccgtcctgtggggggcagggtgagcctctcccgccgccggtttacccggcggtagcgaagctgatcctctgccatcaccaattccaggtccccccggtcggtcaggtaatggaggtacgtttgactggcctgttcaaaataggccagatggcggggatttttggtccgaacctggtaggtccggcagatggcctcggtcaattccttgggggtggtgctctcccccaccaaggtcagcaggtcctccatccgctgggtcaaaaaccgaagctccaggtcaataaagggcaaaatttcccggtaaacaccccgatgggccacaatgaaccggtccgcgctctcctggcgcagctttgccagggattccagatagaccttcatggagaaggcatagggaaacttggcccggtggaggacccggccggtcatcatggcatcccccacatagagcacattgtccggggtccgcacgcagatgtgatccaccgtgtgccccggcgtccgcaccaggccgaaggtcaccccgcacagggtgacctcccgctcctggggcagaatgatccggtcaggcagacagggggcactctccagctctgggtactgcccaaaggcccccagggacagattgtagtactgcagctgcagacccaggggggaaaagagctgtcccgcctcccctagggtcagagccaggacggccccccgggttttttgaaaatatccataggaccccatgtggtcgatgtgggcatggctgcccagaatggccaccggcgtcagccccgcctggtccagggcggcctccagttccgcccgctggtccacggtgcccgtgtccagcaggatgcaccgggtgtcgtccacctggtagagggggatgagctcccagcttttcagcacccaggtgttgcccttgacacgttccagttccattcggcttccctctttcttctctcccttccccgccgccggggcggcgcctcggtggggacggggttatcccgggatgcgtcgggcccgggtaatccacaagctgcccaggacccagtccccccgatagagcaccgccagctggcccggcgtgggcgctcgggcgggggtgagaagctccagccgccctcccgtcccctctggatagaatcgggcaggggtctcggttttagagtggcgcagacgcaccgtcagttcttccccttcggtcagaggggccaacgggttaaagtcctccccccagaccgtgtccgccataaggtccgtgccgtcggagaggaccacctcctgggtctccgggcggatctccgagacaaacagccggtgggccgccgggatacccagcccccggcgctgaccgatggtatagcgatggataccccggtgccggcccagcacccggccggtccggtccacaaaatggcccggcggcggcaccgcgcctcgggcctccagccaggcggcgtagtcgccgtccggaatgaaacagatttccatgctgtccggtttctccgccaccggcagtccaaagtcccgggccagctgccgaacctgggtcttttcatacccgccgatgggaaacaccaggcgggacagccagtgttggggcagccgggccagcatataggcctggtcattggtgtgggcgccccggcagagcagcggctcccccgccggtccggcggcaatccgcgcatagtgcccggtggccacccagtccgcccccacctcctccgcccgccggaacagggcgggaaacttcaccgtagggttgcagcgggcgcagggcagcggggtgcgcccggccaggtaatcccgctgaaaagggcccatcaccgacgcctccagctcccggcggatatctccggcggaaaaagggatgccgaaggtctccgccacttgctgggcgtcctcccggccgcccaggccgatgtccagccaatgcccgtagaccgtgtagccctgctcctggagcaggcgggcggccacggcggagtccaccccgccggagagccccagcaccaccgtcttaccgcccatggcgggcctccttgggcgccaccgccggggcgccgttttgttcgatgagggtcaggtccccccggtccaccaagtattccaaataggggcgaatataccgctccaggtgcagcccccgggccgggtgccccaccggcaggtccatggcggtcaccacggcggcgtaaaaccggctgtacgtcatgggttcggtcaccagcgccccgcaggccgccagctgcccctggatgtggcggatattcatctgggccagttccgccaccgaaccatagcggatgcccttatggcagaagatataggcgtcgcaggagagccccgccacgatctccttgctcttcaggtcgtcggccatatcaaagacaaagggcaccatggcccctgccagcacgtcctccgtcatcaggacatccccggcaaaacacacgttgtccggggtgatgaagcagacatggtccggggcgtgccccggggtgcgcaccacctggaggggaaccccacagaacaccagctccgtctccccaaatgcgatgacccggtccaccgggcacaccaggttttgcagccggggaatggtgcggatcatccccatggtaaaattaaacaggtgatttttcaggctctcctcactgcggacgatgtccgcctccagctggggcaggcaggttttggcgccataggtttcacgaaaatagcgggtggtctcatggtggtcgtagtgcatgtgggtgcacagaacccccaccggggtcaggccggcctgggccagggccgcctcaatctccccctggagcttggtgctgccggggtccagcagcaggcaggtgctctcgtcgatctggtagagccccaccagctgggggccctccagcacccaggtgtttcctttcacatggattcgtttcatggtgtttctcctggtctgttctgtcgttccagcgcaatcatcaaggcggccacatccgccggggagacgccggagatccgggccgcctggcccaggttcccaggccggatggcgtccagcttctgccgggcctccaggcgcaggccggccagctggtggtaatccaggtccgccggcagggttttcccctccagccggcgcatctcctccacctgtcgctgctggcgggcgatgtagccctcgtatttcagggagatctccacctgctcccgaaccgcctgggacagggcggggcggtctgggtccaggggagccagatcctcataggtcaggcggggccggcgcaccaggtcggacaggcgcaggctgtttttggccgggggctcccccttggcggccagcagctggttcagctccgccgtggccgccacaccggtgtgctccaggcggtgaacctcccgtttcacctgctcatatttctcctgcaccctctcgtaccgctcccggctcaccaggccgatggcatacccaatggggcacatccgctggtccgcgttgtcctggcggtggaggaggcggtactcggtccgggaggtcatcatccggtagggctcgttggtccccttggtcaccaggtcgtcgatgagcaccccgatgtacccctgacttcggtccaggatgagtggggggcggcctaaaatctttagggccgcattgacccccgccacaaagccctggaccgccgcctcctcatacccggaggagccgttaaactgccccgcgccgtaaaggccggacacctttttgtgctccagagtgggcagcagctccgtggggtccacgcagtcatactcaatggcgtaggccgcccgggtcatctccgcccgctccagaccgggcagggtgtggagcatctggatctgcacatcctccggcagggaggaggagaacccctgaatgtaaacttcctccgtgtccagccccatgggctccagaaagagctggtgccggggcttgtccgcaaagcgcaccaccttatcctcaatggaggggcagtacctgggaccaatcccctcaatgaccccggagaagaggggggaccggtccaggttggcccggatgatggcgtgggttttctcgttggtataggtgatgtggcagcacacccggttgggcgcgggcttctcggtctcaaaggagaagggcatggcatcctcgtcccccacctgacattccaactgggaaaagtcgatggaccgggcgttcacccgggggggcgtgcccgtcttaaaccggcggagggtgagccccgcctggcgcaggctttctgtgagctgattggcgccaaacatgccgtccgggccgctccatttggccacagaacccaggatggtctttccccccaggtaggtccctgagcagatcaccaccgcctgggcccgataagcagccccggtgtcggtctgtaccccggtgacccgcccctcctctgtgagcagcgcggtcacctcgccctgcttcacccacaggttctcctggctctccagggtatgcttcataatcttctggtattcccgccggtccgcctgggcccggagggagtggaccgcagggcccttgccccggttgagcacccggtactggatgcaggccaggtcggcggccttccccatctcaccccccagggcgtccagctcccggaccaggtggcccttgcccgtgccgccgatggcggggttgcagggcatgttgcccaccgcgtccaggttgatggtaaagcagagggtccgcagccccagccgggcacaggccagggcggcctcaatcccggcgtggccggcccccaccacagccacgtggtaggtgccggcctcataggtcatgggtttctgggatatacgttcttccatcgttgtctcctgtcacagcaaaagttccaccaaaaaaaccaccacgcagcccgacgcggccaccaggaacaggttgccgctgaaccaggccaccagcacccccgccaccagggccgccagccccgaccagagactgtcggtggcgtggaggatggcgggaaaggtcatggccgccaaggtcacatagggcacgtagtagaggaaggagcgcaggaagggatttttgatctcccgccggatcagggtcagggggagcacccggatgagataggtcaccagggccaccacggcgatatagagatagacattatgctccatggccttccccctccttttcctcctccttcaccgggaacagcagcgccgccccggcggcaatcaccacagtgagcaaaatgatccgggtacccgaggccaaggaggcgaacagggggatacactccagggcaaagctggcggccatggagaccaccaccacccccagaatcaccttgctcttccgagaggcggggatgatcaccgccaggaacatgccgtacagccccacgctcagggcgctgaccacgttggccggcaggacgttgcccaccgaggtccccagaaaggtccccagggcccagccgggcatggcaacggtcatcatgccgaaatagtagaaggggttcagcttcccctgctcggcaatggccatgccgaaaatctcgtcgttgacgttaaagccaatgaccagccggtgccagagcttggatgcggcgggcagcttctggctcagggcgcaggacatgaggatgtaccgggcattggtcaccgcctctaaaatggcgatctcccaatagcccccttgggccgccatcatggtaaaggcggcgtactgccctgccgaggcgttgaccagcaggctggtcagggtcgcctgaaaggcactcaggccggcgttcttggcggtgatccccaaggtgaaagacaccgccaaataccccagggagatgggaacccccacccgcaggccccgggaaaattgcttggtgttcatgctctgtgtcttctttctctctggtttcttccgtcagcccaacaccaccaggggcacgtcgggccggttcagcagccgaaagcaggggaactgattccccagcccccgggagaccaccatctgtccataggacaggtcgtacagtcccgcagtatactggggaaaaagctcccgcttggggcccaccagcccgtcggtgccgggcaggcggatgaggcccccgtgggcgtggccggccagggtgaggtccacccgggcctgggtgtattgttcataatggttgttccggtggctgaggagaatctcatagaccgccccctgctcctgccggacctggtccgccagctcctgcaccgtcttttggtcggcgtagccgttgctgtcctccgcccccagcagggcgatccggtccccgttccgttccagcatgacatactcgttggacaggaccgtcaccccgcactgctccagcagcggctccagctcccggaccaccccggcggcccactcgtggttgccggtgacgtaataggtgggggcaatggccgccagacccttggccacggcggggatcatggacatctggtcgggttcgtggaggatgtcccccaccacagccaccaggtcgggctccaggtcccggacatagtccagcaggacccggttcccctccccaaactccttggcgtggaggtcggagaccacggcgatgcggtatccatcaaacccgtccggggcactggagacggtgatggtctcgctggacagcccattctgctgccaccagaaccatcccaccagcaggcccagcaccagcaccgtggtcaccagccgggtcaggcatccccggcggcggcgacggcggcgggggcggggatatcgttcgttccaatcggattctttaatcatggtcaatatagaagggtttcatcaaactcttctgctcagtggagtccttctgccggctcttgggcggctccacccggggcgggatgcgccctctgccccggccggagcgggcagccggtcggccgagcgccccagtccccttcttcgccggggcgggcgcccccttcttgggggcctttcgggtctgggccgcctgggcggccttgggcgtcttttccgggggctggggtttggccggctgggcctgggccttgggctttttgtccccttttccccgcttgccgtgggccgcgccgggcttatagtattggtacaccggtttggccgccaggagccgggcggtggcgtccatgatgacctccccctctagggggtcccggtgggaaaaggacaccgcgccctcctccacaggctgggcggccaggaagtcctccagattccccagattctgcttgccgtgggggaaggtccgccgggccttctcccccttctccggcggctgggccgggggctggggggcggctgcctggccctgtcccttgccccggcggcgtttccggccgggggctgggtccgccggggcatccagcggctgggcagccttttccgcagccttctcggcggcctgcttccgctgggccgcgtgcttttcccgggcggcctggcgggcctcagcgtcctcgggattgaccacccggcccttggcgtccttcacggggacctcaaagacctccatgggatagtcatgcgcccgccgggggatgggctttttcagcagcttctcaatgtccttgagcatgggcatctccccatagtcacagaaggagatggcggtgcccccccggcccgcccggcccgtgcggccgatgcggtggatataggtctccggcacctcggagaggttgtagttgaacacataggagagctcctcaatgtccaggccccgggcggcgatgtccgtggccaccaggacccggagctttccctccttaaacttccgcaggctctcctgccgggcggtctgggacttgttgccgtggatggccgccgcggccaccccccgccgggtcaggtcccgggccactttgtccgccccgtgcttggtccgggtgaacaccagggcgcttttcacctgctcctgctccaaaatctccagcagcagggcggttttgttcttccgatccaccaggcagacctcctggcggatgacctccaccggggaggacaccggggcggcggccaccttcaccgggtcatggaggagggtgtccaccaggtctaaaatctccggggggagggtggcggagaagaacatggtctgtttcttctggggtaggaggcggatgaccttccgcacgtcatggataaagcccatgtccagcatccggtcggcctcgtccaggacgaagatctccaccttggacaggtccagcaggccctggccggccaggtccagcaggcggccgggggtggcggtgagaatgtccaccccccgcttgagctggtccacctggggggcctggcccaccccgccgaagatcaccgcctcggtgaggggcaggttcttgccgtaggcgtggaggttctcgtcaatctgaatggccagctcccgggtgggggtgagaatcagggcccggatcgttctcccccgtcccccttgggccagccgctgcaaaatgggcacgccgaaagcacaggtctttcccgtgccggtctgggcgctgcccagcacatcccggcccgcgatgccggccgggatggctttttcctggatcacggtgggttccgcgtatccgtagtctgtcaacgcggttaaaatcggttccgtgatcccaagggatgcaaaacttgtcataaaatgaactgcttcctttcctgcgccctccctccgccagagagcgccgtggttactgtcaaagcggcagactgccgcgcggagctgcgccgcccggcgggcggcggaaacatcaccgcgctgtgcctcccaaccacgggggcatacagcgggtttgaccttacggctcctcctctaagaagtaggtggcctccatatcggccaccgagagggcaaaggccaggggatacttggcaaaggcccggcccaccagccggctgtcctcggtgccggagaagcccatgtgccaccggatggccatggcctcctcccgggtcaggcggacaaagccgttgatcacatagaccgatttctccccgtggccgtaggggagggggtcctcataggtgaaggtgggcacctgggtccacttgccgtcctctcccttcacattccgggtggagggtttgtaacagccgatcttgcacacgtcgtggagcagggccaccagggcaatggattccgggctgtactccaagccatagaggtccgtgacccgctcccgggccaggtaatcggtgagacagtggtaaacattcaggctgtgctcgcacaggccgccggcataggccccgtggtaccgggctgaggccggggatgtgaaaaagtcgctcttgttggtcagatagtccagcagggcctccgccccgtcccggtggacatgctcccgaaaaatctcaataaattcctcttttgccgacatggctgtgctcctcctctgtctttctgcggcggagcgccgcacctgaatagcttattgtagcataaaatcatgggtttttcacgggtttttccgcgatccccgaaaaaaaggcacctggcacaaaagtgcctggggtcttgggcgggtttctttccgatttggccgggaagcaaaacgcgggagcgcactctgaacggaggcgctcccactgcgttgactttctttgtctgttgccttactctatccccaggacgttttctggcttgtttccattgcctggattctggatcaggcgtgggacaagttccaaaacagaaagaagcgagccgtctgttgcagcagaacggctcacggcttttgtgaaaggtttcttcttcacaacttcatgttagttcaagtgttgtggcaaccgtctgggtttccacatttttattatagtctctaacgagagcattgtcaaccatgtggatattggggcggtactcttctttcattcgtaaagcagcttctcttttcaaaacccatcatcaaaaaatagggagaccagcaccataccagtccccctacccaatcaatttctatttgtattctgttgatttgcgttcagtctttcaaatacctggtcgatatttacagaatatttaagacgcaaaccattcgcataagcatcaagatatttctggcattccgctacaatttctttttcatgcttattgatgatattctgatacaatatgtacgcagcatcttttccaacccaaaatttttcctgatactctcttgtaatgggaaacatcttaatgtagtgcaacccgtgatgattcccaggacgtgtcgatggccttggcggcaaagaaaaatactggtctttgggtgtagccgcagaaatattagagcggagagggactgcgaagtggctcacttgccctttgtattttagggatagcaccaacaaatgcggacgccgatttttccgaaacaagatttcaggatcgtctccacaaatatcaaaatatcgctgggatattgtaataaacttcatcttaaatccctatctctcgtcttatacaagaaaaccctgcacccgctaaaattaggagtgcagggtctcatacgaatgaatgatattctaaccgtcattcccggttgctgagacacatacgaatgaatgatattctaaccgtcatccccggtgcaaagacttctttgcatccttattgtatgctcaatctcctattttgtcaacaggaaaatgatgccatataaagggaaccttggcctgcccggccggggccccatttcttgggaagaaatgggggaaagaacccccgggggaggaggttcctcccccgggacccccttctctggtggggttgtgtgggggaggctgtacttctcacttattacctggcctgcggccctcacattgaaaggcccgtaacggcccgcccaccggctgggcgggctggggacgtgggtgggtgccctttgggagaagacagaaagtaaccgttcgggttcccactttttcctcccgacaataaaccacttctcccgcccgcccgagccggtgggcgggccatgaggcgttggtcttggaggccgcaggccaggtacgccggtagaagaaaatcgctgcttctacaacggtccagagaaaaggggtgtgggggaaagaaactctttcccccgcaggggtccagggggcaaagtcccctggtgttctttcccctatttcttcaaagaaatagggccccggctgggaagccaaagttccctgccgttccaacggcaatggtgaaaacacaatataactccattagacagaccagaaaatatattctcactttatctaaacatatataaaacggtgcccggcaaagcacaagcaccgtaaatcccattttctaatccacatcatctggaacatactccgcaacttcatccaggcgacaattcagaatttcacacaatttattcaaggtatgcgttgacacaggctgatccgcttgtagccgctgaacggttgcatgactcattccatgcttcacgcgcagagtgtacgttgtcactttcttctgcgacatagtttcccacaacgggcgatagcgaatcattgccttgtaacccccctttctacccatccattatggatgtaaccagggctacaagaatatggccattatttagccatattattctgctatcattttttattaatcttttccgcttcctcgtctggcaaatactctgccacttcatctaatcggcagtccaagattttgcacagccgatccaacgtgtaagtagaaaccggcatatttttttgcaaacgttgtacagtcccgtgtccaatattatgtttttctcttaacgtataggtcgtaaagtgtttgtttgacattgtttcccatagagaattatagtgaatcatatgccccctcctttacacgccttattatggccgctataatagccatatggtatggccattatttggccataccaaaataggcaacgttaaagaaaggtgagatacttaaatgaatgttgatgccgaactggatagaatgaaacaggccatcttcacagaggatctgctaacaaagctcctctcctgttcccaaaaaacactggatgcccaaggcagcaccgtcccccctgaggaggcccaggcagcccgcgccgccctggaggacctgctgaccccccagcaaaaacaaatcctggccgccctggaggaaaaacacagggacatcctccgccggctcctccccttcgccgtccagcaggggctgtgcaccgggttccagcagtatttctccaacgagcccctcaccacccccctgcccggcctggtcacccaaaaggtgctggatcaaaccgtccactgcaccggctacacctgggcctgccagcaggccacagacctgtttgacacggtctatgaccagctgccggatcagacagcccaggaccaatggaccgatctcgacctggtctgggaggaccgggagtatatcctggccctggacgccttccacctgggctaccgcgccgccctgcggattctggggaattgcttcggcctggatgccagcatttccatgctcccccaggtccttttgaccgagcatgatctgggcgttctcatgacctcccaggagcaggagcgccagacccgcctgcaggcccgccccctcccccaggaccctgaaacccctttccctgactaaacacaagcccccgccgaaggcatccgccttcagcgggggctttgtttcggtgctcaaatggtctcctccaccagggtcaggccgcaggggcggccctggccgtcgtgctccaggcggtagcagtcggtggtgttcccgtcgctcaggtagcaccaggtgccatcggtgatcaggcgaagggggccgcactcgttttgcaccagcacctcttccccagtctccagctgcctggcccagaggctccactcctgcctgcgccccccattgtccagcgcagcccatgttctgttggtaaagtacagccacccgtccgccacggccaggtaatcccttgttgaatcctccgggtcctcgggctccggcagaatatagtcccggcccgccggggtcagcagcagatagccagtggcgtcgcagaggtagttgcccgcctcgtcaaaccggtttttggacgcatacccaatcaggagcccgccgggaatctctatggcggcctgctccccggctcccatggtgcccgggggcaggagagaccggccgtcctcctggagatcggtccaatggtactggttcaactccacatcctcctcccagccagggtaggtaaagccctccgggtggtccacatagaccacctcaatgcaccgctcccccagccacaggggatacccgttctccctctgcgctgtctgggacaaaagggccccggtgcggctgtccagcacaacggtgtccgtggtcttcccgtcagggtaccggtaggtcagcgtcaccgtgtcctcccccacctggttcaggaatagggccacatcataggtaagctccagttcctccccatgggcaaagtagttccacaggtcccccacccccagttccgcttccggttcctctgggccgggggccgtgtatagcagggtctcctctccagtggtcaggtcctgccgccagagggcgttggtgtctatatccacatagtatagactgtgggtattcaccccccagcaggaaaagagaacatccatccggtgcgcctggtaagacaccagctgctccttgccctcccccggcacatagcggaagattccctgggggacccgggcctcatcgggcccggggaagccgctgcccgcaaagacatagtaggccccgtcctgcagcacccctgcctcgccccccacgtcctgccgggggtggcggacaggctctgtggtgacaaaccacaccagcaccgccgcagccacaatggcggccacaatggccagacgccgccgccagacaccgcgctttacctcggctgactccatgaccagattgtcgtccaaaaggtccagcagttcatagagtttttcccctttcatcccagaagccccctttcctccagatacccccgcagccgctgccgggttcggaagagctgggatttcaccttgctctcactgtggcggaagagcaccgtgagttctccaatggaatctccccaaaaataccggcgcagaaagagctgccgttcgcctctgtcggtcttggttttcagaaagtcgttgatagcctccatcagctcccgctgggccaccgcgtcctccacggagtcctctcccggcagtacctccgccagctcatccagcagcagataaaaacggtcgccccgcttttgggcctggttgtgctccaaacgcttcagcgcaatgttgcgggtcacttttgccaaataggccagcaaactccgcgggggtgcgctgggcaccccgttccacaccgccagataagcgtcgttgacacactcctccgcgtccggatgatcccccaaaatgttgtgggccactgtgtggcagtacgccccgtacttctccgccaaggccgcgatggctcgctggtcccgtgcccggcacagggacaggatctcctggtctcgaagcaccatctccgccgcctcccctttctcctccccttctcgggtgttcttatccttatagaccggaaacaatggccgccggttgcaccgattccgtcaaaacttaaagaaaacgcagaaaaccgggcgtacaccgcccggttttctggttattcatccaacttgagcaccgccataaaggcctctgtgggcagctgaaccgtgcccagggtgcgcatcttcttcttgccttccttctgcttctccagcagcttcttcttccggctgatatcgccgccgtagcacttggccagcacgtccttgcgcatggccttgacggtttcccgggcgatgatcttgccgccgatggccgcctggacagggacctcgaagagctggcgggggatgttctccttgagcttttcacagatccgccgggcccggccgtaggccttttcccggtggacaatgaaggacagggcgtccacctgctctccgttgagcagcaggtccaccttgaccaggtccgaagcccggtagtccaaaaactcatagtccagggaggcataccccttggtccgggccttcagggcgtcaaaaaagtcatagatgatctcgttgaggggcatgtggtaatggatctccaccaggttggtgtccagatactgcatgtccttaaactcgccccggcgctcctggcacatgggcatgatgttgcccacgtagtccgggggggagatgatggagaccttcacaaagggctcccgctgctcggcaatcaccgagggatcgggatagttgtgggggttgtccacccggacctccgtgccgtcggtcttggtgacctcatagatgacgttgggcagggtggtgatgaggtccaggtcaaactcccgctccagccgctcctggatgatctccatatggagcatccccaaaaagccgcaccggaacccgaagcccagggcggcggaggtctccggctcaaaggtcagggaggcgtcgttgagctggagcttctccagggcgtcccgcaggtcggggtacttggacccgtcctcggtgtaaatgccgcagtagaccatgctccgggcggggcggtaaccgggcaggggctccgccgcaggggtctccacggtggtgatggtgtcgcccacctgggtgtccttcacgtttttaatggaggcggtgagataccccacctccccggcggataggctcttgcagggctccagcttggtgggcagcaggtggccgatctccaccaggccgtactccgcccccgaggccatcatccgcaccgtctggtccagggtgagggtcccctccatcacccggaaatagaccaccaccccccggtaagcgtcgtactggctgtcaaagatcagggccttgaagggggccttggggtccccctggggggcggggacatggtggaccacatcctccagcaccgcctgaatattgatccccattttggcggagatctccggggcgtcggcggcttccaggccgatgacgttctccacctcttccttggccagggcggggttggcggcggggaggtcaattttgttgatgaccggtcggatctccaggtcgtgctcaatggccaaataggtgttggccagggtctgggcctccaccccctgggaggcgtccaccaccaggatggccccctcgcaggcggccagggagcgggagacctcatagttaaagtccacgtggcccggggtgtcaatgaggttcagagtataggtctggccgtccagggcatcatactggatggtcaccgcccgggccttgatggtgatgccccgctcccgttccaggtccatgctgtccagcagctgattctccatctcccgctcgggcaccgcgtggcacagctccagcagccggtcggccagggtggactttccgtggtcaatgtgggcaatgatggaaaaattgcgaattttactttggtctgtcattgaatgctcctccttaagccttgacggccttgggtttcttctccctcgttgtgggctttttctccgccggcatctcctgggccagctcccccgccaggcagtggaacagcgcctggctctctgggtggcggcggcacagctccaggcacagctgggtcaaaacctccgctgcggaccgcagcaccgccgggtccactccctccggggcgccctgggcccggccgccctcccgttccacccgccgccccagcaggtagtccgccgagacctggtagtaatcacaggcccgcaccacaaaggccaggccgggctcccggatgccgttttcatagtgggacagcagcgcctgggaaacctccagcgcctgggcggcctgccgctggctgacccctttttcgtggcgcagctgagacagggtctgcgcgaaccgtacctgcatgccatccctcctatcttcccctcccagacaactgggtttttaacatttcgtattattatactctgcaaaatacccactgtaaagggcccccaaaagagaatttttctcccgccgggctgtccgccgaaagaaaaactttgtccccctcgacacccttccccgccatggggccaaaggcggcaaaaaccctgattttcaaccccttgacggatcagaccgcccctcgtatcatcatcttgtaaccagtttgttactcttttgttctcttttgtacactttactggaaaggagcgacaccttggaaaaacattcgatgccggctctcccggactggccggaccgggacgtgcaaacgcggttctctccggcggccatcccgcagcccgccccgccgccggacaccggccccacggtccaatggcccaccccccggcgcagccggcgggcgctgctggcaggggtgctgctggggctcaccgggctttctgtggcgggggcggtgatcgtctccacctgcaccctgtgctacgcggtctccaccgacggctctccccctctggcctacgtccagggcgaggacacctatcagacagcggtccggcaggtggaggaccaggtctctgagattctccggtcggattaccgctacgcccaggagaccaccatggccctgaccatcgcccccaagaacagcctccagacctctgaccagctcaccgccagcctgatggagacggtggaccaggtcaaagcggagtacattctcaccattgacggtctccccatcggcgcctgcgagagccgggaggccatcgaccaggccctgcaaggaatcaaagatacctacaccaaccagttcaccgtgtccgcctattttgacaacaccgtggacgtggtggtgggctatctccccgcccaagcggaagttctgggcgcccaggctttggcagagcgcctgacccagccccggcagcaggcccaaccagccatcgaggcactgcttcaggtcctggagcccgcccaggaactgccccggtccatggaaaccctccgggccgaggcccaggccatcgaccaggaccagggtactctccccctcctgacggtatgcaccgtggaggaagtcacctatacccagccggtggagcccccggtccaagaggtggaggacagcaccctcctgctgggggaggagaaggtcctctcccagggcacccctggcctggaggagcggacagaccgggtcacctacaccatgggccaggagcagagccgggagaacatgtcccgaaaccggttggcgcaggcaacccccacccaagtggccgtgggcaccgcccagggcgtggagggggcaaagggccggttcctctggcccctccgcggccggatcacctcccccttcggcgggcggcagattttcggcggggagaatttccaccgggggctggacatcgccgcccccagcggcacccccatcgccgcctctgccggcggccaggtgatctgggccggacccaaaggcacctacggcaacctggtcaaaattgaccacggcaacggctttaccacctattacgcccactgctccgaacttttggtccaggagggcgaccaggtcacccagggacaaaccatcgcccttgtgggctccaccggccggtccaccggcccccactgccactttgaactgctttggcaggacgagcttttggacccccagctttgtctaccttgacaacttgcctgacggcgccttcccggtgccgtcaggcaagtttttttcgtcctcctttcattttttctgcaaaaggcgatgcacagccccgttttttcctggaatttccaaatttttgccgcaagttccctgtcatctcgcaaaaactcgaccttttccagcttataacgcaagttttctgtcactcccgtgaagaaatgttttctttcctttaatatattgacaataggttgaccttttggccttcttcaggtaccttgatgccagcagatcggtttcataacccatttcatcaaaggaggactttcccatgatccctgtcaaccctgaagcaatcggcctgtttggcctgttcgccactgtcatctgtttcggcctggagcagctgggtgtcggcgtgaaaggcgccgaccacgaaaagctcacccgcaccttgggctacatcgccatcttcttcggcggcttcacccagctcttcacctctctgtgcatgtacctgttctccgtgggcggtgaccacagcgtctatctgggcactgtcttcggcttcttcggcctgttctggattctggtgggcttctttttcatcaaaggcggcgacaagaaagccatggcccacttcttcctgtgcggcctgatcctgtgcatcggcttcaccatccgcgcgttccaggacggcctggtctggcccctgggcatcgacctggtggtcattgacgtgctgctgctcaccctgatccccgcctggtacactggcaagcccgccctgaccaagctggccggtctgtgcaacgtggccatcggcgtgatctccgcattcctgcttttccccgctctgttcctgtgaggcggaccggaagcccagtctttcattcccttccaccccattgaaaccggactcaagttcaatcccccggcggtacagctttcgctgtgccgccgggggatttcgttttgtggtatgtcattcctgcccgggagagaagagcttctcctcccgcagcttcgccaggatgtacgcgtagctctccaggccgttgtggggcagcaggcaataggagcagtctttcaccccgttgcgcatcacaaagctgccccggcagtccgaggcacggtagagggggcagtagcagaacaagcagttaaactcctcctcccgcacccctttatggcaggggaaatactcacattcccggttttgaaaccaagtataatgttttccgttcaaatccatccttgcacgctcctctctggtcttgctccctggacagggaaatcccccgccgggctcggcgggggatggcagcgattattttcggccggcggcggtttccagcacccggcggtccgcccggtggtgctcaatgggcttccactgcacttttctgctgaacagtgccaccatggagatggggatgtaggtcagcatgaacagggggaaggtcaccgtgtacagcaccttccgcagcggcgtggtgtgaatccgcttccactcggtgatggtggtaaagacccccaccagaaacagcaccacatacagccccaggaaggtctgcaaaatgtacatcaggcagggcaggaatgaaatcccctccgccgtggacatgacgccgcccaccaggtaggcgataatcaagccaacggtgagaatatatgcaggcatcaccgtcatgctcatatcatagcaggagaagtgcccctttccaatacccttcaccaggccaaagccatacttgcggaacacctggagaaagcccctggcccagcgcagccgctgccgccaggactggcggaaggtaaccggctgctcatcatacagcaccgcatcggcgcagaagccgatcttccggccctggaggatgtggtggacggaaaactcaatgtcctctgtcagcaggtggaacttccagccattggtgctctccatcacctggcggctgaacagaaagcccgtgccggacaccgcgcagctggtgcccagaagcatccgggagttgttcaggtaccgggattcccggataaaccacagggcatagccggcggaaatccagttgtccccatagtttttggagttgcggtagctggtgaccacttcatagccgtcggaaaaggtccggttcatctcctccacaaaccggcagtccagcacgttgtccgcgtcaaagacgaaaaagccgtcatagaccttggggtaatcctcttcaatgtgcaggagcagctgctccagggcatatcccttgcccaccttttcccggttgaaccgggtatagaccaccgcgccctcccgccgggcaatgtccgccgtggcgtcggtacagttgtcggccatgacgaacacggtgagcagactttggtcataggtctggtgccgtatgctctggatgagatccgcaatgaccgcctcctcatttctggcacaaatcaaaatggcgaagcggtggaggacctctggtttatgaggctcctgcttcttggtgaacggtacagccaaaaaaaacagctggtaggcatagcagcaggtaaagaccaccgctatgacaatgttgatcgtcaagatggtatccattttttaaccttttaacacccttttctttctgtcaatctgtcccgatgggcggaaccggcagcgggcggggaggacccttcttatccctcccgccaggcgatatgcttcttttttcctgtcaatcatccgcccgggaagctccatcggtggttctacggctttctctggtttttccggcaagatgaaaatatgcttgcatggttgcctgcaaatatattttctctattgtacaacgtcctgaaaaaaagtcaattaattttctcttaattttttgtaacagattggccttctccccttccccggtcaattttcctgccctgtttttgaatttttccttgacagccacagaaaaatcctgtatactcccaaatagttagcataagctaacgatcaggaagaacttttttcttcctccgacggaaatccgtctctctttatcatatactaagattccataaatagactgcgtcccttggggcgctaaaaaaaactcggatagttagccttagctaacctcaaaagaaaggagcttctcaatgagtgtcgtcattttaggcggaaacgaatgcatggtccgcaaatacaaggacctctgccggtcctaccagtgctctgccaaggtcatctccaagatgggcgggaccttgaaaaaccggctgggcaaccccgatctgctggtcatgttcaccgacaccatttcccataaaatggtacagaacgccctcaatgaaacccggggccaggacacggtcattgtccgctcccgctccagttccatgtccgccctgggcaccatcctggaggcccacgcgggcgccaagagctgagcctatgtctgtggattatgtgatccagcacgccgcccctaccttggcaggaattaaaacgggcaacctctttccctgcttcttctcctctccccaggccatggtccgggacctccgggccatcaatcaggtcctggttccccggggactccggctgctccccttgcgccgggacaacacccgggtccttctctatctctttcgcccggcggcgctctcccgggatctatcccggggggaggcccgccggctcctccggcaggcgggctatcaggacctggcccaacacgcctgcctccgggagctcaagcggcggctacaggctgggggaacctttcctcatgagatcggcctcttcctgggatatcccccggaagatgtggccgggtttatgacccaccaggggaaacactgcaaatgcgtgggctgctggaaggtctacggcgatgaggccgccgcccgccgccagtttgccgcctataaatcctgcacggccaattactgccgccgcagggcctccggggcctctctggaggggctcacggtggccaccagactgccccaataacgattccaagatcctgccgaaaccgacaaggttcggcaggatcttgctctttttttgtcagccgattgacttttgaagaaagatttcctaaaatgatagtgttaatcttttcggccgcatttttcaaccccatccgcgccgagtttgagaaagggggcaatgactttgcctgaacacaccaatccgcccggaaaaagcaacgccactgccagcttggtgctgggtatcatcgcggtggtcttctggtttttcggctattcctccatcctttccgtcattttaggaatcgtcggcctgatccaggccagcaaggccaaggaactgggatacctggacgccatccgcacggcgggatttgtgctctccctcattggtctgatcggcggcgccctggcctttgtggcctgtgtcgcctgcgtcagctgtgcggggatcgccagcacccttcccctgtaattccttccacctatgccgcggcattcctgccgcggcgccttattttggagctttcgttacggttatgctaccctattggaatcttggcggcactctcttccccacgtacagcctgctgaccctgctgggcgccgctgccgcgtggctgtacttccaccggcagctcaaagcccggggagaaaaccccggccggacagagcaagcctttctctttggggttctgggggcattggtaggcgcaaaatttctctacctgctgctccagctgccccagctgctccaggacctccccctgttggcggccgatccggccgccttttccgcccgctacctctcgggtgggttcgtcttttatggcgggctgttcggcgctctggccgcggtttggctgttctgccggcggcgcaaggtccccttttcccaactgggggccgacctggtccccgccgtccccctgttccacacctttggccgggtgggctgcttcctggccgggtgctgctacggcattcccgcccccgccggctggccgggggtgacctttcgggtctctcccgtggcccccaacggcgtggcgctcctccccgtccagctgtatgaggccgccggctgcctgctcctctttcttctgctgcaccgcctggcccggcggggctggaagggggaggcccttttgctggtctatctggccgcctacgccctgttccgcttcgccctggaatttcttcggggcgatgccgcccgggggatgtggggggtattttccacctctcagctgctggctctggttactctggccgctgtcctccccctcctgatccgccatctccgtacgtacggcaaacagccgcgcctgtaacatacaggccgcggctgttttttgtttccgctcccccgcctcctcttcatcaggagccagcgtcttggaacaggctttcaaaatcgtacgtggagagaaaatcccggaacgcctccatccgagaggcaatctcctgggcggtcatcggctcctcctccagaagccggcgggccagctcctggcatacatcaggggagtagtggatgtggtcgctgtactggtccaggtctgtaatcagggcctggtcatccataaagtaaaacacccgcacattgggccggctgattaacccctccaggaccctctcatgcatggtgagcgtcgcctccagctccccttcccgaatggtcatatcccagaaaaggatactgtacggcggcaggtaaaaggtaaacgtggtctggggatgggcatccacccgggccagaacatggtccaaattctcctgggctgggcccaacagtgcatccgccgccacggcgggccggggttcaggccgctggtaaacccccagcgccacctctctgctccactggacatcgtctccccacaggtatccccctgtcctctcatccgcctggtacccctccctggccgcacgcaggatgtcggggatataccagaaaaaagtatctttactcagcaggtaatgcacatcattgtacaggttttcatcaaaaaggtaggtaggcgcctcccaggtattctccttgtcataccgccgccaacagttggagtccaccccccaaaaaacctgccgcaccgtatgggtttccagggccacgtccaggggaagaagaaaatcctcaaaatatccgccttggacaatgagcttcctcgtctgccctggcagacgctgctgaaagggctccaaggtaaaattggccgtgacagaggtgcccataagcaggtaatcatagtccagattttccgccgcccccacgttttgataccgcccatcctggagccagaggggaagtcccgccactgggccatggtaatgataataggggtccaccacatagattgtcccggcaaacaaggccgtcagcgccagaaagaccgcaaaaaacagtctcagaaatcgtttgggcaccgaatgtctccccctctcagaaattagaatagataaaccggctcacgcccgttagagagatcaccgcccagaacagcagaatccccgccagcacaccgcgccgccctgtcatccgatgctttctccgggccactggcgtctcttgcagacaaaagaacatactccccaccacaaagagcaggaacatgagcagggccaaacgggccatatctatctccaggtagcgtccaatccaggtaatctccggcatctgaaaggaggtggtaaactcttctgccagcggaccgaacgcacaccgcgcaatggcccggcacatggccagcgcctcccggacactgccggcccggaagaaaatccagcagaaattgacatacccaaaggtcagcgcccaggacagcgcagggtggagccggtccagccggctgcccagcaggcggtcggccaccatggcgatcccatgcagccctccccagaccacaaaggaccagtccgccccatgccacagcccagaggccaaaaagatcaccagggtgttgacacaggtccgcggcaacccccgccggctgccgcccaaaggaatgtagagataccgggtgaaaaaccgcgtcatggtcatgtgccagcccttccaaaagccccggatggtcagcgcctggtagggcacatcaaagttctccggcagggtaacccccagcatctttccaatgccccgggccatgtccgtgtagccgctgaaatcaaagtagagctgcaacgtgtagctcagcgtcaccgccaaggccgtggtgctgttgagggcaggcagattggcccagccccagtccgcgccgccgccaaaagcctctgccacaatgaccttcttccaaatccccaaggagaacagccacaggccctcggcaatgccctgggcggaaggtccttttccctggaccgcccgcatctggggaatcacctcgtcatggaaggcaatggggccggaggttacacaggggaaaaagctcacaaagcaggcatactccagcagggtatagtctgccgggtctcctcggtaccggtccaccaggaaagcaatctgctgaaaggtaaagaaactgatccccaagggcagcagcagcgacagcgccccgatggaggtccccagcagccagttgaggttgtccagaaaaaagttggcgtacttaaagtaacccagcaggcctaagttgcccagcagacccagcaccagcagaggttttctggcccggggcagggctcccattgccttaccaaccaaaaagttaaacagaatactccccagcaaaagggggagaaaggccaagtttccctttccataaaaggccaaagacaccaccagcagaaacccttgggccagacgcccatggccccgccagttcagcagccaccaccctgccacagacaccggcagcagggcaaaaagaaatgtgtaggactgaaatgacatggatcgagactcctctccaaaaaggaatggctgcgcttgccgtgccggctccctctattatacagattggttgtatctctgtcaaaaaagctggatttttcgcttttttcctcagattctacttcctgtttcttctgcaggggaaaaaaccattccccctccgcccggcggcgcatcaaccgcagccggtgagaagccccagcaaaagggcaaagacgcagacccccaggcaggccaggaggaaaaggtactgcttcggctctctcattccaacgacccctttctgccataataagacgggagaaatcccctttttgcaacaacattttttctttttctcaaacaatcgccataaaaacgtctctttcgcccccaagcgcaggaaaaaccagcggcccgcccaaaaaagaaaagccaatcgcattgccgcgattggcttttccccatggcacccccgacgcgattcgaacgcatggccttccgcttaggaggcggacgctctatccatctgagctacgggggcacagacatttttattttatcctatgataattggtttgtcaatctactttggacatggccgaatgggacttaattacggaacgtcccccccacgccgtctatactaaaaacagaacagcggcccgcccccccgcaagcgggcgcaaggcatccctgagaaaggagtttttatgggcattctttcgcatctgttctgtatcgacatcaaccggggcgttcgcaactatcaggccacgccgggcgcggtgttgctggacgtccgctcccgggaatcgtacgcgcgcaagcgaatcccggaaagccgaaaccttcccctggaggagctctcccgggccaaagaggttttgcccgatctgtcggtccccctctttgtttacgcttatgggggagagaccagtgcccgggccgtctcccggctgaaggacatgggatatacccaggtccacgatatcggcggcctgaaaaagtgctgcggctcccacgggtattacggccccaccgagggcacccgctggttctcctccccttaaaggcagtctgcgcccccggcccgtggccgggggcgcagactggaaaccgtatccttactccagattcagatgccggtgaagcatccgaatggtgatgcagtagaggatcgcgccataaatggcggagatcagaatactgccccacataaagccgtggatggcggtggctggggtcagagaattgagccagccatccatggaatccagcatggggacccccgcaaagaggagcataccggagacaatctgggtcaccacctggatggcgaaaaagaaggccacagacagcaacattttatgttgggcaaagctatggccgatggccagaggcgtgtaaaactccaggcaggcgaccacacagaacaccaaaaagaggagcaggcactccaccaggaaggccacgccgttgcccacatagtaggcgttccactggtccgcaatctcctggaagaccctacccagctcccagaacatctccacattcgccaccagggccagcagggacaggacatccaccacaaccgcccccaggaaccagacggcggagacaatcagctttgaccacaccagggtatgggtggacaccggcagggtgaacatcacgtatccctcgtccgccattagattgctccggaaccggaggatggccaggatcaccgccaccacaaaggtggcaatcagcgccaggacaaacccaaaaataatgatcccggacagcagggccaggaagttgcggcccagcatcccgtcaaaggtcaccatctcggcccacaatgcggtggcgcgggtgagcaccgccagcagaacggtaatcaaatacaggggaatcatcacccgggctgtggcccggaactcatgtttcaacagttttctcagcatttgtatacctcccggaacagcgcgtccacgctcatgcccttctcctcccggatggcgtccaccgaggactggaggagaatctgcccccggtcaatgaagagcacctcatccagcaccttctccacatccgcgatcaggtgggtggagatgatcaccgaggcctcagggttgtagttgcggatgatagtgtccaaaatatagtcccgggccgccgggtccaccccgccgatgggctcatccagcaggtagagcttggcctggcggctcatggccaggatcagctgcaccttttcccgggtgcccttggacatgtgcttcatccgctgcttggcggagatctccagccggtccagcatctcctcgctgcgctcccgctggaaatccgcataaaaatcctcataaaagtcctgcagctgcttcacggtcatccaaaggggaaggctggtccgctcgggaagataggagaccatggcgtggctctccttccccggcgcccttccgttgatccaaagctcccccgccgtggggaccagcaggccgttggccagcttaatcaaggtcgtctttccgctgccgttggggcccagcagacccacaatccggcccggttcaatggtaaagctgattccgtccagggcggtcaccgccccgaagcgtttgctcagccctttacactccagaatgctcatggtgtcccttctctccttccgtctgtacaaatgtgacgatctctcccagctggaaccccagctggtacattccctctaaaaagtccttcacctggttccgggccagggactcccgcaggcgccgaatccgctccccgtcctcggtgacaaaccggcccgcggtgcgctggctgtaaaccagctcctctcgttccatctccatcatggcccgctgcatggtgttggggtttacccctgcctccgcggccaggtcccgcaccgagggaagccgctcccccggcagcagggcgccgctgacaatcctctgctggatctgggcaatcagctgggtatagatggggatgtcattgcgaaactgccacgccatatccatccctccttggtggtgttcatctgtgtcgctgtactgttgtactgcacgaataatacaataacacattttctccatttgtcaagcccctttttcaaaaaaagtgaaaagaatcaggcgggaagattgtcctgcctgtcccccgcccctgaactcccttccgccgcccggtctcccagggccgcggcaaaatttatccttgcaatcctttatttacaatagtataatagatagccgttgaattagcgtccgtttgaattttcgatagatatgaggtgcgaacctgtgcagaacgaatcactgagaaacatcgccatcatcgcccacgtggaccatggcaagaccaccctggtggacgagatgctcaagcagggcggcgccttccgggagaaccaggaagtgaaggaccgggtcatggactccggggacctggagcgggagcgcggcattaccattctggccaaaaacaccgccatccaatacggcgatgtgaagatcaatattgtagacaccccgggccacgctgacttcggcggcgaggtggagcggattctgaaaatggtcaacggcgtcatcctcctggtggacgccgccgaagggcccatgccccagacccgcttcgtcctctcccgtgccctggacctgggccatcgggtgatcgtggtcatcaacaagattgaccgccccgaccagcgcatccacgaggtcatggacgaggtgctggagctgctgctggacctggacgccacagaggagcagctggactcccccatgctcttctgttccgcccgccagggcatctgttcccgggaccccgacgtgttggggaccgacctgcagcccctgtttgagaccattctcagctatatccccgccccggaggcggaggcggacaagcccttccagatgctggtctcctccattgactacaacgagttcgtcggccgcatcgccatcggccgcattgagcagggcaccatcaagcagaaccaggagatcaccgtctgcaactaccacgaccccggccagagccgcaaggccaaggcggtgagcctctaccagttcgagggtctggcccgggcgccggtcaccgaggccgccgccggcaacatcatcgccatgtccggcatcggggacatcaccatcggggacaccatctgcgccgccggcctggccgagcccctgccctttgtgaaaatctccgcccccaccatggagatgaccttctcggtcaacgactcccccttcgccggcaaggagggcaaatacgtcacctcccggaacctgcgggaccggctcatgcgggagaccttaaaggacgtctccctgcgggtcagcgacaccgactccaccgaggccttcaacgtggccggccggggagagatgcacctgtccatcctcattgagaccatgcgccgggagggctatgagttccaggtctctcccccccgggtcctctaccaggagatcgacggggtgaagtgcgagcccatggagcgcctggtggtggacgtgcccgccgacgcggtgggggcggtcattgagaagatgggctcccggaagggagacctgctggagatgaccccggtgggtacccggatgaagattgagttcctggtccccgcccggggcctgttcggctaccgcaacgaattcctcaccgacacccggggagaggggatcatggcctctgtcttcgactcctacgccccctataagggggatttgagccgccggagctctggcagcctcatcgcctttgaaaccggcgagtcggtcacctacggcctctgggccgcccaggagcgaggcgccctgttcatcggccccggcgtcccggtctacgggggcatggtggtgggggaaacccccaagagcgaggacatcaccgtgaacgtctgccgaaagaagcagctgaccaacatgcgggcctcgggctccgacgaggccctccgcctggtgccgccccggaacctgagcctggagcagtgcctggagtttctggccgatgacgagctgctggaggtcaccccggaaaacctccgccttcgcaagcggattctcaaccacgaaatccgtatgaaggccctgaaggggaacaaaaaatatcagaacctataacaagaaaccggcgctgtggactgcacagcgccggtctttttgtgtggtatctgttgtgtcttaggactcacccagcatgactgcatagacttgggcagcattcccgccccgcttctcctgtacctccggggtgttgtagcccacgggaatcccgtagctggtgcacaccttcaccccggcatcataggccgcctcttccgtgtcctgctcagggttggcggtctgccagtccgtatagaccttcttgtgggtgttgcgcagctcatagctgatggtgatcccctccgcctcctggacctgggccagggtgatggtgtccgccccgtccgccgcttccagatagttttccagcaggcgcttgatccggttgtaggaggtccactgcatgcagcccaggccgaagcagcttccccggccgttggcccccgcaggacccagctccaggaccatggcatagacctcctggagggagatgccctcatagatcagccggtaggaatacttgtcccggtagtcgtaattctcatccatgtacaccagatagtcgggctcggcgtcggggttggagagataggccgagctttcaaagcggccgcagtccccctcctctatgatgttgcccaaaagcccggccacaaaggcgggggcaaacccatcgtccagcagaacctgggccatggccgccagggtatcccttttccgcagggaggaattctggaggtttcgcaccatctcctggtggctcaccgggccatcgggcatcaccgtctcgcagaaccgggtgaggatcaccgccacctgggcccgggtggcactgccccgggggcttaacgtggtgtccgtggtgccggtgatcagccccgccccgcaggcccaggccagcgcctgggtggcatagtcgctcacctgcgccgcgtcctggtagagccccagatcagtccaggcggacacgtcccatccctggtcctgggcatagcggtaaaagatcaccgccagctgctcccgggtgatgggggaattgggggaaaaagtggtggcgctggtgccgttgacaatgtcccgggacgccgcccaagccaccgccttggcgtaccaggccccggcggccacgtcggtaaactggctggccgttccgctggccggttctcctgtcagacggtagagcaccgtcacaatcattccccgggtggtggtgttgttgggggaaaaggtggtgctgtctgtgccgcccatcaggttgttctcataaacatactgcaccgcgtcgccggcccagtgcccctggggcacgtcggtgaagggatgctctcccgccgccagggccgtgccggagaaaagcgtcagggccaggcagagggccagggccgcgcttaccattcgttttctcatactgcgtagtcctttcttccgtatgatgcctgattataccagaattcttccctgctgaaaaggggaaaaacggtctgttttgcaaggagttccgccgccaactgcaaaagcccccgccagggggcgggggcttactgcgccgtagctgcttcagggcagtggctcaaaagcaatggggtctcgctccgagatatattcccggtattcctcggcagaaatgacggtgcttcctccgtcagaagtgtgaatctcatagtatatttgggagtaatcctccgagtggttcgtcccaatgctctgttccatttgcaggctgccattgttgagcgtgtaatagccataatttgaaatggcagttgtccctacatagtaggggcgcagatcggtgaacacaagcgactgatattggggggaatacatcagttccccgtaacaggtttcgacttgtttaggcgcgttgctttccgatgtcccatctgccaaaggtacaatgaccacctgtttagtgcgtgcatcatatgtgaagactgagaaattatagaaatcatcgtagaacgtgtcaaagtaatttccctgaagaatgagctctttcattccgtcttggttcagatccagcagcgcatactccgtgggctgataaaaccagtcatccagatagtccgtgtagccctgctcagccaaaaaccgttggtaggcctgcttccagcccgtgtccggcaccgcctggccggtgcgggtgacggaaaagcgggtgggagactgaccggacaagacctcgccctgtaaggttccctccaggtccaacagccggtaaccggagggcttctccacccactggtccgcgtcaaaacggaaggccccctgatcggtcacagtcacatccatcgtataggagccctctttggcattggtccggccggggagattgtaaaagtcaaaaagggcgcggtaaccgccgttttcctcatagacggtcagagtcaggcccgtctccccctgggaggcgaagtaggagccctcgtagacgcccaccaggtcctccaaagttgtcttttctggagaaatgatttcttccagcgtcacatcctctcggtacagtgccttaacctcgctgttatatccccaagtgtcggcacttccatgcttttccttcgcatactccaatgcctgagaaatcgtataatatgatccctgctctgtgcgttgggtcagtccttccgcaaaggagtacagcatcttgaaattatagatttgacgcacagtacgggtgttgcctaaaatgacctcggcccctttatcccagatactctccgccaaccgacggtctgcaaagctttggcaggttcccaagtagatcaggctacccgcaaaggcatcctggggcatgtacttttcaaaaaagataggagaaatataaaactggccgttctggttcaccaacagcgcctcatccccaaactcctgggcatagagcagaatcgttgactggtcccacttcttcgtccccaaaaagagaacggaacctaaacgatccacatagtttccgtgccctgaccacaggataatgctgtgctggggaaggttttttagggtatctactgaaactgcatctccatcataattgtgttgataggtcagcgttggtccaaagctgtcctccagatcttctgctgcttggtcgggccctttccctcctgctaacagataagacgcatacatctctccaggaaatggctccagggtaatgatttccattccctcctgtccgccggccatcatcccttcctccggtggtgcatagaggaagcccaaccatcctcccactttcatataaacacacgtgtcgttgacctcatagttggttacggttccttggttttgtagctgctctgcataggcagcaacttcctgcagcaacggttctaacttttctcggggaacaaccccatccgtattttcgtatttcctctcgatctgacgggtttctgccgcaaccgtctcataggcttctatggctgcttcctccggagattgggggctcgcattgacggtttgctccaaccgcataaaaatcgtcgcggcctccgcccggttggcggtgcgctggggctggaaggtgccgtcctcatacccggccaggatgcccgtctggcgcatgagctccacccccgcctcggcccagtcagacacggcattccgatccgtgaagggagccgccgggtccccggtctcgggcagggggaggtcggcgctgtctacatagcgggcgatcatggtagccatctgctcccgggtcacagggctattgggggaaaaacagccgtttcctgtgccatccacaattccttccccagcggcccaggccacataggcactataccaccggcctgccggcacatcggcaaacccactctcgccactctcctcctccgcgccggccatccggcccaggatggtgacaaacatagcccgggtcagactgccgccgggctggaacattgtggcgctcaccccattcatcaggtcattttcatagacatagcccaccgcctcgttggcccaatggctctggggaacatcggtaaaggggtgctgtcccgccgccagggccgtgcccgacaacagggtcagcatcatgcacagcgccagggctgcggaaatcactcgtctcttcataaacctctctcctccctcgagcgatataatgatgtttaattataccaaaatttcaacagaatataaagcacttttctcttcctcttacagattttctgcaccaaaaaggggtgtcctgttttgcaggtatgttaaagtgcaaaagcacctgctctttttgtcacaccaaggttttttcgaaatttcgctttactttccccccgcccagtggtatactacaagatacgtgcgtactgcacgcaatctaccctgacttagtcccgggagtaccgcctggtttcagggccacacccgcccgtcactcagtcagaggcaaactttggaaaggtggaaataaaccatgattcgcaaggacgaaaagaccgccgttattgaggcaaaccgcacccatcccacggacaccggctcccctgaggttcagatcgccatcctcaccgcccggattcaggagctcaccgagcacctgaaggtccacatccacgacaaccacagccgccgcggcctgctgaaaatggtcggtaagcgccgcaagatgctggactatctggccaagaaggacattgagcgctatcgtgcgatcattgccaagctgggcatccgtaaataattccgtctgcgacaggggcggtgtggccaaaaccgcaccgcccctttttcccaacccccgcgcggagagctccccgccctattttagcgtttgaacgtatgcccgaggctcggacatgccttcaagtgctaaatcaggcgcaggctctccggcccattttatgatacctgcgaaaggagtctgcaaccatgtcaaccattatcaccaagaagcaattcaacaaccacatttacaagaccgagattgccggccgccccttctccctggagtttggaaaggtggctgagctggccaacgcctccgccatggtccgctacggcgacacctccgtgctggtggcggtcaccgccgccccccggcccagagacggggtggatttcttccccctgtccgtggactttgaggaaaagctgtacgccgtgggccggattcccggctcctttatgcgccgggaggggcagccctctctgcccgccgtgctggccagccgggtcattgaccgctccatccgtcccctcttccctggagacttccgcaacgacgtggtggtcacctgcaccgtgatgagcgtggaccgggactgctctcccgaggccgcggccatggtgggcgtgtccgcctgcctggcggtgtccaacatcccctggggcggccccatcggctgcctggaggtgggctatgtggatggtcagatcgtcatgaaccccaaccaggcgcagaagcacgcctccaagctggacctcaccgtggccgccaccggcgccaaggtggtgatgatcgaggccggggccgaccagctccccgacgagatcatgtatgaggccatcgtgaaggctcacgaggagatcaaggcccaggtggactttatcaacgccattgtggccgagatcggcaaggagaagatgacctacgaccacgccgacttcgaccaggagctctttgacaagatcgtggccgccaccatggacgaagccaaggccgccatggacaccgacgacaaaaatgtccgggaggagcgctggaacgccctcatcgaccactggcacgaactcttcctggaggagtatcccgagatggatcagtacctggaagagatcacctataaattccagaagaagattgtcaaagcctggctcctccaggggcaccgggtggatggccgtcagaagaacgagatccgtcccctggccgctgaggtgggcgtgctgccccgggtccacggctcggccctcttcacccgggggcagacccaggtcctgtccgtggcaaccctgaacaccctctccgcctgccagaagctggacaccatctgggaggaagaggaaaaacgctatatgcaccactacaacttccccgcctactccgtgggtgaggcccggggcgcccgcagcgtcaaccgccgggaaaagggccacggcgccctggcggaacgggctctggacccggtgatcccctcggtggaggagttcccctacgccatccgggtggtctctgaggtggtttcctccaacggctccacctcccagggctccatctgcggctccaccctggccctcatggacgcgggtgtgcccatcaaggccccggtggccggcatctcctgcggcctgatccaggacgacgacgggtccttcaccaccttcatcgacatccagggcgtggaggacttccacggggagatggacttcaaggtggccggcaccaaggacgggatcaccgccatccagatggatattaagaacgacggcctctcccacgccatcatcaaggaggctctggacatcaccggcgacgcccggaaggccattctggacgagatcatgctcccctgcatccccgctccccggcccgaggtcagccaatacgcccccaagatgctcaccatgaagattgaccccgataagatccgggaagtcatcggctccggcggcaaggtgatccagaagatcaccgctgagtccggcgccaagatcgacattgaggacgacggtaccatctatatctccgcggaaaatgccgcctgctgtgacgcggccaagaaaatgattgacaccatcgtctttgtccccgaggtgggaatgctgtactacggcaaagtggttcgcatcctgaacttcggcgcctttgtggaactggcccccggcaaggacggcatggtccacatctccaagctggctgagcgccgggtggaaaaggtggaggacgtggtgaacatcggcgacatggtgtgggtgaaagtcaccgacatcgacgaaaagggccgggtgaacctctccctccgggacgcccagcgggaaatcgccgccatggaagcccgggacgccaaaaaacatcaaaattgatgggagcacaagtcccatgaatcagctctggaaggccgctggcgcggcggcatggggtgccgccgcgctgggcggcctccagccgtttctgggcccggaggcggcagaacagctccacaccctctgtcccggggcccagaccgtgctggtgggggcctttccctactacgccggccaggcccccggcaatctctccctctactgccggggggaggactaccacctggtcctgggccggcggctggagcaggtctgcgccgggctccgggcccgccatcccagccatacctttgtggccggggcggacaactcccccgtgccggaactggccgcggcggagctggccggcgtgggctgccggggccgccacgggctgcggatcgtccccccctacggctcctatgtcttcttaggcaccattctcaccgacctggtcctcccctccaccggtccgtccgcggagaccctctgcccgccccactgccgggcctgtcaagcggcctgccccaccggcgccctgacggagcaggggtgtgaggtcacccgctgcctgtccgacctgacccagcgcaagggcccgctcccccccgaagccgccgaacaggtacgccgcagccccacggtctggggctgtgacctgtgccaaaaggcctgtccccacaaccaggccgccgccctgacccctctgccagagttccgggaggacctgctctgctcccttaccctggcggagctggagcccctcagcaacaaggctttccggcggcagtatgcccgccgggcgttttcctggcgggggattgggccattgcgccggaacctggccctcaaggaggagacagcgccagccgaagaggaggaccgcccctcctcttgagaccgccgctttcccggtcagcttctcccaggacgtcttttccgtgtatatccgcctgggattccgcccaaactatgggaaacggaaacgaggtggttttttgcaagtgcgtgacattatgaacccccatgtggtgtccattgatcccacggagagcgccgccctggcggcccggctgctggcccggcacaacgtggggtccctgccggtgtgcgggtctggggggcagctccaggggatggtgacggaccgggacattgtgctgcggtgcgtggccgccgaggaggacccccggtcggtgccggtgcgcagcatcatgtcccggcggcccgccgttgtcaccccggaggacgacgtgcgccaggccgcccgcctgatgtccagccagcaggtccgccgcctgccggtggtggacaaggaccgggtggtgggggtggtctccctgggggacctggccaagtgcggccgctatgagatggagatttcccgggcccttaccgacatctccgagaacatccgtcagccctgaaccggggccgcgggggaaaacaacagtccctcccgcggccccggtttccttacgcctgctccaccagggtacggatcttacaggcctggtcccaggcctccctggcgtgctcccagaacaactgctggaggcaggggtccgtggtggtctccgtgccggtgagataggcggccatggtggcctgctcctgggcaaaccgccggcggagagtccctaagtacgaagtcaccggcgggcacttctcccc

SEQ ID NO: 2234 - DNA, 48057 bp, KLE1738
tacgcagaggaggcggtagacttcccctggcggtatcttatcggaccgtagcgtcaccagcgctgcggtccgtttctttctccagcgcccagaacacaggccgggcgcgcagcgccaggcacgccgcaagaagcccagcccccagcatcactgcccaggcgtggtccgccaatccctcaaacagcagaccatagaccgcctgtcccaagggttgggcgcagttggccgtagccagcaccgtggccatcacctttcccaacagatccggaggggtctgcccctgcatggcggctaaaatcgtcacggtaaacagggtggagacccccatcaccagaaaactcagcacagtgatcaacccatatcccacgataggagaaaccaggggcagaagggcaactcccatgaggaccacccctccggaggccaacagcaacagcagcgggctgtggtgaagccgaagtcttgcccccagcccgctggccagtaagccccccatcagtcccccgagacccaaagccccctgggtcagtcccaattgagtatcggacccatgcagaagctgcaccaccataatgggaatgcccacaatgatggctgcggagagaaccaagttaaacagcgccaaaagaagagtaacccgtaggaaattcggtttctcccgccccataaaacgccagctctctgccaaatcccccttcacggtccggagcagactgtccgtccggggacggccgttgtggggaatccgaaggaaacactccatgacagcggaggcaaaaaaacacagggcactcacaaggacaatgggatacacgccaaacgcgccaaataaaacgccaccaaccaccggccccaagaggccagccagggtgctgaccatattgaccaacgcattggcctgaaccagtccctcctccggcaccaacagcggcaagctggcctggacagaaggctggtaggccccggaaataccgtagagcagcatcagcaccccaatgagcagcgggaccagcggcaggacctctaaggccagggcaagccccaccataagcagggatgtggcaaagtccaaggccaccataatgtttcgtttgttcacccggtccgcaattccgccgcccaggaaggaaaacaccaccatgggcagaaaggaacaggctgtaaccaccccgaaaagggatggggaattggtctcccgcagcagatacagcggcagagcaaagcggacaatggcgttgccaaacagagaaatcacctgccctaacaccagaatgatcatatctcgagaaaaaatttgcttgagtttcatcgtgttacctccattttaataccgacggtcggtttgtaaagtcccaaaaataaactgctctgaacggagcagtttattgggattcccctcaaattccacggctgtccgccacgaaagagtcgatcaaatcttcctccagcagggtccccaggccgcagccctgggtgatttgattaaacaccacacagcgggcccgcatttcctccggcgttgtggggcggctgatcggctggagccaaattcccatcagcaccataatcgcctcccccacagcctgaatgtccgagacctggagggagccgtctgccaccccctcctccaaaatcggctgaatatactccgggacggaaatgtgaagaatctcctgcatctgcatggccaaatagcgtggatggtccagaaggtagggcatgatatgaaacgcctctttttgattgggatgaagaatggctgatcgaaagattttcctgagcttttcttcccccgtcaacgcggcgtcatcccggatctttgaaaggcggatttcattttcctggccaatctggttgcagatcgtttcaaaaatcgcctcttttgaggagaagtggtgatagatcgcccctttggacaggccggtttcccggataatatcctggagtgatgtcttctcataccctttctccaaaaaaagcttggaggccgtggtgagaatgcgctgcaccgtctcctctgggtgtttgttcctggccatagacgcgcctccttcccattaacataccgacggtctgtatgtaaattatcacgtttttctcctgctgtcaagaaaaactgttttccttctctgttttttccaatgtgttccctgcctacggtttattaccatctccttcctaaaaatgaaaggggggcagatatctctgccctcccgtcataccgccgcattaaaaccaaaggatcgtctgctcctggaatacaggcgccgaaccctgttcgtagggatcgtatcgcttttcattgcagccaaattcctgcagacgctggattcggccctcgctgctccagaggacgtaggagaccccttcaaaagcctgctcggtcccgtcgtccatccggcagtgaaaccgccaggtcaccatggtctcctgcgcccggtgaaaacaggcccccatgtcccaccggaggactctgccccgggtgttccattcggtaaaccagtgcttgatcttctcaacgccctgatactgggggccccagctttcaatatacagggcatcctcctgaaacaaggccgcaattccctggtcttttccctccagccacatggaaaaccagcggcgaaggatggcttcccgttcctccatgttttctcctcctcacgattccttggtcataaactgggaggccgctttcagcatcatccgcttggtccccacattgtcgaaggccacctccagcagcgcgtctcctcccatggactgaacggtgagaaccatcccggttccaaacgccgaatgccggaccatgtctccctttcgaaggtccagcatcggctgggctttgggcgccggcttgcgataggccgcaggcgccgcccgcgtgcccgagggccaagcgggctgcggcgcagccggcctttgcacctgagaaaaacgctcctccccagaccatccggtatctgaaagcagttcctgctggggacgccgaatctttccgccggcctggacccgttcagcgggaatttcctgcacaaagcgggagggcaaattcgccgaggtccggccaaaaagcattctctgggccgcgcaggtcagatagagacgctcttttgcccgggtcagcgccacatagcaaagccggcgctcttcctccaattcctcttcctccccaatggcccggaaccctgggaaaaccccctcttccattcccacggtaaacaccacgggaaactccaggcccttggccgcgtgcatggtcataagggtgacgcagttgtccgcctcctccacactgtccaaatctgtatacagagccacctcgtccaagaaccctcccagggaaggatcttccgcgtgctccagatacccgctgatggaggaggacaactcgtgaatgttttccaaccgggacttgctctcgtggtctgtcttggccgaaagcatctctccatagccgctggcctggatgagcgtttcataaaatgtaggtaagtctacctcctccgccaaacgctgcatggagcgaatcaagtccacaaatgtctggaacttgggcgccgccttcttcagggcgggaatctgcccggcattggagagaacatcccacaggctccgtccctcctgggccgcgattccccgggcatgttccatggtctttgccccaattccccgaggcgggttgtttaccacccgaagcagacggaggtcgtcctggggattgtgaatgacgcagaggtaagagagcatgtccttcacctcagcccgctcgaaaaagcggaagccgcccaccacccgatagggtatgctgttgcttttcagcgccatctcgatctggttggacagggcattcattcggtagagaaccgcacagtccctccactgcttcccctccccataggcgcggagcagctgcgtggcaacgtacatgccctcctcccgttcatttccggcggtatagaactgtactttttccccctccccatggtcggtccacaggttcttccctttccgcccccggttgttccggatcaccgcgttggccgcttccagaatgtttcccgtggagcggtagttctgttccagacggatcacccgggcattttgatactcctgctcgaaggagagaatgttctcaatggtcgccccccggaaccggtagattgactggtcatcgtctcccaccacgcagatgttcttctgcccccctgccagcagggctgccaggagatattgcaggtggttggtatcctggtactcgtcgatgaggacatagcggaatttccgctgatagtacgtccgcacgtcgtcaaacccctggaggaggcggacagtgtggagaatgatatcgtcaaagtccaatgcaccggctgcccagagttttttctcataggccagatagacattggcaatcttttgcagccggaaatcccctttggccttgcactggtccagatacgcctgggccaaaagcatctcatcctttgcccgggaaatataccccagtaccgtgcggggctgaaaggccttgtcgtccatattcagctccttcaggcactccttgatgacccggagggagtcgtcggtatcataaatggtgaaggaggcgggaaatcccagtttctcaatgtcccgccggagaatccgcacacaggcggaatgaaaggtcgccgcccagacgtcccgggcatccgggccaatcttttcctccagccgttgtttcagctcaccagcggctttgttggtaaaggtgatggcgatcacctgccaaggggcggcgggctccagggcgcacaggaggttggcccggctggtctcccattcatcgggggccgttttctccacatactccgccaaaaagcggacatcttcctctgtgatatggtcgggtacctcctgggcatctgcgcctctgccatagcgcagcaggttcgcaatgcggtggatgagcaccgtggtctttccactgcccgccccagcaagcagaagcaaggggccctccgtggtcagcaccccctccaactgacgggggttcagattaccaaacgcctgggcaatgacccggcgtcgcagtgcagcaaattgtagttgtttttcttcagacagcatcgtgattcaccgtatctttccatcattcgatgggcaatattgtacctgaaaccacgacgttttacaactgaaaatccccctattccgcctccctccacaaaatttggttgctttcatcccctgcaatggggtagaatagggatacttaaaaccagcgcgcaggaggaccggatgaaacgggtaagacaatttttctctcgatatcgaagcggccttcagcgggccggcgcggtgttgctggccctggccgtatggcaggggcttgcaatgggcgtaggccagaaactactggtcccctctcccctgtccgtagtggaacgcctggggggaatctggcaggaggccgacttctggggcacagtgtggttcacctttcggaagatcgtggcgggtttcctgctggggctggggttcggtctgggcctgggggctttggccgggcggtttccactctttgagattctgttccgtccctgggccaccatgattaagtccattccggtggcctccttcatcatcatttgtctcatctggatgtcctcctcccggctgtccatttttatctcttttctcatggttctgcccattgtctataccaatgtgcttcaaagtatccgcagcgccgaccggcaactgctggaagcggtgtccatcttccggttgtcctggcccaagcgggcactctacctctggcttccccagctcaagccctaccttctctcggcctgcacagtgagcctgggcatctcctggaaagcggggatcgcggcggagatcatcggcattcccgccgggtccatcggccgaatgttttacgatgccaaggtctatttcaacacagtagatctctttgcctggactgtcatcgtggtggtgatcagcgtgctatttgaaaaaggattcctggctcttttgaagggggtctttgggaggttggaaacgctgtgacagatctcatcttagaacatatcagcaaacgatacggagaccatgtcgtccttgaggacttttccgctcggtttcccgccgggcaatgtacctgcatcatgggtccctcagggtgtggaaaaaccacgctgctgcggatcatcctggggctggaacagcctgaccacggcaccatccagggacaggtccgccctgtgtccgcagtttttcaggagaaccgcctcttcgaggacttttccgctctctccaacgccgctgtggtctgccccaaaggggaccggcaggaggccgcccgccacctcaccgcactggggctggcggacagcttatccctccctgtccgtgccctcagcggtggaatgaagcgtcgggtctccattgcccgtgctgtactggcccccgggccccttctggtcctggacgaaccctttacagggctggaccgaactaccaaagcggtggtattggattacttgaaacgctatacccaggggcggaccctgcttctggtcacccatgacccggcagagcgggatgcattggcccacagcaccttacagatgccgtcccagataacatgaatgaatattcataccggtttcatccactgggaaatatattccttttattccgtttccccgtatcccgctttttctccctggaattctgccagaacagacaaaatccgccctgcggcacctgaggcggctgccgctgggcggattttttgaacgggaaggcgatttattccttgcgctctccctctcccaaggaagcaatctccgcgggatactccccctcttccataaaataggtccggtaaccatctgtcaccaacgagtgcttacccaatacccggaccagcctttgactgcgcaaggcgatttcctgcgccacgtcaggaatggtctgcccgtttttggagacgctctctgcctctcccggggtcatcatcgtaacttggctgctctgaagagacagaccactgcggggaaagaccatttcctccggcgtggccaggaagaaatcctcccgcaccaggcgaatcccaatgtccgccaccaccagccggccgaccttccatacagcctctcccaagaacataccagctttcagatagccgatggtcaccgtgaggtccgacctgaccaccaggtcccctttccctgtgtccccattcataccgctgttgatatccacactcaccacataggctttggcccgattgatggcctgaatggcctgttgaaacgccccccgcacgggcccagaaaatccggttcccaagaggcagtccaccaggatgtcgtagcgggatagatcctccccctcagaaaatcgcttccgctccacccctttttccacagcctggtcataataatattttccatcctcagaatagtgctccgagacttggtacaggcagcagggcacagaatggtccgccagaatgcccgccagggcatagccgtccccgccattgttgccgctgccggtgaaaatggcgaccttcttcccctgccagttcaccgcctggtacactcccatggctgcccggtacatcagttctctgctgggtacatataacgcaatggtatgggcgtcactctcccgcatggttgccactgtgatgacgtctttcatctcttgccatccccttttctcctctgtgggtattttttctattataattgatctgatagaaaagatcaattcccttacgcacaaaaatgggaatcctgtctttttcccttgcaaacgttccctatatttagtataatacgtgtttgtaaacttttcttatcggcagatacaaggaggatgacacaaacattatgaaccaatcccaacgacagaaagagcccatgagcaaaaaggccaagctctactgggccattggcatcatcattgccattctggtcgccgcgcttttgatctggcacaccttcttcttcgggaagcagaacgccaacgcgaccgctgccactgtgggcgaccagacatacaccaccacggaggtctcctactactattactccgtcgccaacgggttcacccagcaggcgcaagcctatcagcagatggggatggatatgggctatgacccctccctgtccccctcggagcagacctacaacgaggaggaagggaccacctacgccgactacttcctggagcaggctttggaccagctccagcaggtgtccatcctgtgccgcgaggcagaagccgcgggatacacgctctctgcagagggcgaacagtccattcaggacaacatggacgcgctgtacacctacagtgtgcagagcaatgccggctcggaggaatcctatctccgcatgatctacggccggaacatgaccaaatccctgttcaaagaacttctgaccaagtccatcctggccgatgaatatgccgctgtcaagagcgagtccttcacctatactgacggggagctggacgattattatgacgcgcacgccgccgatctggactcctatgactaccgcttctgttacatcaacgctgaattcgaggacaagacggacgaggatggaaacaccgtcgagcccacagaggaggaaaccaaggccgctatggacgccgccgctgagaaggccgacaaaatgatcgcagaagtccggggcggcaccgcgttcaacaccgcagcacaggactatctggatgagacctccgccgagtcttacagtgatcccgagtataaccacaagaccggtgatctgggcagcaccgtgacctccacctaccgggagtggctcaccgacgacagccgtcagccgggagacctgacttccattgaggtagagaataccggctactgcgtggtccagttcctgggacgggaaaaagataccgacagctaccagactatgaactaccgcagcattcagattctggcagagaccacccccagcgaggatggctccaccgccctgcccactgaggatcagctggccgccgccaaggagcaggcccaggggctgctggatcagtggaaagcaggagacgccaccgcggattccttcgccgccctggctaaggagaacagcgccgatgaaaccaccaaggaaaacggcggcctccatgaggatgccaaccgggacagcctggatgccgccctcaccgactggctctttgcccaggggcgtcaggttggggacaccactgtggtggagagcacggacagcagtgggaacgtcaccggctaccaggtgctttacgtggagagctttggcgagatccagtggaagtaccaggccgccagctccctgcgctcggaagactacaaccagtggtacgaagacctgcaggccaaatatcccgcagagctcaccgaagagggaaaggccatccccacactgtaaccaccttccccgcggaggcataacgcttccgcggggcttttttaggaggcatccccatggatcatgaacaatttctccgcacagaaatgctgctgggctcccctgccatggagcggctccgccagtcccatgtggccgtttttggcatcggcggcgtgggaagctggtgcgccgaggctctggcgcgggctgggatcggccagctgaccttggtggaccacgaccaggtgggactcaccaacctgaatcgccaggcggaagcccttcactccacccttgggctggagaaaaccgccgccatggcccagcgcatccaggacatcaatcccaactgtatcctccacttgatacccgaaaaatacgaggcggcgaaccgtgaccagttcttccgtctgccttatgattacatcgtagacgccattgatctggtctcctgcaagctggatttgattgagaccgcacggagccgctccattcccatcctctcttccatggggactgggaataagctagacccctcccaattccgtgtggcggatctctcccaaacccaaggctgccccctggcccgcgtccttcggaaagagctgaggaaacgggggatcctccaccacaaggtggtgttttcccccgagctccccgcccccaccacccagggggaggcacccccgcccggccggcgctctgtccctgccagcgccccgtgggttcctcccgtggcgggctttctgctggcaggcgctgtcatacaagatctcattgcagaataaaatggcccttctctggcaaactatgccggaggagggcttttgctttgaaacgatcaacttcttggattcccgccgccatggccggcggcgcagcgggaatcgtcaacggattcttcggcggtgggggcgggatggtgctggtgcccctgctcatgtctcgatgtgccctggaccggcggcatgcctttgccagttccgtagccatcatctttcccctgtgcgccctgtccgctattatttactatacgaggggccatctggacctgatgggggcactcccctacctggtcggcggactcatcggcgggctcatcggcggaaaaatctttgaaaaaatccccgtggtatggctgaagcgggcctttgctctgctgatcctctacggggcctggtcggcgctgcgcggatgatgggttggctgatcgccctgctggccggcaccatcacaggaattctctccgcctttggcattggcggagggtccctgctgctcatctatcttacctccttcgccgccatagaccagcaccaggcccagggaatcaaccttctgtatttcctgccggccgccgccgccgccctgccagcccaccacaagcatggtcttctggacaaaaaggtgatcctccccgcgattttagcgggcttggccgccgccggattggctgcctggctttccagcagtctggacacagggctgctgcgaaaactctttggcctctttcttctgtatgttggcctgcgggaactctttcacaaggacccggaccagtctgaaaaagatgacaccaaatgagaaagccggggtgacttcaggtcaccccggctttctcttcccatcatttgcatttccgctgcgatgacatcaatttacccctgtggcaaaacgtcgctatctgcaaactgctgctcatggattctattttttcggatgagaagcacgctgatcagcatggcaatgatttgagataacggcactgaaatccaagtgccatctacactgcccatagcattggggagaatgagaagcaaaacgcagagggtcaatggttccccataaatcagaacgtaggcccagaggttttttcccatggcataaaaataagctgtggtcactctggatacactgacaaagacaaagccaactatgaagatcggcagaatttgcgcaacgcgtaccgccactgtttcagaggtcccaaataaatatgccgcgttgccccgcagaaggaaaaggatgacagcgcagatagccgcaacgccaaaagcaaaccgatacgccagattccgcaccgttttggttatatggtacttcccctccccataggcaaggctgatcagcggctggctgccgtcgctgaccccctgcatgagcagcataaccactgaggaaatataactgatcggtgcataacaagtcacagcaatcgttcccccaaaaatcacggcgctcttattcagcaggatcaacgtgatattgggcgaataggtcaacccgaaaggggaaagtcccacgcctaagatacgggacgaaagagagcgcccttctccaccgaaatgaaaggatggggcgtgcttctttacgataaaaaatacaaggcataccaaaaaggtcatcgcctgaccgattgccgtggctatggcggcccccatcattccccagggaagcacccatacaaacagataatccaaaacaatgtttgtgataaagccggtcaccatagcagccatagcggtgaccgcccctcccatattgcgaatgaaaggaaccagtccggttcccgcaatttgaaagaccgccccgtagctgacaaagcgcagatactcactactgtactccagtatctcaccgcttgcaccaaatgctccaagaatccggggaccggcaagcaggaacaggacggtaaagagaatgctgcatccgcccagcaagacaatggacatgcccatatactgttttcccctgctttcatgcttacttcctgcatgaatcgcgtactcaatcgcgccgcccatgccgatgcctgtcccaacggcctgcagaaaagccgtcagcggaaaggcaatgttgaccgcggccaaggcatcgtctcccagcgcgtttcctacaaagaaaccatcggcaatcgcatagattccagacagggcaaaggcaagcatagaagggattacatatcgaaaaaattctcttcggatgtgcattttaatccccgacctccctaaaataccggttatagagagccgtgtattcaatcagctgttccgcccggtccacctccaaccggagccatacccgcgcctcatgctcctgaagcgattggacgatttgtgccgcctgttctctcccttcagccgtcaaacagagtttccggctccttcggtcctgttccgaaacttccagttccagccaccccttgtctgccaaggttttgataatggcatgcacagtctgctttggaatcgtaaaacgccggcaaatgtccttttggaacaccgcttcttcagtttctgtaatagaaaggaccaccagcagctcataaaacgagagtccccgtcttcgtgcccaggtttcatacagctggctcgtttccatccataccgcattgtaccgagcgcttagttgacgcaaatgatccataattcgcctccattagtccaatttaggactaattatacggtgagatacagcattttgtcaagccctctgccctcgccggaccggccccccaaaaggccgccttttgccggtgacctcacctcccgcgttataaaaaattcccgtaagtgaaccgccatgggagaaaaaagcgatacaaaacgctggacatggttttctcaaccatgtccagcgttttgttctcatctacctgtatttacgtcgtttcccctctgtctcacaaaaaacctgtttacaacccaaactatttggaggatgacaccaccgttttgttccgcttatggaccatatgaatcccaaacagcgtcagcagcatcagcacaatggcaatggggagggcaatccacgccttgggcagaaatcctgcgatcacatagctgacaaagctcaccgccgccactgtgatggcatagggcagctgcgttgagacatgattgacgtgatcacactgagcccccgccgaggccataatggtggtgtcggagatgggagaacagtggtccccgcagaccgcgccggccatgcaggcggaaatgcacaccacagacaaggggttatccatgggaaacacactctgcacaatgggaatgagcatcccaaaggttccccagctggtccctgtggcaaaagccagcaggcagccaatgaggaacacaatagccggcaggaacatctggacctgggaggcgttgctgtaaacaaagtcccggacaaaatacttcgcgcccagagaatccgtcatcgctttcagcgtccaggcaaaactgagaatgaggatagcggggaccatggccttgaatccctctggaatgcaggacatcatactgctaaacgacatggagcggcggagcccaaagtaaatcaaggagaagaccagtgcaaaggcagaccccagcagcagccccaccgaggcatccgacgcagaaaatgcctccacaaaccccacaccatcaaaaaatccgccggaatagagcatcccggtgacacagcagagaatcagcagaacgatgggcagaaccaggtccatgacccgtccgtggctcacatcctcttccacctccatggtatcataaggattctttccagaaaacaggtccccagactccatcgcgttgcgctcataccgcgccatagggccatagtcgattttcagcagggaaattcccaccatcatcagaatggtcagcagtgcgtaaaagttaaaagggatggcccggataaacagattcagcccctggccgtcctccgcaaatcccgccaccgccgcggcccaggaagaaatgggggcaatgatacacaccggagcggccgtagcatcaatgagataggacagctttgcccgggaaatccgatgcttgtccgtcacaggacgcatgacgctgcccacggtcaggcagttaaagtagtcatcaatgaagatcaggcagcccagaataatcgtggccagctgggcgcctacccgggacttgatatgggtttgcgcccaccggccaaaggcggctgaaccccctgcccggttcatcaggcacaccatggcccccaagatgaccaggaaaatcaaaatccccatattgtatgtatcagataccgaggccacaatcccatccaggaatacgtggcggatggtcccttcaaagccaaagttggcgtagagcagtccgcccactacaatcccaataaagagggaggaatagacctccttggtgattaaggccaatgcaatggccacaatggggggcagcagtgcccaaaacgtgttgtaaaaatggctgggagactccacatagcccgtcccctggcagctgggacatacaaaggttcctccgcaggcctcacagctggcatcctgcccatagcaagtcatgcataggccggtgctgttacaatccgcacacgcaatcatcttgctgcctggttcctctgtggggtcttctcccgcagcaaaggcagtggcgctcatggcaagcaccaggaccgccagcacagccagcaggggaagcagccgccgtcgatggtttctcatcgttttttctctctcctttctataaaaaaagccatgacgctgtcatgacttcacagaatgggaaaccacgacagccctccgcccccttggggcgacagtctgagggatcttatcccacagcccggcttcccagaaggacaggccccctctgaaaaacctcggcagacacgcctttctccctcccaccagcctgggtttccaggaggcatactcttcgcgcccgcacctctatcatgctatgtctccttatcctatcatttcctgcaaaaatgtcaatcctttttacaaaagtctattcttttgccccgcaggtgaaacgggctacccaatttttcagaatgggtgtacaatagagaaaatcttttgtgtgggagaagcctctatgaaccaaaaagaactcaacgaaattcgccgtcacctctccctcaagcggtgcggcatccataagatttatggctgttttgtcagcagcggcaaagagatcatctctgactttcaaacctccttcggtctcatgagcgagttcgaggcagaaaaatacctgtctcttctcaaaaagacgctgtccggtacattgggaaagaacctcctggacctctccttttccacccagcaggtggttgacagcccagagcacaagcgcctgtccgccctgcgaaacactcagttagaggagcccagtgccagagcggccttcttccagtcggtgatcgcctctctgtccctgggagacaccccttacctgattctcttggcccatgacgtctatgacgttccccatcgcggcggagacgacgaactgcaggccgacgcatccgatcaggtcttctcctaccttctctgtgccatctgccctgtcaaggaagaaaagccagaactggcctacgcccctggggacaaggtcttccgcacccgggggatcagccagattatctccccgccggagcttggattcctgttccccaccttcgaccagcgcgcagccaacctataccatgccctgttctataccaaacatgaggaagaaattcatcaggacttcatcgacgagatttttcacacagggcctctcctgtccgcggcccagcagcgggaaaccttccagcacgctctcacggtttccctcaatgagacctgcagctacgatgtcattcaaggggtacacgagcagtttcgggaacgcattgcccagcacaaggagagccgagacccagagcccctggacctttcgattcgggaggtgggcgccatactccaggagagtggtgtgccgaaggcacaaattgaggcctttgaagagacctgtatccaacagttcggagaaaacgccgcactctccccctcgaacctcatcgacagcaaacggtttcaggtggcctccccgcagctgaagatctccattgatccagagagtagcagcttcattgaggccaggattctccatgggcggaagtatctcctcgtccctgtgaccgatgaggtcgaagtcaacgggattcccattcatttcccggaagaggagccttgctgaccattgcagccctttcccctctcaggcgccctattcaaaaacagaaggaacaggaagatccggccagatcgcgggccggatcttcctgttcctgttttagaacttccacaccccaatctggcctgtaaaaaagtctatcgcacaacgttctcaaaggataatggatctctctgttttagtcagatctatactaatttacttatagtcacaaaaaaatgtcatagaaatcgtgttatcttttaagatgtaccatcaagattccattttctcttctatcataaaaccatcttttaatgaaaaggtggttctatatgacaaaaacagagtctacaatccggttcctcttcggagcctcccgcaaggacattcgtcccctggtccacgccgtggacatcaccatcaaactgatgttttcccagggaatccccatggacgacatccgtgtcacccatgcggtctatccccaggtcgccaaaaggctgaaaacgcgttccggtgcatctccctctgccaagacaacggcccggcggatacagcggctggccaatgcgtgctgggacgccctcgtggaaagaaatctggtaaaggaatttcttggtacttccctccgcgatcttcaggcacccagagacctcctcttctacttggctgccttttcccacttagggattcccttctttgaggcagtcaagcgctaccccgagctgctcttttggcccggacaatggtgggatgacaaggcagaaacccacccccatacttgaacccgttccagctatatgatatcataagcgcacagcagacagaaagaagggattcccatggaaaaacgcaaccaagcccagctccatgcaaagccagtacaccgcgacagttgcatggagtaagtacggtcgcagaaacaggctggctttgctgcttgatcacgaactgcaaggaggaagccccctgtgaaatacatcaacgcaaagtttcttctccctgacgcgctggtaaaagagctgcagcattatatccagggtgggtatctctacatacccacagaccagacgcagcaaaaatgctggggagaaaaatccggctaccggcaggaattgcagcagcgaaactgccggattcgagcggcacgtcggcaaggcgcctcgctggagcatctggcagagcagtactgtctgtctatccatgccatccggaaaatcatctaccaaaaataaccgacggggatcgcgataaggcggtccccgtcttttttatacaaattggttcggcacgatttggtagatagaaacccaataggagccgtgataccctggagaaaatcccccggcttgcgccgagaaaggaacccttcatgtgcattcgatttgtatatcgtggcgacgacatcatcaccggcttcaatttcgacattgacccggccgtatgggaccatcagatcgtcaccgcgcccgaccgcttctaccttggtattctgcggcccgacgggctgcgccacggctatcacggggtccatcaaaatggaaacacagggaccctgctctatgtccacggcaacccgtcgggccgataccaggcaggctccgacgctctgaccatctccgatctgaccgagcaatttattcaggcacagatttcctgggaggaagccctctccatcgtacagaccaaaaaaattgtctatgcgccggacgccaccatgcaggctgtattatccgaccgctacggacgcacactgctcatcgagcctggaatcggcagccgggtagataccggaacctattccctgatggccaatgcctctctactatccccggagagtacccgtccctggctcctaccgggagacaaccgatatgagaaagccgcccagcttctggccaagcagggccgccgcttttctgtctccgacgcctttgccatcctccgcgctgtccggcaagaggggctgtgggccaccagggtctcctttgtcttttccgccaagcaacggacggttttctatgcagagaattcccatttcgattccatccaaacctatcagttcccgccagtgtgagagaaaggagcccctatgcacccagagaaacgctacccccgcacaggagaccgggagacggtctacctgaagcaggtcattacaaatcccaacattcgggtgggtgactttacaatgtaccacgatttcatacacgacccacggcagtttgaacaaaatgcggtacggtaccactaccctctcaaccacgacaaactgatcatcggcaagttctgctccatcgcctgtggtgtgcaatttctcttcaacagtgccaaccacaccaagaaatccctgtccacctatccctttcccctcttttttgaggaatggggcctggatatccgggatgtggcctccgcctgggacaacaagggggatatcgtcatcggcaatgatgtatggattggctacgaggccatcctcttagccggcgtcaccattggggatggggctgtgatagggacccgcgccttggtaacaaaagacgtgcccccctacaccatcgtaggcggcacaccggccagggttcttcgcaaacgattttcagaggacaccatctccgcgctgctacgcctgaaatggtgggactggccaatagagcacattcaacggtatattccagagatacaatccgggcaggtccaccccctgctctctgcacatcccgaataaaaatgtgccgcaggaccagatgtcctgcggcacctctgctttcttgttggttggcacttactcctgcgccgctccgtccgcagcggcctccggccgttcacagctggtgataattccaccttccagctcaaaggtcgcggttttcacaatatgggacttgcccacacggatttcctgggttcccagctcactggacaggttgtccttcacggtaccctcaatggtaaagaccaggttataggtcccggcatccacctgtgtcagggtctcaacccctaaattcgcattccacatcatcgcataggtgtcatgctccaccggggtcgccgtgacatcggtcacagacgcatccagcagttcattggccgccatcagctggctggggagctgcttctgaataaattcatacacctccggctccacgcccttgacctccacggtatataccacagcctgtccctctccagccaggccgccggggcttcggaccaggagcttatagccaatcaaagccaaaaccgctacaatgagaaggatggcaatcaggtcaatgatattgagcttgccaaaaatcttccctttcttatcaatcatgctcatagggtacctccattgcttgaccattctttcaaaccactgtataataacatattacattatattctacaagtcttttttcggaggatctcccatgaaagtactccatttaatcagcggcggggataccggcggcgccaaaacccatgtccataccctcctggccgggcttacgccgcggattcaggtaaaaatggtttgttttaccgaagggccctttacccaggaggcccgggcactgggcattgacaccgaggtaattcctggccggaacttcttcgccaacctgaaaaagctgtctcacatggtgcaggaagaggggtttgacctaattcacagccatggggcccggggcaacatgatggcggctttcctgtctaaacggaccggcctccccaccgtgtccacggtacacagtgattaccgtctggactacctggggcgccccctctcccggctgacctatggtaccatcaatacactggctttgcggaagctggactaccggattggagtctctgacgccatggtagaccttctgatctcccgaaagttcgacccggaacgcctgttctctatatacaatgggttggattttaccccccgtaccccagccatgaaccgggcggaatacctccgttccgtggggttggaggcagacgagacctgcgttgtggccgggatcgccgcccgtctgaatcccgtcaaagacatcgccacactgattcgcggctttgccaaagcccacagagctttccccgccctgcggctgctcattgccggagacggggaggagatggccaacctaaagcaactggcggcggacctgggcgtggccaaagcagtctgttttgccggatggatctcagacaccgactccttttacaacgcgctggatatcaataccctgacctccatctcagagaccttcccctacgccttgaccgagggagcccgggccggtctacccaccatcagcagtaaggtgggtggcgtctcctacctgattgaccacgggtccaacggtttcctcttcccgccaggagaagaccaagccctggcggatcatctgctcaccctggcccgggaccccgacctgcgcaagaccatggggcagcgcctatatgaaaaggcaaaaaaggaattctctatagaggccaccgttcagcggcagctggaaatctatgattccattctccgctatgagaaaaacggccgagaccgggtggtcatctgcggcgcctatggccggggcaacgccggagacgacgccatcctgctggccattctcacagagcttcggtccattgatccggatctctccttccaggttttttcccgtaatcccatggaaacccgtcagacctaccgggtcaacgccttttacaccttccacatctggaaagcgatctactatttcaagcgggcgaagttcttcatcaacggcggcggttccctcatgcaggatgtcacttcgtaccgctccctgtggttctatctgtggaccttggcaaccgccaaacactatggatgccctgtcatcatgtatggctgtggcatcggccccatccgaaacaatggaaaccgggcccgggccgcccgggtgatgaaccgctcggtggactccatcaccttgcgggaccccgactcgctgaaggaactggaggttctgggggtgacagagcctaagattgccctgtcggcggataccacagtgagcctgccccccgcttcccctgatatcatcgacggaatcttggacagtcggggcatccccgccaatggaaactatattggctttattctccgcccttggccaggttttgaggaaaagaccaaagacattgccgctgccgcagattatgtctatgaaacctacggcctcacgccagtgttctttcccatcgagcctcgcttggatgtggcggccgcccagcgggtgatccactggatgaacgccccccattacattctgacagaggcctatactgccgcccaaaccatcggaattctctcccgtatgaaggtggtcacctccatgcgtctgcatgggctgatcttcgcagctgggcagggtgtccccttggtcgggatcgtctacgaccagaaggtcagttccttcctctcttacattgggcaggacctttacgaagatctaaaccgcctgaccgcagacaagctgaagtctctgattgacggcgcggtttcccggggaaagaacccggcgcttctgtctgaaagcgtggaaaaactgcgccggatggatgaagtcaaccgaaaggtcctggaggagtacgccgcccagaaaaagaatccggctgaataagcgcgaagcgttcgccccgttccgggcgaacgctttttctcttctgtctgaagaaataaaaatagccagggcagagatgcgctccgtcctggttacttttatcacttcaaaggttccttctgtgcataggccgccaaatccgccaaagccccttgcattccctccacatcttcctgggcctgggaaaacgcggcccggacggaatccaactccgtctctgccgaaaagagggaggtatgcagatcctctttgaggcgctggcagcgggcttgcagttccaaaatccaccgaaccccctccgcccgaatttccgccgcctggtcctgggcagattggatgatcctctgtgcccgctcgtgggcagaaacctcaatgtctcccgccgtgtccttaatccgccgccaggattctgcccctggctccaggtcattgaccttctcccgaagggcagccacctgggcttcggcctctgccagcgccgcggtgatcttttcctgggcctgcctgctctccgccagggtctgttcgaatgcctcccggtccgcaaccgcctccgcagccttgttttctgcctgctgggctcgcgcctctgcctgggcacgggcagcctgttcctccgccagggcttgttccagcgcctgcttctgcgtctgattttcccgggtgatgcgctccaaatagtccaggacatcctggcggtgaaatccaccgaacgccgcgctccggaactgccctgtattctcgttcatagtgcttcctcctaccaaaggaaccgattctccccttcacagaacccatcggcagagtccggggagcttctatcatctttgccccttatcttaccataggatatccgccaatacaatcatttttcccggaaaacctcggcaatctccatatttcattgacgggagtggaagaggatgatataattttttatcgcttgtatgggctgcggccttccagccgcagtttatttccgcagaaacgactgcgggaaaacaccggccccagcagggccaggaagagggagaatggacatgtgggcgtcaactggttggaaagactatgagctgctggactgcggcaaaggggaaaagctggaacgctgggggtcttataccttagtgcgtcctgatccccaggccatctggaataccccccgccgtcaccctggctggaaacgctacgatgcccgctatgcccgctcccatacgggagggggacagtgggtcaaaaaggatctgccccagcgatggcaggtccgctatggggccttgactttcaatattaaacccatgaacttcaagcacaccggtctctttcccgagcaggccgccaactgggactttgccatggagcagatccagcgggccggccggccggtctccgtattgaatctctttgcctacaccggcgcggccacccttgcctgcgcagccgctggggcctctgtctgccatgtggacgcggcccgggggatggtcagctgggcccgggaaaacgccaagagctctggtctggaggacgcccccatccgctggattgtggacgactgcgccaaatttgtggagcgggaaatccgtcggggccggcgctatgacgccgttattatggaccccccctcctacggccgagggccctccggggaaatttggaagctggaggagaacctatacccctttgtggagctggtcaccggtgtgctgtccgaccgccccctctttttcttaatcaactcctacaccacggggcttgccccgtcggtgctgacttacctgttggaaacccttctctcccgccgatatggcggcagcaccgtcagtgatgagctggggcttcctgtcacccacagcggcctgatgctcccctgcggcgccaccggacgctggaccgcagagggaaagtgaggaacaagccatggcaaccatgatcaaagccgaacacctgacattttgctacccagacgagccggcagatcatccgccggtactggacgatgtcaatttagaaatcgaggccggctcctttgtggccattctggggcacaacggctccgggaaatccaccctggccaaacatatgaacgccctgctgacgccaacggcgggaaaactctgggtggagggcttggataccgcagacccggaaaatctcctggctgtccgcggcaaggtcgggatggtctttcaaaacccggacaaccagattgtcgccagcgtggtcgaggaagatgtagccttcggcccggaaaatttgggggttcccccggcggagatccggcagcgggtggacaccgcgctccacatggtggggatgtatgacctgcgggagcactccccccatcttctctccgggggccagaagcaacgggtggccatcgccggcatcattgccatgatgccacgctgcattgtgctggatgaggccaccgccatgctggacccagtgggccggcgggaaaccgtggacaccatccggactttgaatgaaaaatacggcatcaccgtgatcctgatcacccaccacatggacgaggccgcccaggcacagcggctgatcgtcatggccggggggcatatcatcgacgacggtcctcccactgaggtgtttcagcatgttgacaccctgcgaagcgccggtctggcggttccagaaacggtggggctgctctatgagctgaaaaaggagggtctccctgtccccctggatgccatccgcgatgaggactgcgccgccgtactggcgggtcttttgcaataacatcccgtttgcaaggcaaattgtgaggagtaaaaggtttggaaccaatcattgaaatcaaaaacttaacccatatatacagccccaacaccccttttgagcagcgggccctggattccgtgaacctgaccatttatcagggggagacccttggcatcattggacgcacgggttctggaaagtctaccttgatccagcatctcaacggcctggtccgtcccacctcgggtcagattctcttcgagggacaggatatctggagcagcaaggaactgacccacaccatccgtttccaggtggggttggtttttcaatatccggagtatcagctgtttgaggaaacggtgtacaaggacattgctttcggaccccgcaacatgaagctggacgaaggcgaaattgaccggcgggtgcgtcgggctgctgcttttgccggtctgcgtgacgaagttctctcccgctccccttttgagctctccggcggccagaagcggcgggtggccattgcgggggtcatcgccatggagcccaaggtcctcattttggacgagcccaccgccggtctggacccggcgggcgccgccagcattctggccaatattgagacctaccggcaggccaaccacgccaccgttatccttgtcagccattccatggaggatgtggcccgactggctgaccggctggtggtggtcagtcaggggacccttccctatgtggggacccctcgggaggtcttttcccacggggaagccttagagtccatggggctggctgtccccgccatgaaccgggtcttttcccgggtccgggccatgggagtggacatcgacccggcggtctacaccgtcgagcaggccaaggcggccattctggacgccttacggaagaaggggggacgctaagtggcactgaaagacatcaccctgggccaatattttcccggtcattccttcatccaccgtctggaccctcgggccaagatcatctttaccgtggtctatattgtcgctatctttctgtgcaaggctttggtctcctacggtttggctctggtggtcctgctcctcctcatcgccatctcccgggtgcagcccaaggttttcctaaagggaatgaaacccgtcatcttcattgtgatctgtaccgccctgctcaaccttttctacacctcggggaccgttctctggagtttcggcatcctcaagatcacagaggagggaatttggaaggccggtttcatggtgctgcggattttgatgctgatcgcctgcacgctcctgctgacctacaccacctcccccattctcctgacagacggcctggaacggctgctgcgtcctttgaaaaaggtccgcttccccgtccacgagctgtccatgatgatgagcattgctctgcggtttattcccactctgatccaggagaccgacaaaatcatctccgcccagaaggcccggggagctgacttcgacagcggaaacctaatgcagaaagcgaaagccctgatccccatcctcatccccctcttcctctcctcctttcgccgggcagaggaactggccatcgccatggaatgccgctgctaccacggggacgaaggccgcaccagcctgcgccagctgaccatgcacgggcgggactggggctttgtggtcttcagtgtgctgctgtgcgcggccatagtggtgctgcgctgctttgggctgtaagggagggattcggatgcgcaacattgctttgacgctgatgtacgacggcaccgcctaccacggctggcaagtgcagaaacgggatgtcaccgtggcggaaaccctggaaaaggcgctggcccacgtagtggggcatccagtgaaatgcaccggtgccggccgtaccgatgctggggtccacgcagaacggtatgtggccaatttccgcaccacttcctccattccctgcgaccggattcctctggcggtcaatacccgcctgccaggagatatcgtggtcaccaaggcaacccaagtgccagaggacttcaatgccatcggcagctgccagcggaaagaatatacttaccggatctataattcccgcattcgcaacgcctttctggtcaaccgggtgtggttctaccccaaacacctggacgaagaggtgatggctcgggcggcccagcattttgtgggcacccatgatttcgcctgtgtccgctctgtgggaacggaaaccaaaaccacagtccgtaccgtccactacttcaccatcacccgggagggagatatgatctcctgccgggtctgcgcggacggctttctttacaatatggtccgggccatggtgggaacctgcgtctacgcctcagagggaaaactctcccccgatgacatccccggcctgctggaagggcgcaaccgcaccgatgccggccccacagcccctccgcaagggttgtatatgaccaacctgtggtaccccgttcccaacctcccctaagcattcccagaccccccagccccaatggaggtgtgctatgaataagctgaacaagctgcaagatctcaaaacaacactgacgcagaagcagcggatcatcctgttggtggtggcagttgtggtcgtccttggggccctgactgccacagtttttcgggacaacgccgccagcttcctgcgctggatgacctattcccaaaaggacgacgattttccccacaacgcccagtccaacagcctttttctgggcatgggcgatgacctgctgatctgcacccagacccaaattcagttggtctcccccacgggaaccgctcgtctgaaggagacggtcaacatgagttcccccgccctcaacgcctcgggagactacgctgtggtgtatgatgtgggcgggcaggaactgaacgtcatcggccagggtgccctgctccacaagctgtctctgtcggaagaggagtccctgctctgcgccaccgtcaatgaaaagggctgggttgccgtgaccagcaaggtcagcggatataagggggttgtcacggtatacaaccgggattttgaggccgtcctcaccatccgtctgtccagccgctatatctccgacgcagtggtcacgccagactgccggggtgtctacctgatctctcccggtcaggcggagggcgcttttgaaaacaccctcctctactataccctttcctcccgggaagagcccacccgcaccatctctctggggtctaacgtggtcctgtccatccgcagcgccggacggtgctggattttaggggacaagagcctgctaatcctggattccagcggagtaattacttcctcctatgactatgacgaccagtatctgaaaatgggctccctacagggcaatggctttgccacgcttttcctctcgacctcttcctctggaaccgcaggaaccctggtgacggtggggaccgatggaaagccctacggagagctggccctggacgggcagaccctcgccctggcggcgcagggacacaaggttgctgtgcttaccaccagcgaggtcatctccgcagaccgcaagttggacagctacaccaccagccccaaccagcgcggcgtccgcaacctggccgtttatgaggacggcagcgtggcgctgatcaacagcgccgccgtgagcctctacttcccctccaacggcaccaaagtggaccccaaggcagacagcagtgaggggacttcgtaatggaactcaccgtttccctcctattggacctggtgattctggggctactgctctactgtctgatccagggccttcgccggggcttcatcctcactctctgctctctgttggccgttttgctggctttcctcggcggctggtatctggccacccacgccgcccagcccctggaagagaaactggaaccggtcattctccatgccatgctcgcccaggaggaatcggaggccgcagattccccggagcagacagacttaccatcccaatccgaacaggccaacccatccgagaatggactgtttcatcgctttccccaatccctccaggatcagctgacccagacaacagaggactggaagcaggcgactcgtgccgagctggctgccgcggcagctgggcttttggccaggtctctgctgtttttggccggtttcttcggcgttctgatcctctggctcattctctgccacactttgaatctggtggccaagctgcctgggcttcacctgctcaacaaactgctgggggggcttctggggctgatcaaaggcctgctcctgctgatggttgcccgctggattctctgtgacctgctggggtggattccggcgtccattgcagcggagagccgcctgctccccctcctctcctccttttccatcttctccctgctgggaggataactttccaatcattcacatctaattcataaacccatgttaggatagcatactactaaatcatgacaccccacaaaggagtgaacccgcctatgaaaccaacgctgtgcagcagatgcaaaaaaaatgtcgccgtggtctttatcacccggctggacaacaacggacagggaggtcagaatgaaggtctctgcctgaaatgcgcccgggagctgaatatccgcccggttactgatatgattgagaaaatgggcctgagtgatgaagatttggagggactgacctctgaaatgatgtcggcctttgaaggggccgaaagcatggaaggcctgctgggcaacctgtccggcgccctgggcgacgcggcgaacagcagcgacgacgacgaggaagaagacggacggactgccaccttccccttcctgaacaagctcatgggaaacttggccaaccccgatggggagaaaaaggaggacgcgctgcccgatgtctctccccaggccgcggatggcggccgcagtgtccgcgaggaaaaaaccgagcgcaaaaaccggaccaagcggaaattcctggaaaatcactgtatctccctcacccgaaaagccgcagagggaaagttggatcggatgattggacgggatcaggagctggaacgggtcattcagatcctcaaccgccgccaaaaaaacaatccctgcctcatcggagaacccggcgtgggaaaaaccgccattgccgaagggctggcgatgaaaatctatcagggtgacgttccctacaagctcaaggacaaggaggtctacctgttggacttgacttccttggtggcgggaacccagttccgcggccagtttgaaagccgcatgaagggactgatcgaggaaatcaagaagctgggcaatatcatcctggtcatcgacgaagtccataatctggtgggcgccggggatgccgagggctctatgaatgccgccaatatcctcaagcccgccctgtcccggggagaaatccaggtcattggcgccaccacactggtggagtaccggaaatatattgagaaggattccgctctggagcgccgcttccagcccgtgatcgtcaacgagccctccattgaggatgccgtggagatcatcaagggcatcgccccctattacgagtcctttcaccatgttaaaatcacccctgacatcgcccgcctggccgtgctcatgtcggagcgctatatcaccgaccgctttctgccggacaaggccatcgacctcattgacgaggcctgttccgatgtcaatctgcgggacaaaaatctggcccgcagccaagaggtccaaaaagagctcaacgacatcgctgttgagcgggaggtcatggtcgctgatgccggggaccgggcgtatgagcgcctggcagaactgcggagcaaagagctccagcttttacaagaacagcaggaactgagccggcaggaggccccttccctgactctggagagcctgtcccgcgtggttgagctttggaccaagattcccgccagcaccatccaggagcaggaatacgagcgtttggccaagttggaagaccgcttgaaggagcacgtcgtcggccaggacgaggccattgccgccgtctccgccgccatccgccggaaccgggtgggggtcacctccaaacggaaaccggtgtccttcatctttgtgggctccaccggtgtgggaaagacagaattggtcaaacggttggccgaggatctcttccatgcaccggagtccctgattcgcctggacatgtctgagtttatggaaaagcactccgtctcccggatcatcggctctccccccggctatgtgggctatgatgaggccggtcagctgaccgagaaaatccgccggaaaccctattccgtggtcctgtttgatgagattgagaaggcccaccccgatgtcctgaacattctcctgcaaattctggacgacggacatatcaccgacgcccagggccgggtggtcaactttgaaaacactgtgattgtcatgacctccaatgcaggcagcgacagcagcgcaggaccgctgggctttggaaagaccgccaatgaactgaacaaggacaaggccatgaaggccctgcagcagttcctgcggccggagtttatcaaccgggtggatgaggtcatctgcttcaaccagctttcggaggagaatttccgcgccatcgcccggattatgctgcaggagctgcaggaggttctgcaggaaaagaatctgacttttacctgggacgaaaccgtgctggatcagttggtgaaggattcctattctgccgcctatggcgcccggaacctgcgccggcacattcagaagagcctggaggaccccattgccaccaaaatcatcgagagttatctccatcccatcaccgcgttaaaggccgtggtggagaatggaaccattgtcattcacgctttgtaataccgcacaaacgccccgcatacctttcccgtgtgcggggcgtctgtttgcatgcttacctatcagcagcgaaaaagattcccctgggtgcgtcagcatccagaggaatcttttccactttatcgttgttatcgttgggtgcccaggaaaaaaagcgccagggttcccaggccggagtgggcgccaatcacagggcccacatccccaatggtgacagagaccacgtgcagtcgctcttggatcatcgccgccaaagcccgcgcctcgtccagacagtctccatggctgatgtaaatgcgttgattctgggggtctatggcactctcctccatgtgtttgagcagtgcctcaatggactttttccgtcccttggccgactccatgggcaccagatgcccctggtcatccacgtggagcactggtttgatattgagcaggttccccacaatcgccttgccggcggaaaggcgcccgccccggcggagttggctcaaatctcccactgtgaaccagtggcacagatggggaatcgtctcccggacaaagtcccggaccgcttcaatgtccttcccctttcgcttctcctgcaccgccaagtccaccaaaaggccctgtcccattgaggcacacagggtatccaccgtgatgaccttggcctctggaaattcctcctgcagttcctccgccgccatggcgccattgtgataggtcccgctcagtccagaggaaaaacccaggtacaagacgtcctttccctgccgcagaaagggcaaaaagcagtccttgaactcctccacattgggcgcagaagtctgcgccggttctcccctgctcagacgggtataaaagacatggctctctggggcctcgtccgggcaatttcggaacctgtcctcccccagctggacagacagtgggatcaccgtcaggtctaagtctcggatcagatcctggctgaaatcacagcaggaatccgttacaattacatactctctcatggcagccgactccttcctcttgtttttcttttacccagcgcagcagttggtatacaccgcaaaaaactgcagaactgtcccagccaaaacaaagaaatgccaaataccgtggcgatagggtttctccttctgccgatagaaaataacccccacggtataggccacaccgcccagcagaagcaggcacagcccttccagcgtcatgtttcgccaaatcgtaggaagcgccaggattcccagccaacccatgacaatatagaggaccagggagacctttttccaacgcttcaagctgaccgcgttcaggacaatgcccacaatgccacaggccaaattgatgccaaagatggttaacccaaacgtgccccccactgtaatcaggcagatgggcgtgtaagtccccaggatcagcaggaaaatggaacagtggtccaatatctgaaaaacctgctttcctttggaccggggcagcgcatgatacagacaggagatcaggtacagaaggatcatggagcctccaaaaatggccacgctgatgatattcagcaggtccccttcctccttcgcccgaagaaccagaagcaccgtgccaatgacagccatcactgccccgatcccatgggaaatggcattgagcacttcttcgccgatgctttggcggcgggcggagccgccgggatacgccacggattctgtcatggtccgttcctcctttattgattttcaaatcggtttatcttgttttctatattaagaataccaccgaaccattcaaaagtcaacactatattataattcatactgaattatcttgttctctatacaagcaatgtccaatttttataaaaacattctctacccaaaggtttctccccacaagtgccctggaacatggagccccgcctttggacgctccactccctctccaggaaagtccgattgtctttttacccgatgcaatcccaaaatcacgctcctttttcaccactcctccaaaagaacgaattcctcttgacttttttggtggagccttttatactcagcataaggaaaatattatacttttataataatattttgcatctttactatacagatagagtgaggattgatgtttcatgcccatgtatcagcctgaaattgagaccatgtcccaggagcagattcgcaaactgcaaagtgaacgcctggtcaagcaagttcgccatgtctatgacaacgtcccgtattaccgcgctaagatggaggaaaaggggatcaccccggaggatatccacggcgtcgaggacctccataagcttccctttctcaccaagagcgacctgcgggacgcctatccttatggccttttggccactcctctgcaagactgcgtccgtatccagtccacctccgggaccacaggccggcgcgtggtggcgttctatacccagcacgatgtggacctctgggaggattgctgcgcccgggccattatggccgctggcggcaccgcagaggatgtggtccatgtctcctatggctatggtctgttcaccggcggtgccggcctgcatggcggctcccacaaggtgggcagcttaacgctccccatgtcctcggggaacaccgaccggcaaatccagttcatgtgtgatctgggctccaccatcctctgctgcaccccttcctatgcagcttttctggcggaaagtgtgctggagcgggggctcaaggatcagatcaagctgaaagccgggattttcggcgccgaagcctggtcagaggaaatgcgccaggatattcagaacaagctggggatcaaagcctatgatatctacgggctcaccgagctctccggtcccggggtctcctacgagtgcagcgaacagaaaggcatgcacatctgtgaggatcatttcatcgcggagatcatcgatcccgataccggcgaggtgctcccggacggcaccaagggggaattggtgttcacctccatcaccaaagaggcctttcccctgctccgttaccggacccgtgacatctgcgttctggaccgtacgccctgctcctgcggacgaacccatgtacgaatggccaagcctatgggccgctctgacgacatgctcattatccgcggcgtcaacgtcttcccctctcaaattgaagaggtgctcctgaaggtcagcggcgagaacatcacacccaattatcaaatcatcgttggccgggaaaataacacggatacactggatatcaacgtagagatgagtgagcagatgttctccgatgatatccgctccgtggaaaccctggaaaagaagatcgtctcccagctgcgctcgatgttgggcatcggcgccaaggtccatctggtcaaccccaagaccattgcccgcagcgagggcaaggcccagcggatcatcgacaaccgcaaattgtaaggaggcagccctatgttaatcaaacagatttccgtattcattgaaaacatgcccggcaagctgggtgaggtcacacaggttttaggggaaaacggcatcgacatgagtgccctctccctggcggacaccacggattttgggattctccgtctcattgtcaacgacccggacaaggcctgtcaagtgctccgaaaccacgatttcattgtaaagcagagtgacgtggtggccgctgtcatcgacgaccgtcccggcggactgaccgctgtgctgcaaattctctccggcgcccaggtttcggtagagtatatgtacgcctttgtgggcaaccaagacggccacgctgtggtggtgatgcgaaccgacaacgcagagaccgccctccaagctctggaggacaatcacgtttcaaccctggacccaaaagatatctaccgactgtaatctgtcggccagcccgcctccccggaaaaggggaggcgggcttttttcttgacagagggctgatatcgttttacaatattataaaacgatatcaggaggtgctctatcatgcccaaaaaatccatggagaacctgaccgagtccatgctctatgtcctcatggctttccactgccggcccatgtgcggcatcgaggtggctgccttcctggataccctgaccaagggccgggtgcagatgggaccggccaccctgtacaccatcctgggaaagtttgaaaaggagcactatctccaggagatccacgtagaagggcggaaacgcacctatcggatcacggagcgaggagagctggcctacgctcaagaattggagcggttgcgaacctgcctggccgacgcccagcggcttccgccccctgccatcccccagccggagagcccggtgacagaccccacccccacccccacccatgcccctgcctgaaaccgcaggcggctgcccccacagaaaggagtgtcccatggcgacaaaaacaaaaacccgcagatggattccctgccaatcctatgacctggaagccatggagagctggctggaggaaatggcccgctgtggctggcggctggagcaggtgggctgttttggctgcaccgctgcctttgccgcggccgcgccccagatggtccgttaccgactgacctctgccatggacgcagacaccttcggcacggaggcgtggctggggccctccgaggagtcccgctgcctgtatgctgcctatggatgggaatacgtggccaaacgggggcccttttacatctaccgtacccgggacccggccgctcgggaggtggacacggacccccatacccaggcactggtcctccgctccctccaccggcgggcgcgggagagcttgctcaccctggttctgctctttttcctggtctatcccctgacgctgaactggtgggagatattgcgtactttgtggcagcacgctcccgctgccttcctgctctacctgatcctgtttctgtggataacggggttctccctggctcgggcccgccattaccgctgcctgtgccggcagctggaggccgggcagagcctggaccacgggatcccctggcgtccccgggcccgccggtatcggctggtcagcgccctgcacctggggctgctggcggcctgcctggcagtcgccgtgtggctcaggctgggctgatgagggattacagctcccgcttaattttctggatggcgtttttctccaggcgggagatctgggcctgggaaatcccgatccgagccgagacctccatttgggtcttcccctcaaaaaatcggagacggagaatgtgtttctcccggtcgctgagccggtccatggcctccttcagcgcaatttgctccagccagttttcgtcggtgtttttctggtccttgacctgatccatgacacagatggtgtctcccccgtccgagtacacaggctcatagagggagaccgggtccacaatggcatccagggcaaagaccacctcttcccgctttaggtccaaaagtttggcaatctcctccacactgggctctcgctggtgttccgccacatatttctctttggcctgcaggaccttatacgcggtatcccgcatagagcgggacacccggacagagctgttgtcccgcaagtaccgccgaatctcccccacaatcatgggaaccaaataggtgcttggaaaaacgtccaggtccacattgaaattgtcaattcccttaatgaggcccacacagcccacctgaaaaagatcatcgggattttcgttgcgcccgtcaaacttcttgatcacactgagcaccaggcgaagattcccctgaatcagggtctgccgggcctcttcgctgccagcccgagcctgctgaaagagcaccttggcctcctctcgggagaggacaggcagcttcgatgtattgacgccgctgatttctaccttgctcagtcgtcccatattggttttccccgctttcattgtactgttttcagtatctccgccggagaaatccttcattcggaaaaaggtccgctttcttgggaatcgttcctctggattcgatggattttttcatttcttcgggttccatcggctcccatccccgctgcaccgcttgggcacagcagaaaccacatgtgtttcccttttttctgccaaaaaagcggcgcatgtcaaaatcccgcgccgcctctgcctttctccatgaaacagcaaggtaaaccaggaaaaaagtccttgcaatataaaaaaatttatggtaaaatgttacccgattccgtacgggtccagacaaacggccgtgtgcctggggacaggttggccgcacggaggaagggcccggaggtaccaactaaaacaatcaggaggaaacaatccatggcagtcgtatctatgaaacagcttcttgaggcaggcgtgcattttggtcaccagacccgccgctggaaccccaagatggcaacctacatttacaccgagcgcaacggcatctatattgtcgacctgcagaagaccgtgaagaagctggaagaggcatacaattttgtccgtcagctctctgagaacggccagagcctgctgtttgtcggcaccaagaagcaggcccaggacgcgatccgggaagaggcacagcgctgcggcatgttctatgtcaacgccagatggctgggcggtatgctcaccaatttcaagaccatgcgcggccgtgtggaccgtctgaaccagctgaagaagatgcaggaagacggcacctttgacatgctgcccaagaaggaagtcatcaagcacatgggcgaaatcgccaagctggagaagtatctgggcggcgtggtggacatgaagcgtctccccggtgctctgttcgtggttgacccccgcaaggagcgcaacgccatcaacgaagcccgcaagctgaatattcccattgtcgccatcgtggacaccaactgcgatcccgacgagattgactacgtgattcccggcaacgatgacgccatccgcgccatccgtttgatttcttctgtcatggccaacgccattcaggagggcaagcagggcgcagatgccgcagaagctgccgctgcggaagaggctcccgcagaagcttaattgacgtttctgtgattttagcggatgcccgttgtttgacgggcatccgccctttggatactgttactatataattggaggtttgttatcatggcatttactgctgctgacgtgaagaccctgcgtgaaatgaccggcgtgggtatgctggactgcaagaaagcactggctgagaccgacggcgatatggataaggcagttgaactgctgagagaaaagggcctggccgccgcccagaagaaggctggccggattgccgctgagggtatggcttacgccgaggtcttctctgacggcgccgccctggtggaggtcaacgcagagaccgactttgtggccaagaacgaccagttcattgagtttgtcaaggatgtctgctacgtagtgggcaagtggggtcccgtggatatggacaccctgatgaccctcccctatcgcaagactggtctgacggttcagcagatgctccaggaaaaggtcctggtcatcggtgagaacatcaagatccgccgctttgtccgctacgacagcggtgtcagcgttgcctataaccacatgaacggccggatcggcgtgttgctgaatatggaggtctccgccggcctggagcagaatgaaaaggttctggagctgggcaaggacctggccatgcagattgccgccatgaatcctgctttcctggacaaggccgatgtcagccaggataccctggacaaggagaaggaaatccagctggctatgatggccaacgatcccaaaatggctgccaagcccgacaaggtcaaggaaggcattgttatgggcaagctgggtaagtactatgaggagaactgcctgatgcagcaggctttcgtgaaggagaacaaagtctctgtggagaagcacgtggctgctgtggccaaagaagtgggcggctccatccagatcaagggcttctatcggtttgagagaggcgaaggtctggaaaagaaggaagagaactttgcggaggaaattgccaagcagttgggacaggcctgatccctgttttcctcccttcaccagagaaataaatgaaagcggacccgaggaggtttcctcgggtccgcttttttcatagaaatggaatcagtatgttttagggcctcatctcttcactgcgcagtgttatagatcctcttggcatactggattcccgtgggcgtcatagccagtccccccagtgcggtctcttttagcgcactgcacatgctgtcccccacggacttcatcgcctggatacattcgtccaccggaatcttgctctcaattcccgccagggccatttccgctgcggtaaaggcaatggataccccggaaacattgcgcttgatacagggaatctccaccaaacccgccacggggtcacacaccagccccagctggtttttgatggccatggcgcaggcgtggcccgcttgggtcggggtgccgccgcacagctccacaagggccgctgccgccatggcggaggctgaaccgcactcggcctgacatcccccctgcgcccctgcaatcgaggcctgctgggcaatcaccatgcccacagcgccagccgtgaagagagccatcacagcggcttcctctgtacactttccctcttccagcatagaaaccactgtgcccggcaggatgccgcaggagcccgctgtgggagacgccacaactttccccatcgccgcattgtactccgacacggccagagccctggcaatggaacggttcataaagccgccgatgattcccccttcctgggcgtatcgcttcatcttaaaggcatctccgccagtcagccccgacagtgagcgcgtctccggcatggacccggcctggatcgcctgccgcattacctgtaaattttcccgcatacgctggtacagcacttcagtagggagctccatttcttccgcttggtcgcgcagaaccagctccgaaagcgagacccctgcctcctccgccgccgcacacagagcggaaattgattgatactccaacatagttcttccctctcatccaacccggatcaatatgatgtcaatgatattgtcaaacgccctcagatggtccatgattgcgtccggcacttccccgtcaatttccagcatcataatggcttttcccccttttctggttcgggaaagctgaaaatttccaatgttaatccccgacgtggccgtgtagttggagaccgcagcaatggtccccggccggtcccaatggaccaccagcagcgtattgcactgagccgtgaaagtgaccttgagaccgtcgatctcagtgaccaaaatattaccgcctccagtcgaggtccccacaatcgtggtggctttcccgcgctctcccgtcaaatggatgcgtgccgtattggggtgtgcgtctggcagctctgtctccaggaaagagaaggaaattcccttctcttgcgccagctggggggaacagcgaatccgtgtatcatcggggcagagccccataatccccgccagcagggccttatccgtaccatgcccccgataggtccgagcaaaggacccggagagttcaatgcgcgcctgaaccacatcctccccgagaattttccgggcgatctgtcccagccgaacagcgccggctgtatgtgaactggagggcccaatcataatgggcccaatgatgtcgaagacattcatgctatcctccccaaattttggtgcacagagtttactccttcaaacgtccagccatattatgacgtagccagcgtactccgtcaagtctcaattcccctcttatgatccgccagcaccctataagcttgaaaatcccacagggcagtggtatactcttttcattataaaatggaaacgtgacctctcacgttcctctgcttttggaggtacgcgccatgtattctatccgagaaacccaagatttctaccctctctccctgctctatcaggagagcggactggaggtcactcccggccacacaccgcctcagggaacactgtccatgcttcgttgtgaagactcagaaactggagaacttgtagccgcagccaccctccagcaccgtgcagggcacttcgttctggctcacttggcggtagtttctcacctgcaaggtggtggcttgggaagtcaactgctcgcttcggcagagcaccacgccaagcagctgggcgcccgggaactctggctggtgggaaaggttcccggcttttacgcccggtatcagtggcacactgttccccgagaaatggctcctcccatttcccgctgtctcacctgctcccagttccaagtggactgttttcccagcattatgaaaaaggaactctcttttgatgtgtaaaaacagcccttctaattggataattagaagggctgttttgcccgcttacgcctcctctgggcgcgttttcttgcggtctggtagttgggccaaaacgatggccccaaacatcaacacacagcccatcacctctctggcggacatattttgcccgagaaacagccatccggccaaaacagagataacagactccaagctcaagatcaaactggccacagtgggattgaggcctttctgtccaatgatctggagggtgtaacccacccccgaggataaaacccccgcatacaaaatgggcgcccaagagatcgccactgcatggggatcaggaattccctctatccccagcatgcagaggccagagaaaagcgccgccacaaagaactgaatgcacgacatctgaacgccgtctacctttgtcgtaaaatagtcaatgaccatgatatggaccgaaaagcagaatgcacacaaaaggaccaggaaatcccccttttgcagctgcagggagccactcatacacagcagatacagacccaaaatggcgatcaccacactgacccacagtttgggacccaccttctttcggaagaacaagcccaggatgggaacaatgacgatgtacagtgccgtaataaacccagcctttcccaccgtggtatattgtatacccacctgctgcaggcaggaggcaatccccaatgccaagccacagaaaactccccccaaaagaagcgtctttcgctgggctcgctcctctcggcgtctctcctcacttttcatccggccaaaaatcaaaatcgcagggatcagggcaaggccacccaccaaggaacgaatggcattgaaggtaaatggtccaatgtggtccattcccaccgactgggccacgaaagccgtgccccagataacggcagtcagaaacagcagcaacagattctttgcagggaattgattcatgcttctctctctacgctcctttatcgctttgcaatgatttctctttcgtttttataaatgtggtgagggggaatggttccccgcacactggagattgggtagatatggctgtgagggccaatcaccgtacctggattcagcacgctgttgcagcctacctcgacataatctcccaacatcgcgcctacttttttccggcctgtggggatacgctcctcccctgcgcggatcaccaccaaggttttatcgcttttgacattggaggtaatggaaccggctcccatgtgtgcgtgactgcccagaacagagtccccaacgtaattgtagtggggaacctggaccccatcaaacaggaccacattctttagctccacagaattccctaccacagctttcttccccacaatcgcacttccccggataaacgcgccgtggcgaatctccgcgccatggtcaatgatgcaaggacccccaagataggcagacgggaaaacctttgcatccttcgcaatccagacatcctccgccggatgatcaaattcctccggggaaagggtggcgcccagttgcagaatataggcactaagaccctctaaaacctcccaggggtaggtttttcccgcaaatagagacgccgcaatagtgtcatccagacgaaacaaatcagaaatggtcagcatgttatttcttcgcctccacaatcagcccccgctggcgcatgaccgcaatgaccgcgtccacattctcctcgcacagctcgttggtgggcgcctctaccatgacacgcaaaaccggctccgtaccacttttccgcaggagaatccgcccttggtctcccagttttgccgacacctcgcggactgcattctgtaccgcaaaatcatttaaggcccgctctttgtcttggacccgtacgtttttcagaacctggggatagattttcaagtcctgcgtcagctttgacaacggcatttttttgcttaacattgcctgcatcagtttgatcgccgtcaagatcccatccccggtgttggcgtactttccaaaaatgatatgcccagactgctccccgccaatgagatgcccattggcacgcatattctcataaacgtacttgtcgcctacatccgttttttcatatcgaatatccaaggcgtccagtgccttatacaggccaaaattcgacatcaccgtcgtcacaatggtattgttggccagcttttcccgctccttcatataggaaccgtaaatataaagaattccgtctccatcgaccaaatttcccttttcatccacggccaggcagcggtctgcgtcgccgtcaaaggcaaacccaatgtccatgtgattctcttttacgtattgctgcagctgttctatatgcgttgatccgcagccgtcattgatatttagcccattgggtgtgttgctcagcacgtaagtctccgcccccaaggcctcaaacacgttttttgcaatcatccaggcgctcccattggcgcaatccaaagccaccttcatatccttataggaatgggtagccaaactaatcagataaccaatgtagcggttccggccggaagcataatcaatcacgcggccaatgtgctcccctgtggcatagggcaactctcttgcgctgtccaaataggcctcaatctgatcaatcacttcctgttccattttctcgccatgccggttgatcagtttaatgccattgtcatgaaacggattgtgactggcagaaatcataattccacagtcgaattcatctacttttgaaatataagaaacactgggggtcgtcgtcacatgcatcagacaggcatccgcgcctgaagcagtaatccctgccgctaaagcacactcaaacatatagctggatcgacgggtatcctttccgattacaatctgtgcctggtggtcttggctgtaataccaccctaagaaacggcccacatgaaacgcatggtccacggtcaagtttacatttgcctcccctcggaagccgtcagtcccaaaatattttgacatcatcatcactccacactcaaagaaagttagactctgcgtcactcaaaagaaaatagcatgaaaacacctgcaagctttaacgtttcattatacaactacttgatagggtctgtcaaataatctaaacttaaacgttctataatgctatgatcgcagataagcaaaaggtatgttaatgtgtcgttaaccacacgtatatctataatattagatttttctacatcataaaccattttcccatttttataactacaatataattttaattcttcagggatgcgtgaaggtctgtctcgtgtcaatacctcggaattggacattcctaatagacttcctacctcgatagatgcgtaatatatcggttcatcatcttttttataggtcttatatcctccatatctaatttttcctatataaaaattctcatcctttttgcatattacaggaaatacatttctgagaaaataacttacttctcttgggcttacacttcttgataaaatagtatcgtcgtttatgtaaagtgacccagtaaaacgatcttcacaaatagaaatcagttgattttctttaaatattacctccttacgctcaccttggtgtcctatgtaaaaaattttgaagtacttaatctcatcagtagtccaaaattgaatttcaggacaagcatagcctctgtaaaaaacttttctcccctcaagaacatattttttatacaaacttgtgtaactgttctgtaatatgcataactttcgcatctccataaattgatttattcttttatccataacagccaagtcttttcttcttatttccataccatttcctcccacagccgatcaattttcttcattatagcaataaaaaacaggacagtcaactaactgtcctgtttcctgtgttggcgttacctattttcccggttcgtctccaaacaagtatcttcggcgcaagtgagcttaacttccgtgttcgggatgggaacgggtggaccctcactgcaatcaacaccaactcgctgttacaataacagcttatcaaatttttcgcgtcttgtcaaccaaaacgtggtgacccgtacgggaatcgaacccatgtttgcggcgtgagaggccgccgtcttaaccgcttgaccaacgggccgttggtacaccttcagggactcgaaccctggacaccctgattaagagtcaggtgctctaccagctgagctaaaggtgcatacttctccttgaaagaaaaagcatgcaaaaagaactttatactgactcggcttcgttcccttgctttcttcttcctcaagaaaaggctgtggcaatatccacaccctcaaaaccgaacaaagtaaccgccataccccaagcaagcgcctgcacttcttactcttaacctgagactcaggtcaagccctcggctgattagtaccggtcagctccatacattactgcacttccacctccggcctatctacgacatagtctctatcgtgccttactcctcgaaggatgagagatcttatcttagggaaagtttcacgcttagatgctttcagcgtttatctcgtccgcacttagctaccctgctatgccgttggcacgacaacaggtgcaccagaggtgcgtccatcccggtcctctcgtactaaggacagcccccttcaaatctcttacgcccgcaacagatagggaccgaactgtctcacgacgttctgaacccagctcgcgtgccactttaatcggcgaacagccgaacccttgggaccgagtacagccccaggatgtgacgagccgacatcgaggtgccaaacctccccgtcgctgtggacgcttgggggagatcagcctgttatccccagggtagcttttatccgttgagcgatggcatttccactcacataccaccggatcactaactccaactttcgttactgctcgagccgtcactctcgcagttaggctggcttatacgtttacactcaccgcacgatttccgtccgtgctgagccaacctttgagcgcctccgttaccttttaggaggcgaccgccccagtcaaactgtctgcctaacagtgtcccccgaccggattcacggccgcaggttagaaacccagcaatccaagagtggtatcccaagggcgactccatacggcctgacgaccgtacttccatgtctcccacctatcctgtacatgaattaccgaattccagtattaagctgcagtaaagctccatggggtctttccgtctagttgcgggtaactggcttcttcaccagtacaacaatttcgccgggtgggctgttgagacagcgcccaaatcgttacgccattcgtgcgggtcagaacttacctgacaaggaatttcgctaccttaggaccgttatagttacggccgccgtttactggggcttcgattcaatgcttcgttgcctgacatctcctcttaaccttccagcaccgggcaggcgtcagcccatatacgtcatctttcgatttagcatagacctgtgtttttggtaaacagtcgcttgggcctattctctgcggcctgctcgcgcaggctccccttatcccgaagttacggggtcattttgccgagttccttaacaacccttctcccgttggccttaggattctctcctcatctacctgtgtcggtttgcggtacgggcaccctaccttcgccttttctcgcctcagaacatcgcggacttccctactcgtgttcggtcccttacgcccggatctaccaatctccgggtcccgctatttccaagtgtcagctttcattcgataaggtggctacggaatttcaaccgtatgtgcatcgactacgcctcgcggcctcgccttagctcccggctaaccctgggcggacgaaccttccccaggaaaccttagattttcggccattatgattcccacataattctcgctactcattccggcattctcactcgaatacagtccaccgctgctc

SEQ ID NO: 2235 - DNA, 35491 bp, KLE1738
gctaagtgcggacgagataaacgctgaaagcatctaagcgtgaaactttccctaagataagatctctcatccttcgaggagtaaggcacgatagagactatgtcgtagataggccggaggtggaagtgcagtaatgtatggagctgaccggtactaatcagccgagggcttgacctgagtctcaggttaagagtaagaagtgcaggcgcttgcttggtggtatggcggttactttgttcggttttgagggtgtggatattgccacagcttcacaaaagagcaagttggtgttgattgcagtgagggtccacccgttcccatcccgaacacggaagttaagctcacttgcgccgaagatacttgtttggagacgaaccgggaaaataggtaacgccaacataggaaacaggacagtcggtaggctgtcctgtttttttgttgtgattggaacaaaagaaaacctcccttcaaaagggaggctttacaatgattaaggcatctgctgtttgattaaatccacccaagcgtcggcaaaggtgaccattcccgctttgttggggtgcaggccattgaccgtttcataggtgacaccatgggcggctaagtccaccagatgggcatgctccgctttgacacaggtgcggatgaccgtattgtaggcatcgatgttttggaaatgttccggctcaatatagtagggccggccggaagagggcgcttgccccatacaaagggtaccggcccagatctcagccccgggatggaagcgatgaatcttttgtagcatatccgtgtagtcccgctggaaagcatccagaggaatgtcattggccacgtcattgatgccggtgtagatcagaatcatatcagggctgtcctcttccgtggccagattgcgaatccgccccggcagcatcgcggcatagtggccgaggtagcttacataggacccggaaaaggagttgttgcaaagaacgctgccccctaactttttgatggcctgcatccaccaggtgccctccgcagagtcaaagcctgagtaggagacatagctgggagaatagaagctgccgagcctgggggtatatccctcaaaggtgctgatgccatctcctaagatcgagatcttgggcgcagttgcttgagacatggaaagtcctcctttatgatagaatccgaagataggctgaactgatcctaccaaaatttcagcaaaatagatgttgcggcggcatcatttttagaatgaattgaccgtacaaattacattatagcacagagaaagggtcagcgcaaagaaaagtggaaaaaagagtacaaaattaaaaaaagtttctgtcctatgaggaagcttccattccttggagccagagcctggccagctgtgccatgccagttccattgggatggaatgcgtccagggcatcgtagcgggaatgcatagcggccaagtccaccagctgacaatctgcctgcgccacggcagagcggatggcctggttgtagggggccaaacgctgcacaagacaggagagggagccctgagtccctggaacggcacccaaaatcaatgtgccgcagctgatctgtgcgtggggataggtttgccgaagacgggagagcagctgctggtattcccggaggaacccttctggcggcacataaaaattggcgtcgttgagcccggcatagagaaggatgtggtctggcgtgacgccatcgacggtaagctgtgcaattcgacgcgggggaaatccgcccatggtgcccgcagtggagatggtattgccggagatggagagattggaaagaagccttccctggagggcacggatcacctgcatccaccaggtatcttccactgtatgtacacctgtggcagcgcccagatccggggagtaatgggcagcgccccagggagagtatccttgaaaggtactgattgaatcccctaagacagagaaatttttttgtgttctggccatgggtgtccgcctcctgacgacaaaattccgagttcagtataccaggaacggaggaaaaagaaaataggaaaaaacccgaaaagaaattttagagaattttgaattctggaacaaatttgtttggaaaagcactggacaattggaggcgttggctttattatatatagtgttttagtctcgctgcggactgaggcaattttttggggaaaaagagaatttggcaaggaaaaacagaggtgatgctatgaagcaaatgttttacggcggcgtccaccccgccgagcacaaggaagctactgagcagaaaccgatccaaccgctggccaatgccccggcgcaagtcgtgatcccgatgtctatgcacatcggcgcaccttgcaagcccgtggtgcagaaaggcgacacggtgacggttggtcagatgatcggtgctacggcgggtctcggcgcacccatccacgccagtgtttctggcacggttgtggcggttgaaccccgtcccggtaccggcggtgtgcctacgctttctgtcgtgatcgaaaatgacttccaaaacacccttagcccggactgcaagccccgcgaaaacgcagatgcactgacctcccaggagatcattgacatcatccgtgacgcgggctgtaccggtatgggcggcgcgggtttccccacccacgtcaaaatcagctccgcagttggcaaagcagacaccattattatcaatggtgctgaatgcgaaccttacattaccgcagaccatcgtctgatgctggagcatggcgagaaaattatcggcggcgttcggttcatcatgaaggcccttcagctggaccacgcgtacatcggcatcgaagacaacaagatggacgcggtgaaccatttgaaggagctggtgggcggcgccaaggacattaccgttcaggctctgcgcacgcgatatccccaaggcgctgagaaacagctgattcaggccatcaccggccgtgaggtgccccccggcaagctgcccgcagatgtgggatgctgcgtcttcaacgcggcgaccacggcggccatctatgacgctgtggcactgggcttgccggtctatcagcgggtgatcaccatcactggcagcgccgtgaagaaccctgtcaacctgttggcgcctgtgggcacccccttctctcacctgattgaggaggccggcggctttaacgggacccccgcccgggtgatctccggcggcccgatgatgggctttgcccagtatgatctgtccgtcaccatggggaaggccagcaactgcgtgctctgcctgagcaaggaggatctgcccgccaccagcgagaatcccacctgcatccgctgcgcacgctgcgtcaatgtctgccccatgcacctgacgcccctcttcatgaacatgttcgccaaagcccgccgctggagcgaggtggaggagtaccggatcatggactgtatggagtgtggctgctgtcagtacatctgcccggccagaattcctctggtgcagcagttccgtaccgcaaagtttgccatccgccagcaggcggccaaaaagtaaggaggggatagcatggaagagtataaactgagcgtagcttcctcgccgcacgcatcgtctcctgttggaaccaagaatctgatgcgggatgttctgatcgccctgatccccgcgatggcgatgggcatctatgtgtttggaccacgcgcactgaccaccaccctggtgtcggtgattttttgtgaaatctttgagtggggatactgcaagctgatgcacaagcccaatccctgcggcgatctgtcagcggccatcacgggtgtgctgctggtgtttgtatgtccggtcacgctgccctattggaccatcatcattggcgacttctttgccatcgtggttgtcaagcagctcttcggcggcctgggcaccaacttcctgaaccccgcgctggctggccgtgcattcctgatgctgtgctatcctgtgcccatgaccacctgggtgctgcccggcaaagagaactgggcttccgtcctctctgccacagacgcggttaccggtgcaacccccctggccgtggactacatgaagggcggcatcgttcccgaggcctctgtgctggatatgttcatcgggaacatcggcggctgcgtgggtgaggtttccgccatcgcactgctcatcggcggaatctacttgatcgccaagggcgtgatccggattcggattcccgccgcgtacatcatcacggtggctgttctgaccctggtgttctcccgggcgcccgaaggcgtcaacgtcttctcctggatgctccgtgagatttttgccggcggtctgttcctgggcgccttcttcatggcgaccgactatgtgaccagccccaacacccccaagggcgaggtgatcttcggcatcggcgcaggcctgctggtggttttcatccgttactttggcgggtatcccgaaggcgtttgctactccatcctcattatgaacatctgcgtctggctcattgacaaggccaccctgcccaagcggtttggcgtcacggcggagatgcgcaaggcggagaaggagaaggcaaaggccgccaagaaagctgcaaaggagggcgcggaagcatgagcactgcgaagaaagaacccggattggctatgctggtgattgttttggccctcatctgtctggtggttgcggctttgctgggcttggtcaaccaggttacggcacctgccatcgcggccaacacagagaagaccatccaggactccctgaaggtggtccttcccgcggatagctatgaaaaagtagagtatgatggcggggatattaccctggatactggcacggtggttcccgtcctggccgtctatcaggccggtgaagagggctatgtggtggagaccaactcccccaatggctttggcggcgccattgacatgatggcgggcatcaattccgccggcgaggtaaccggtctggcgatcatcacccacgcggagacgtcgggcttgggctccaaggcgacggaccccgagtggcaggcacagtttgcaggcgccacggacattgtgagtgtcaccaaggatggcggtaccattgaggccatcactggttcgaccattacctcccgcgcagtttgcgacggcgtcaacgccgcccgtgctgttgtggaagcactgggttaaggagggaccgagacaatgaatgtaaagaaacaattttttgacggcctcattaaccagaacccgtccctggtgcagctgctgggcatgtgccccctgctggccatcaccacttcgatgttcaacggtctgggtatgggcttggccgttaccatcattttgacttgttccaatgtggttatctccgccctgcggaagatcatccccaacaaggtccgtattgcctgctacatcgtggtgatcgccggcttcgtgaccatggttgacctgctgctcaagggatttgtccccgcgttgtccgagagcctgggcctgttcatccccctgatcgtggtgaactgcatcatcctgggccgtgcggagggctttgcttccaagaacagcattggggcctccgctctggacggcattttccagggctttggcaacatgatctccctgaccatcatgagtatcatccgtgagttcctgggcgccggaacctttggtggcggtatcctcaacggcggcgcaggctatcagatccttcctgaggatgtggtggcactgggtatgatcctccctgtgggcggcttcctgaccctgggtgtggtcattgctaccgtgcagtactttatgagcaagcccaagaagaataaggaggtggcgaagtaatggaaagtatcaccagcctgctttcaatcgccttgggcgcggttttggttaacaacttcgtcctgtcccagttcctgggcatctgcccctttatgggcgtgtccaagaaggttgaaaccgctctgggcatgggcatggcagttatcttcgtaatgggtgtggcctccgctgtgaactggcccatcaacgagtttttgaacagcaagggtctgggctttatgcagaccgtgacctttatcttggtcatcgcctctctggtgcagtttgtggaaatgttcctgcaaaaggcaatgccctccttgtatgaggccctgggcgtgtacctgcctttgattaccaccaactgtgccgtgctgggtgtgaccttgcagaacgcgcaaaagtcctataactttggtgagagcctgacctatggtattaccggcggcgttggtttcctgcttgccattgttctgtttgccagtgtgcgtgagcgcatggagtttgccaagtgtcccaagtgttttgaaggcttccccatcgctctggtggcggccagcttgatctctctggccttcatgggcttctctggcctgaaagtttggtaagggaggcgaagagagaattatgagtactaccattttagcccctatcgtattatgcgtgctgggtattatctttggtattatcctggcggttgcctccaaggtcttcgccgtggagaaggacccccgtgaggaggccattacagagtgtctccccggcgccaactgcggcggctgcggctatcccggctgcggaggctatgcgaacgctgtggtgaaagggctggctcctgtggatgcctgttcccccggcggcgcggaagtggccaaaaagatcggcgccatcatgggcgtggaggtggaagagggcgcgcgcaagattgcccaggtgatgtgcaccggcggcggccatgacaagacccgctatgattatgtgggcctggaaagctgtctggcgatctcccgggtgtcctccggcccgctgcagtgttcctatggctgcctgggcggcggagactgcgtggaggcctgtaagtttgatgccatccatattgtggacaatgtggcgaaggtagatttcgacaaatgtgtcgcctgcggcgcctgcgtggatgcctgcccccggaacattatccgcattgtgcccctcaacgccaagaagtatacggaggtcccctgtgcctcccacgacaagggccctgtggtccgccaggcctgcgacaacggctgtattggctgtaagatctgcgtgaaggcctgccccaaggagggcgccattgtggtggagaacttcctggccaagatcaactatgacatctgcatcggctgcggcatgtgctcccgcgcctgcccccgtcagctgatcactgtggacggtgttgttctgcccccgaaacccaagaagcccgcggcacccaagcccgcagcggcccccgctggagaggccaaggtggaagcgcccaaggcagaggcggcccccaaagcggaagcccctaaggcggacgcggcccctgctgcggaagcaccgaagacagaggagcctcccaaggcggagtaaggtgcttgcgcagtgttgcgtggaagaaaaacggaaaaaccccgggatggaatcacttccatcccggggttttctgatttgttcggatcacatgcggtgggtgtcagggaatcagaagccgttcttctgcttggacatctcataggaagcgcattccgtgcaggcgcattccttggtggtggggccgcagcagcccacctggatcgaggacagggaacagacgctcttggcgctgttgtggtgggtgcagctggagacggagcatttgatgctgttgttggcgttcatgttattcatgggataaccctcctttttgaagtctgaggatagtatgtgcgaaagaaagcggggttatacgttgggaccttcccgccatttttcgcataagatggatgggaggtgagagaacatggatttgcggaacaaccaaattaccgtccgggagcttctggcggaccccaaagcccggcaggtactggcccgccagtttccccaggtcattaaccggcccattgtggcaaaatccggttccatgaccctggacaaggcgatgaaattgggggcggcctacgtacccaaaagagtcattcaggagaccctggaggagctcaggcggctgtaacaggaacgggccgggaaagcccggcccttacatagattcctgtccgggggagacaggacggtctcgccggtaccacagcaggcaatctgtgctcccggttcgatggagaagaaagagggagagaaggccgtccgcggcgaacagaagaaaaagaatttgagtcagcccaaggggtatccgggccagaagaggggagaacagcggctgcagcccatagacggtcaacagggacaatgccccccagaaaagcgtgtatagggggcagatccgcccagagagattgcccggctgctggtcgtattcccagaaacggacccccacgcccttttcgtaaaaaacggccacgacatattccaccagtgtggccaccagggcgccggccaaaaagaccaggagagggcggcgcagcagaagcgctggcagagacagcaccgccagagcgcccaggccgtagacggggcagagagggagaaacaggagacatttgcggtcctgcttgggatgatggcagaggcgggtatacgccacctcaatcaaaaatcccaaaaagctgtaaaggaagaaagtggaaaagaactggtccatagcaacacctcctttctatcatgtcctccgcgcgggtggttatcccaaggaaaaaagaaaattttccgaatctacctgaaaaaagtgttgacaaaacgcttaaaatatggtagcctatacaagctaacggttccggaatacgtacttatgcgggtgtagttcaatggtagaatcccagccttccaagctggtcgcgtgggttcgattcccatcacccgctccatctgcaaagctgacagcgatagggtgtcggctttgcagatggaacgatacgggaacggtggaaggaagggccgtcaggcttttccgggggcagcttgttatatgcgcctgtagctcagctggatagagcaactgccttctaagcagtgggtcaggggttcgagtcccttcaggcgtgccatgtttccctgttactgcttaggaagcgatttggtgggtgtagctcagttggttagagcaccggattgtggttccgggtgtcgagggttcgagtccctttacccaccccagatatctcgggagagagccggagcagcggttccggctctcttctcatagagagtggattctatgatggggtgtcgccaagtggtaaggcacgggactttgactcccgcattcgctggttcgagtccggccaccccagccatctttttgacccgttagctcagttggcagagcacctgccttttaagcagggtgtccggggttcgaatccccgacgggtcaccaagaaaacccttgaaccttaaaggttcgagggttttttagttttattttctttctatttgttagtaacttgataataacatcccgtgttttcaacagcttgcaaaatatcatccatatctacggtggtttaattctttcttgagcgttattcgcattggttccgatcacgatagttagaatcagaaatgccaccatgaccggaaatatccacttcaaaaacgcctggaatgttttgccatttcagacgtttttttgttgcactttttgaaaaaacacgtcttaaatagggaaggtcctttgcaaggagccgtttcctggtgtaaaattaaaaaagggagttttggaagactgtcccttgaatgaaaacaaaggaggaacaagagcatgttaaaacgaggattcgcctttgccctggcgctggtgatgctggtgtcggtggccagtgccgtggaggcagtgacgccggatggggacacgtatgaggtctcggcctgggcacagaaggatgtggcggaagcatggaacgtgggcttgtataaaggggggggatatgagaactatcgtatgcctgctgacaggtccttgcttggacaggttgcgtcccggctggtggcgctggccttcggcggggactatgatgcctataccgggtatcgggggctgcagagacagatcaaggatcaaccgtggggcagcacggtggcggaggaattggggctgcttcagggccgtgaggatggagacatggactacgacgccgtcattacccggcaggaggccgctgtggttttggcgcgggcctatcggctgtattgcgatgaggtccatgatgacgcggagccactgtcctatgccgacagcgggatgattgcggactgggcagaagccgacgtacagcttatgacccacctgggcgttatgaatggtgtgggggagaacaagtttaacccccaaggcacgtgtacgatcgagcagtgcctggttacagtagttcgtctgtatgaaaacacctgtaagggcaagcctgtggtcgagaatgatttctttgatctgaccccgcggcaggctgcgatctctcaggcctatcggccggtgctctattgtggctctgcggaaaacgacaagacctttgcagtcgtttacaatacatcgggagcatatataggtcctactcgcatgaaagtcgtcgtagtggatgccgctgggacatgcgcagaatatcggactgtcatcaaagagtctcataacatcttttggggggccggtgagaatgggcagtctgatgctgctgtcgacaagatttggttgtcggaagatggcagcaaggtttactatcagagtacgctggaagaagatgtctatccctattatcccgacgggacctatggtgagctgttgttcgccaaaggggtctacactgtgacgctggatgtggcaagcgggaaacagacctatacgcgggaggacttgcgctaaattttccttcagagacctgttttacaggtctctgaattatttttggaaatgttcggaaaacacgtttatttttggggaggaatggtatctttttcaatcatctaagaaatagaggcctcaataatctcttagaaattctttaagattggaacggaaaaaacaatatgccgattggaacttacactatgctgaagggaaccaagcccgcttttgaagagaagagcagcgccaactactatgcctatgggcccagcggctctgtggctacctacaagaagatctccggtctgatcacgctcccggataaggttcgtctggtaggcaccggcaagggccggaacgcgtttatctctcttggcgttactgccaagggcggcaagagaggcatcgatattggcctgagaaaccgcggactgggttgccagaatgaggagttggatattaacattccctccaaggataccggctatggttggcatccgtattgcatcgagttggataagacgatcgatgctggctattactttgatggccagaaaaatattcataagacggatcaggtcagtcgaaatgatgcctattttgcgcctaacaatgcaaaacaggcacgctttgaaattgtgccgaacaccaacgggagaagtgttcacttcactgtgacctggctggatgcaaacggcacccaagttggcactgtgttcgacagagtaatcgatctggaggggacctatcagtgggacaacttctgccgctttgcctccttggtgaccccggagagaacggccaccatgacagacagcacctacgtggtaaacggtgggtttgcgaccctgaagatcggcagcgccaactggggtatcaccacgtcccaggtccccctggcctggatcatgaacgaacccaagtgcaagctgaacagcaagtgggcggtgggggagtcgttcaccatcgaccattgggcataagccagcaacgctgccattgatgcaccgaacaaaggagagccgcgaaccatctcgcggctctccttccaaaaagattcgcaggaaaaggaaaatgcgtaagtcctttgtttggacttacgcatttacgccatgtaacacttttcttttagcacagagaacggaaaaaagtcaagggaacagacaaggctcagcgcgtaacccccatggtctttttggcgcgaacgagaaaccggcgggcggcgggggagagactgtccagatcgggcagggaggcgcccagctgccggtgggcccggggaaccaaggggcggacggtgacgcccgggtggtcctcatggaggtagagagcgggcatcaccgagacgcccagctccagccggaccatggccaggatggccagttcatccttggaggtccaacggacgttggggtgaacgcccgcctcctggatcacccgggagatgtcgtagtcataggcccggtcttccaggatgaagggttcgctggccagctgggccagggagagctcctcacagcccgccagagggtgcccgtcggggaccaccgcccagatttcatcctccaggaagggaatccagtgattctggctgttctcatggtagctgcaaaaggccaggtccaccgagccctcccgcagccattcatccagctcctcctgcccgctctcccggatggagacggtgatgccggggtaatgctgggcgaagtcccggaggatttccggcagccagaaacgggagatggagggaaaggtggccagggagacggtgcccacggccaggccgcggatatcggcggcctcctgctccagctggcggctctttcggtccaggtcccgcagcagagggagaatccgctggcagtcctcggtgggacggacgccggtacgggagcggaccagaaggggaaaacccagctctgtctccagggtcttgatgacataactgagtccggactgggtgtaccccagctgttccgccgcccgtgtcaggttgcccaggtcaatggcggtgagcagggccacgcatttgttttggtccatggtgcctcctttccaggcagagacaggggggaaccatttggttccattggaaaatccaatgataaaggtgggttttccttgttttacaaagggaagtgggtttagtataatgcaattagaaagagaaagcaagcagaccggccggagaaactttcctttctgatcgctgcaagcctttcatggacccaagaaaggagcattccaatgaaaagcagaacatctcatttgatccacctgttggtttggctgctggttctcacggcctatgtggttgtgctgaacggtctgccccaggctcccggtcttctgctcaccatccctgcggggttgggtgggattgccgcggcccaggagtggtcggattatctgaccatgaagaaacacgcggcctgagtgtgcctaccatctctctttttcaatattcgctcgaagcaaatgggctcgccttggaacaccccctctgttccccggcgggcccgtgctcgtttggggagacggcggaccgccctgcggagtctcagactccgcagggcggtccgcttcaatggccccggtgtttttcccggtgtttctcccggcgcagggcggcccggcggtgctgggcctgggttcgcttttgacgggcggtctccttccgggtctggacccgctgggcgtgctgcagctgcagggcctgctgggctttggtgccgatggcaggggtctggagctgttttcggatctcccgctggagccgtttggggttgatccgcgcccggggcacggtgccggcgggaagaggcggggagaacgtcaggtctttccaatgccgctggagaaaggcatagacctcataatccttgggctctgccccaaagggaatcttgcagacctggtacaggccttcctcttcccgttcgtaaagccccacccagaagggagcctcgaaggagatggtgagggtggaaactgccggtttcatttgggttcctcctttttgggttcctatggggaagggacaaccaaggaggcaggttactgacggtcgagccgcttccggactaccaaccggaacgtgtttttatccccacacagggatcatagcaggatttccacgccggtgcaagcccttggcgcacgtcggggacagggggcttcagaggcagcggagaaagagacggaaaaaaacggcggggttttgtggaaaagagaggcttgacggcgccggagggaagtgctatgatacagacaagttaaaaattccaaaccagtgaataagagtagtacctctttcttttgcccttcagagagctgcggatggtgagagcgcggcgggacggggaggagggaatggacttatgagggcggagcgaacccccggcaatggggtagtagtggccgacggggaccgcacccgttatccgggcggcacgtatgatggtacgtgaaaagagcgggcgcaatgcgtcaatttgggtggtaccgcaggaattcagtcttgtcccatttcgttagaacaaacgaatggaacagggctttttttgttgtcccatgatttgacaaagagaccctcaccaccatcgaactcaaatcaaaaggagaagatcaacatgaaaaacctgaaaaaactgctctgcggagccctgtccctgaccatgattctggcactggccgcctgtggcagttcctctggcggagaccacgacgacacaggcgcgtctggcggagacgcccccatcatcggcatcagccagtacggccagcatgggtccctggacaactgccgggaaggcttcctccaggggctgaaggaggccggactggaagaggggaaggactaccagattgactaccagaacgccagctttgacgacaacatggccattcagattgcccaggctttctccgcggaggatgcggctctgatggtgggcattgccaccccctccgccaccgcctgctatgccgcggcggaagacaaggacattcccgtggtcttcaccgccatcaccgaccctgtgggggcgaagctggacagcggcaatatcaccggcacctctgacgtgctcccggtggagggacagctggagctcatccgggcactccagccggaggccaagaccatcggcattgtctataccaccagcgaggccaactcggtgtattccgtcaaggtctatgaggagaaggcggcggagtatggatttaccattgcgtctgtgggggtcacggcccagtctgaggtcacccaggcggtggataccctgattgcaaaaggggtggactgcttctccaacctcaccgacaacaatgtggtgggggtgctgggctccattctggaaaagaccaatgaggcgggcattcctgtgtacggctctgaaattgagcagatgaagctggggtgtgtggccggtgccggcctggactatgtccagctgggcatccagacgggaaagatggcggcaaaaattctcaccggagaggccacctgccaggacctgccctatgaggtgattgagaactactccctgtatgtcaacagcaacgccctggcccagatgggcatcaccctgccggatgacctggcccaggaggcggaagaggtgggcgcgaccgcctgagtttgaggaccccaaccaaaggaggaggaccgtatgtcggacttgattgtctccacgctgacccagggcctgatctatgccctgctgtcttacggcgtgtatattacctattctgtgctggactttccagacctgacggtggacagcagcttccctctgggggcggcggtgacggccatcctcctgctgggcggggtggacccctggctcaccctgctgtgcgcggcgggagccggcgccctggccgggctgtgcacgggcctgatccacgtgcgtctgggggttcgggacctgctggccggcatcatcaccatgaccgcgctgtcctcggtgaacctgctcattgccggttccaatgtgactgtggagcgggcggtggataccatttttacctccgcgccggtgatggcgctgctgggagacctgaccttgtcggcccggaagctcattgtggccctggtgctggcggtggtggtgaagctcttgctggacctctacttccgcaccaagtccgggctgctgctccgagcggtgggggacaatgggaccctggtgaccaccctggcccagaataagggcaacatgaaagtgctgggcgtggtcattgccaacgccctggtggccctctgcggcggggttctgtgccaggagcagcgcagctattccgcggtcatgggcattgggcaggtggtttttggcttggctaccgtcatcattggaatttctctcatccgctttttcacccggtccaaggtctcccagagcctgcggaaggtcaggggcctgcggttcctggccaccccccaggggaccacagcggtgctgctggggagcattctatataagttctgcattcaaattgccatcaacgcgggcctgccggccaacatgctgaagtttatcaccgccgccctcttcctgttggtgctggtgatcgcggggcgcaaaggggaggagatcatccatgcttgagctgcgggatatgaccaaaatctacaatgcgggaacggtgacggagctgaccctgtttgaccggttcaatctcacggtggaggacggccagtttgtctctatcgtgggcagcaatggttctggaaagacctctctgctgaatatcctctgcgggtccatcccactggacgggggagacgtgctggtgaatggaaaaagcatccgaaagcagaaggatttccagcggtacgccaccattggccgggtgtatcagaacccctccctgggcacctgtcccaatttgaccatgctggagaacctctctctggcggacaacaaggggaaacgatttggcctggggtttggggtgaacaagaagcggattgatgcgtatcgggcagaactggcggccctggggctgggcctggaggataaactggacgtgaaaatgggggccctctccggcggccagcgccaggcagtggccctgctgatggccaccatgacccccctgaactttctaatcctggatgaacacaccgcggcgctggaccccaagactgcggagaccattatggagctcaccggcaaagtggtccgggagaagggtctgacggccatgatggtcacccacaaccttcgctacgcggtggagtacggagaccgcctgctgatgctggaccatgggaccattgtgctggatcgggcgggaaaggaaaaggaggctacctccaccgaggagctgctccaggtgtttaaccggtacagcatcctttgacacagaggcctccatatagaaccgacgaaaaaagtacagccctcctttctggagggctgtactttttgataaaaacacggcccgggtcacccgggccgtgaatgaatggagtatttatgccagctttgccttggacagctcggtgagcgcggtgaaggcggccttgtcgttgacggccatctctgccagcatcttccggttgatctccacgccggccagcttcaggccgtgcatgaagttggagtaattcatgccgttcattttgcaggcggcactgatccgggtgatccacagctggcggaagttgcgcttcttctgcttgcggcccacataggcgtaggtcagggacttcatgacctgctcgttggccatcttgaagtgcttggacttggcgccccagtagccctttgccattttcaggatcttatttcttctcttgcgcgtcatcatcgcgcctttcactcttgccatggtatgttagcctcctatgtcttgtggtaaaaaattatttatacaggatcatgcgcttgatggcggcctcattggttctgtccgcataagcgccggcgcggaggccgcgtttccgtttggtggttttcttgttcaggatatggcgtttattggcgtgtgcgcgcttgaccttgccgtttttggtcaggttaaaacgcttcttggcgccgctgtgggttttaattttgattttaggcatggcggaaaactcctttgtaagattttactttttggtctctttgttctgccggcaggacaggaacatggtcatgtgacgtccatccagcttgggctccttgtccatggtcgccacctcggcgcagtcggctgcgaatttttccagcagacgctttccgatgtcggtatgggccatttcccggccacggaagcgaacagcaaccttgacccggttgccatcggccaggaagcgctgggcgttgcggaccttgacattgaaatcattgacgtcgattcccggggacatacgcacttctttgatctcaacaatccgctggtttttctttgcctccttgtcccgcttggtctgctcaaagcgatactttccgtagtccatgagcttgcagacgggggggacggcgttgggagaaatcttcaccaggtccaggtcggcgtcgccggccttggccatggcctcggccaggggcatgataccgagctgttcaccctgggcggagatcaggcgcacttccttgtcgtgaatttcctcgttgatttgatgagccgtgtgagctatgatagacgcacctccaattctgaaataggaacataaaaaatggatacctttcgaaaggtatccgcacgacaggcaaaccaacgccccctccatgggagcgatgacgttaccttataaacctctgtcgcccaagcgcagaggtgaggcaggcggaaccttcctactttattgtacagagggtagtataccattctcaacgtggaatgtcaaccgaaacttgagagaacctggagaaaaagaaatcacccgaaacccaggcaaaaaagacggtgggattcgggcggattcgcgggatttttacaggcattgtcttatatcatcgaaaggatgggaagagggttcccaggggtctggcctcagccctggcggcgttgcaggaccaggcggtcggcgatcatggcgataaattccgagttggtgggctttcccttggagttgctgacggtgaagccgaagtatttttgcagggtgtccaggtcgccccggtcccaggccacctcgatggcgtggcggatggcacgctccacccgggaggcggtggtgccgaatttccgggcgacctcgggatacaggaccttggtcacggcgttgatcacatccatgtcctccacggtcatgatgatggcctcacgcaggtattggtatcccttgatgtgggcgggcacaccgatctcgtggatgatggcggtgacgttggcctccaaagtctgccgggcggtggccgggccggcggggttctccccgccctcggaccagtgctgggcggccagcaggcggacccgctccaccactgaggcaatgcggcagggcttcatcatgtagtagtctccgccccgggcggccacctgatcggccatgcagccccgggcaaagccggacaggatcagggtgctcaccggtttggacttgaccgcgtccagcacgtcaaagccgtccatccgccccagaaccagatccatgaccaggatatctggggaccggtcctgcaccatctggatggcctcttggccgtcgctggtctgccctaccacttccaggccctcctcagcctggagcgcgtcggcgaggatggtacggaattcctcgctggtgtcagcaatgagaatggttttcttcgtttccatgcgtgtatgtctccccccgtggggaagcggctgtgccagcttccccagatttttcaaatgatgtaaagcgtttcaaccggacatccataatttaccacaatgggacagaaaactcaagacaaaaatagcaaaaactggaaaaaccgtcgccgcaagtttcgacaaaaaacgacaccaatccgcaaaaaagtccagcaagaccttggattccaaaaaaaccagaaaaaaacgaaccgcaggagaaaatttgtcgggaaaaccggtttacgaattgtagggaaaatgatatgatgaaaaacgatatattattgcaattcctgcccgcactgtccgggcggggacacccaggaaaggggttttcccaatgaagaaactgatgctgggcaatgcggcggtggcccggggactctatgaggccggctgcggcctgatttccagttatcccggcacccccagcacggagatcaccgagcaggcggcccaatatgacgagatttactgcgagtgggcccccaatgaaaaggtggccatggaggtggcctttggcgccgcgctggcaggcaagcgcagtgcctgtgtgatgaagcatgtgggggtcaatgtggccgccgacccgctgtttaccattgcctataccggggtcaacgccggcatggtgatctgtgtggccgatgatcccggcatgcattcctcccagaatgagcaggactcccgtcactatgcggtttcggccaagctccccatgctggagccggcggactcagaggaggcgcgggcatttgccaaacgggccttccagctttccgaggaatatgacaccccggtgtttctcaaattgtgtacccgcatcgcccattcccagagcattgtggaactgggagagcgggaagaagtcccggcaaaaccctatgagaagaacattgccaagtacgtgatggtccctggcaacgcccgtccccggcatcccattgtggaggagcggacccagcggctgaccgcttacgcggagaccacagacctgaaccgggaggagctgggaaccgaccgtaccctgggcatcatcacttcctccacctgctaccaatatgcccgggaggtgtttggtccccatgcctcgatcctgaagctgggcctggtcaacccgctgccccgggagaaaatcctggcgttcgcggccaaggtggatcaggtgctggtgttagaggagctggacccggtgattgagacccactgccgcaacctgggcctgacggtgctgggaaaggaccggctgcccatggtgggggagttttctcagggcctggtagcacaaaagattcgggatacggcccgaccctggatggagctggaggaaaacattcccccccggcccccggtcctctgcgcgggatgtccccaccggggactcttctacaccctggccaaacacaaggtcacggtgctgggggacatcggctgctataccctggcggcctatgagcctctttatgccattgaaacctgtgagtgtatgggggcctcggtgagctccattcacggctttaacaaggccctggggcaggacagtgagggaaagaccgtggctgtgctgggggactccacgtttatgcactccggcatgacgggactggccaacatcgcctataatcagagcaactccaccgtcatcattctggataactccaccaccggcatgacggggcaccagcagaaccccaccaccgggaagaatctccggggggaccctgccgggaagattgacttggagaccctgtgccgggccatgggaatccgccgggtgcgggtggtagacccctacgacctgaaggccacggaggaagtggtgacagaggagctggccgcgccggaaccctcggtgatcatcacccgccgcccctgcgtgctgctcaggtcggtggagaagcatcccccctaccaggtggaaccggacaagtgcaagggctgcaagatgtgcatgcgaatcggatgtcccgccatctcctggaaggacaagaaagcggtcatcgaccccacccaatgtgtgggctgcggggtgtgtgagcagctgtgtaaatttgacgcctttcttcactgctgagttgggggagaaggggctgcttgaaaagatcattgtgtgctcccaagagcaacccgaacgggagcaggacccagagtgagccctgctcctttttcctgcccatttatttttgggaatcccaggaaaaccttgggaatataaggaaagtataaacgaaagcacggcggatgtaaagaacagagaaagagaaaatccccaatcctctgccgggcaacatatttttccggcggatttgatacattgaaacaatcagggaggatcgttctgaccggtcttttcccatgggaggaatggagcatggtaagtcagatcttggccgtgataatttttgtggtcatgtttgtggagattgtccgggagaaattcccccggtatttggtgaccctggtggcgggcgtgctgaccctggtggtggtctttctgctggccatgcagagcctccccgatgtgtggaaggcgctgagcctggagagcatggcggagaccaccttctggtacactggccacatgacggtcaatgagatgaacaccggcatcaactggagcaccattctcttcatcagcgggatgatgattatggtggagggaatgagcgaagcgggattctttgactggctgtgcctgcgcctggccaagctggtcaactataagcctgtgccgctgatgatctgctttatgatcctgtcggcggtgctgtccatgttcattgacagcattacagtgattctgtttctggcggtggccagtgtccgcttggcccacttgctgaagtttgatcccattcctctgattatcgcggagattttcaccgccaacctgggcggtgcggccaccatgagcggggacccgcccaacatcatcattggcacggccctggggctgacctttggggattttctccggaacacagggctcattgccctgctgtgcatggtggtgatggtgccctatttctatttctgcttccgcaggcagattcagagccgggatgagacggcccgcgccgcggccatgtcgctggacccccgggcgtccatttccagccggaaggcctttgttgtcaacgtgaccattttcctggtgacggtgctgctgctggtgacccatgccaagacggggctgaccgtggccacggtgggcattgtggcggccattctgaccctgctggccaaccctgccccgctgcggctgctccgaaaggtggactggcagacagtgctctttttcctgggcctgtttttgacggtgagcggattggagcagacgggggtgctggaggccatggccaatggcattgccgggatcacagggggcaacctgtcgctgatgatcgtgattctcatctggctctccgcagtggcctcggcctttgtggacaatatcccctttgcggccaccatggtgccggtgatcagttccctgtcggccaccatgggggtggacctgaataccctggcctggaccctttccatgggcacggatatcggcggcagcgccacccccattggggcctcggccaatgtggcgggcaccgccattgccgcccgggagggccaccccatcagctggggccgttactgtaaatattccgcgcccgccgcggtgattgtcgttgccatcagcatggccgtcatcctgctgcggtactgagatagagcgggcaaattctttgattggcatggaaatgggagggagtctatgctcagccaaattttggctcttatcattgcgattgtgttgttttctgcgctcctccaggggaaatatccccggtatcttctgacgctggcagccgggggcgctatggttttggtggtgttgctggggacgatgggcagcccggctgccgccctggaagccctgagtgtggatagttttgtcaagccccaattttggttcgcccacggcggggtcactgagtttaacgtggggatcaactggagtaccatcctctttctggccggcatgatgatcatggtggaggcgatgagtgaggccggctttttcgactgggtctgcctacgcctggccaaggcgttggggtttcgccccatgcctctcatgctgagctttatggtgctggcggcgctgctgtccatgtttgtggacagcattaccgtggttttgttcctggtggtggccactgcgcgcctggcgcattttctccggtttgacccggtgcccatgatcattggggagatctttgccgccaacctgggtggtgcggccaccatgagcggggacccgcccaacatcatcattgggacctccctgggcctgagcttctgggactttttgcggaacaacggcgtgatctgcctgatcggcctggtgctggtgctggtgtatttttatctctgcttccgcagtaagagtaggggagaggccgccgttgcgccggagctctgggaaattgaccccaacgatgccattcccagccggcggagatttttggcgcgggtctctattttcggcgtggtgattttactcatcgccacccataccttgacagggctcaccatgcccaccattggggtgctggcagcggcggtgacgctggtgagcaccaagacgccccaaaacctggtcaggcagatggactggaagattctcggctttatcattggcctgttccttacggtgagcgggctggagcagacaggggtcttggatggaatggcccaattcttggcggcgctgggaggagaccatgcggaccagatggttgtggttctgatttggtttaccgccattgtgtccgcttttgtggacaatattcccatggccacggtgatggtgccggtgctcctgtccctggcggagaccttgggcatggacctgcataccctgacctgggcggtgtccaaaggcacggacatcggcggcattgccacgcccatcggggcctcggccaacgtcacaggggtggcgctggcggccaaggaggggcatcccatctcctggaaacgctattgcaagtatgccatgcccgctgcagttctggtgctggtggtgagcatggtgctgatcctggcccttcactgaccggcggacaggcgggcgaccaccagctcgggacggttgttcaggcgaatgggcgcaatgctgttgcccaggccccggctgacaatgaggcgggtggtgccctgaacatacacaccggcgtcgtagaagggaaacagaccctggctgggggcgatgaccccgcccagaaggggaaggcgcacctggcccccatgggtgtggccgctgaagaccaggtccacggcgtgagccgcgtagacccccatcagttccggccggtgggacaagaggatggtgtagggggcggccgctggcagaaggcgccgcagcttggcagagaccagctccgccggggaaccgggaagcccccgcttcttgtcgaagctggggtcggccaaccccagcagggtgatggtttccccgtcccggcacagggggacggaccggtcttccaggacgaccacgccggcgtccttcagcccggatttgagggcaggatattgaggcagcctggcctcgtggttgcccgggacgaagtaagtgggggcaagttcggcggcccgtgcggcaaaggcaagggcccggggcaggttggtgcgcctggaatccaccaggtctccggtcagcacaatgaggtggggcttggcctgggagagggcctgcaggaggcggcggttctcttttccgaaggatgcgttgtgcaggtctgagacctgggcgatccgcatgccgtcgaaggcaggggggagtccgggaagggagaggggaatctcgtggattaggagggtgcgattgccccatagcacccagagaagcagggacagtaggagcagcgggaggaaaaacatggttggaaggaatctcctttttggaaagcggtttctatgggctcattgtatcatgtcccggggcagggagcaaggcaacaccgggggttgacgtgcccgccaaaatttgctacaatacccccgttcactggagggtacgccattcaggatcgtgatggtaagctggataaggtgacagactgagaggcctgttgccctgtccggctttttttgcggcatggggcggggccgaagagaaaaaccaacgaaggaaggggaacaaaacgatggatctgctgcgaggaaatataaagcacacctacttcaagtatttgggcgcggcctttggcagtgccatgctggcctcggtatatagtctggtggacatggcgatggtggggcagtatcaggggccggacggcgcagcggcgctggctgtggtggcgccggtgtggaacatcatttacagcttgggtttgctgaccggcattgggggttctgtactgtccagtacgcaccgggggcaggggaagcgccggcaggccaaccaggcctttactgtggcgctgggctttacggtgattctggcggcggccagctggctgggcctaatcttctttgaggtccccctgctgcgcttcttcggcggggacgaggcgctgatccctctggcgcgggattatttgtacccggtgaagttctcggtgcccttcttcctctttacccagatgctggcggcctttctccgcaacgatgggcggccggccctggccaccggcgcggtcctgtccgggggcgtgttcaacgtgctgggggattacttttttgtctttgtcctggacttgggtatcatgggggcgggcattgccacctgcctgggggcggcaatttcctgcctggtgatgctcacccatttcctttctcccaggaatacccttcggctggtgccggtcaagggatggatcaggcagatgggccggattggcgtgacagggttttccgcgttttttgcggacattgccatgggaattctcaccatcctgttcaaccgccagatcatgcactttctggggaccgacgccctggcggtgtacggagtcctggtcaatgtgagcaccctggtgcagtgctgcgcgtacagtgtgggacaggcctctcagcccattctctccctcaactacggggcccggcagaccagacggattttggatgtcctgcggtatgccttggggacggtggcggtctttggggtgctgtgggtgttggtgctggccgcgtttcccacggagattgtccggctgttcatggcgccgaccccggaggtcctggaggtagccccgggcattttgcggacgtatgggctgtcctttttgctgctgccgttcaatatcttttctgcctactatttccagtctattcttcggccggccagtgcctttggaatctctgtcacccgcggcctggtggtcagcgggggtctcattctcaccttgccggccctttggggcggctcggccatttggctggcgatgccgctgaccgagctggtggtggcgctggctgtggcggggttgatggtccgttccgtccggcagctcaagggggagctttgatgaagaaaacgcgcccggaggcggttcctccgggcgcgttgcgatgaaaaagggtgtcattcctcacaggagacctctggggaacgggcacggatttcgtccatgagcgcggtcaatcgatccccttgctgatggagaagggccaggtcctctggactcaggttgtgggtgataaagagctcctccattttgtgggtcagcgccaaggtcttccgggcagtgtccagaaaggtgctgtaattccggctgcgccgggcgttctggaaggcctgacggtcccgggcgatgaactgaagaacctcttccgtgctggccaggcggccctggaccatgggatagggccgggcccgctgcaggtagcaccggttttcattggtgatggtgaagatgtaggtcagggtgagcccctcccccaggtcaaaatccaccacatgctgtttgccgctgaccaccttgattctgctggcgcccagctgggagagggcggtgtcgatgaaatctccgctgaatgtagataagctcatacaaatctccttcccaaaatagaggcggccgtgggggccgccccaggtcaatcggaactgcttaggtaaaccgcaggagcaggaacacggtgctgatggccacggagaccagcatcaaggggaagcccaccttaaagtaactggcaaaggtgatggggaacccgtgacggttgctgatgcccgaaaggaccacattggccgaggcgccgatgagggtgccgttgccgcccaggcaagcgcccagggagaccgcccaccacaggggggtgacatccacgccgctgctctgcatggtgaggatcaggggaatcagggtggccacaaaggggatgttgtccaggaacgaggagacaatggccgagacccagaggatcagcagaatggtcaaggtcatgtggccttcggtcaggtccatgaggccgttggccaggatctggatcacgcccgtctcctggaggccgcccaccacgatgaacaggccggtgaagaagagaatggtggtccattccacgccggccacgatctcctccacgtcctgacggccgatgaggagcatcaccgcagcggcggtgagggcgatggtgcaggactccaagtggagctgagagtgaaagacgaatccaaacaccaccaggaggatcatgacgacgcttttgatcagcagactgcggtccttaatggctttgttctcatccagctgcagaatggagtccatggcctccggctccacatggagcttgcgcccatagataaaataaaagcagacaatggtggcggccagcacaaagagcacggcaacgccggtgttggtgatgaaatccgtaaagctcagccccgcggcgctgccaatcataatattgggggggtcgccgatcagggtggcggtgccgccgatgttggaggccatgatctgggtcatgaagaagggaatggggttgatccgcagcatgctggtaatggccagggtcatggggccgatgaggagcactgtggtcacattgtccaggaaggcggacaaaacagcggtgatcaaagcgaacaacaccatcagcggccagggccggcccttggcgattttcgcggccttaatggcaatgtattcaaagatgccggagtttttgaccacggccacgaaaagcatcatgccgatcaggacccccagggtgttgaggtccacataggaaaagccggattccaccgacaaaaccccggtgaggatcagcagcagggcgccggcgacggcggccaccgttcggtggagcttctcggtcataatggctgccatggtcaccagaaagatgacaatggcaatgatttgcgttgatgtcatggtcaatcacaatcctttccagagagaacaggggcacgctgtggggatgcggagggttcggaacaggaagaccctggaagaggatatccggcgtccgatcctccgttggattgagaccgcaagatgcccaaatgatgtcttattataaaacccaatttcttaaatggcaactattttcttatagattttccatattctgcaaaacatttgtcgaatgcggcaaggccgcgcctggcggtggaacgaaacgtgtccgataggaggctgccagggacagatcgggagagagggcagcggagccccgcttggcggcgtcatagtgggccgaacccgatttctccgtacaaaataaccgtgccttgcaagcattcaaagcctgcaaggcacggtttattgaaaacgtgataccatcgtttgagggaaacgtcaatcctccgaaagcgcctcagacacccgcgtccgcggcggtgagcgcctgggaggtgttgaagctgtatgtccagccgtcggtggtgaggacgatggagccgctctttcccgttccgtagaccgtggcccccacatcgaagaggcgctgtaaggtttccccggcgggatgatggtaggcgttgtccagcccataggagatcacggcatattccggtttgaccaccgacaggaattccgcgcaggaggcggtgtcggagccgtggtggctgacctttaggacatcaatgtccccgaagagagggagcagcttggtctccacctgctgggacatgtcgccggtgaagagaacctgaacgttgccgcaggtgagctgcgccacgacgctgcagtcgttgctgtcctcccagtcgttgccggtctccaggatggacagggcggccagagagctgagggggatgatccgatcctccccgtaggagatggtgcagccctcggcctgaactgcggcccaataatctttataggtgtcggtgtcggatttgcgcccgctgtcgatgacctctcccacctcaaaggcctccaggaccgcgtccagtccgccgacgtggtctgcgtcggggtgggtggcgatgaggtagtctaatttgccgtctatgtagggtgtgagataggagaccacctcgtcgccggcgccgttgttcccgccgtcgatcaggacctcggtttccccacagtcgatgaggatgcagtccccctggcccacgtccaagaagtggacccggagcaggctgctgccggttttgatgaccaccaggcggttggcgttgtcccaggtgacataggcgccaaaagcctccatcaccgggcggatgggcagataggtacgggtgtctacaatctgcgcggtggtgtccatttccatgcgctttccgttgaccagcaggtagggcgcgccgatgggaacctccacccgggtgccgtccttctccgccacggcagtgcgcgtctcattgttccagtagacggcacagccaaagctctccatagtcagccggaagggcacctgggtccgcccggcgctgtccaaaaaggggcggccatatccatcgtcgtacaggaccgatgtgccgtcgatggtcacaccgatttccccggcggccccagcggggagaaccagcagggacaagaccagggcaaaggagaggaccgcagcccctattttctttcccaaaatcatggtacacctccaaaatttcttttttcagtcttaatataccatgaaaccggtggacaggtcaaggatgtaaccccggcggcggaagattccgctgccggggttgggtcaggtgttttgggcctgggcggcctggtccagcatgttctgggccagaatgccatagccccggtccgcatggtcgatgagcacgtgggtgacggcccccaccagcttgccgtcctggaggatgggcgagccggacatcccctggacgatgccgccggtcttctccaagagcctggggtctgtgacccgaagcatcaggtcccgggtgtccgaggtgttggagtagactttgagaatttccaccgtgtactcctccacctccgtgccggccacattggccaggatggtggcctgtccggtgtgaacctcctccgctgtggccacaggcacaggggtgcccgtgaacgtgccggggtcctgaaggtggccgaacacgccgctctccgtgttggcgtataaggtgcccaggtcctggctggaggagaaggccccccggagttccccgggccggccgttcacccctttgaccacccctgccacggaggcgggggtaatggccccggactggagcttcatcagcaccgcggtgtccacgtcgttgatgccgtggcccagggtgccgaacaggccggtctccgggtccacaaaggtcagggtgccgatgccggccatggagtcccgaatccaagcgcccagcttgtaggcgccgtcggtgctgcactgggcggcccgggtggtcacctcctggctctcctcatcccgaaggacggtcagttccatttcctggccttccaggtcctggagtatggtctggacctcctcaatggagctgacctgggcgtcgttgatgtgggtgatgacgtccccctcctggagcccgcaggcccgggcgggagaggccagtccctggtcggtggtgatgtcggacaaccccaccaccaggacgccctgggcaaagagcttaatgcccaccgcccggcccagggggatcaccgagcggggggcgctgttctgggattccgctgcctgggcacctgggaccagcgccaccgtcataaccacggcggcggccagcaggagcagggtgcgaaagaaccataccgccacgcccgacccatggcgttcgttggtgtcctgcaagaaatcacctccctctttctcaaaacatagctgtcagcaatggtttgccctgcggtccgcgggccgcagcgcccataccggcgccggacgggctgccggcgtaccagaggggcgggccgccggaaagaccggcggggcaggcgtctttctgcggcaggacagaaagaaaaaaatggttgacaggaagcgcgaaaaaacgcgcaagcttactatggcctgttttttgaaaaaaagaagcggcaaagttacacagtgtttccttggaagagactgcttgctttttcaaagggcctttgttaagatgaaaaaagaccggaaggaccgggaaaggaggtgagatgccttgaccattcagtataaaaccaaaggggtttgctcccggcagatgaatgtaaaaatggaaaacggggtcatccaaaaagtggacatcctgggcggctgcgccggcaacagccagggcgtggcccgtctggtggagggcatgcgggcggaggacgccatcgagaagattgcggggattcgctgcggcaacaaggccacgtcatgtcccgaccagctgtcgaaggctttgcagattgccctggcggaggaggccaaacgagcgggggcctgacctgccccggcgtgccgataggatacaaaatgatttttgaaggaggaaaccatcatggcaaatctgtatttccccggctgcaaggtcaagggggactttcctgcggccagtgaaaagctggctgcgtacatccagagcaagcgggtggtgaccccggtgggctgctgccgggtggaccacgacaagctgaccccggcagataccgccgttgtggtctgcaacaactgcgccaatatcattgccgagagcggcgatcccgggcagatcgagtttgtctgggagatcattgacaacgatccggagtttcccttccccgattaccacggggagaaaatgaccatccaggactgctggctggccgtggagaagcgccacgtccaggacgccatccgatccctgatgcgcaaaatgaacattgacgtggtggaactggcggaaaaccacgaaaagacccggttctgcgggatgaatctggtggccccctgcaaccccagcaacgccaagctggcccccaaacgctatgtggaggagggcggccacatgttccagcccattcccccggaggagcaggcagcttacttccagtcgtattgtgcccagtttaccacggatcgagtggtctgctactgcaaatcctgccggggcggcttgctgaagggcgggaaaaaggccctgcacattctggaactgttgttccctgaagaatgagactgcacaagctgcctggaaagcgccaaaaaagcctggaaattttccaggctttttttgatggaaatgcaaaggatggagggattgcttccaaagggaaggttccatagaaggcctcacaccgtcagctgccgccggcgtgccaggttcaggaccccttcctgccgtttggccaggtgcggcagggtctgctccagccccagggccacggcgcggatggggtcctcggccaagtgggtctccatcccggtccgggcggccagcagggtgtccatgccctggagcaggctgccgcctccggtgaggaggatgccgctgaccgccacatcggcggccagttccggcggcgtgcgctccaggactgcctggacggcggagatgatgttctccgccaccggtgtgaaggcttccgcagtctcctccccggagagaaggatctcccggggcagccccgtgttcaggcaccggcccttgaccgccagggtttcctctcccggcccgtccacccgcccgatggcctccttgacctcttccgcggtgcgggcgccgatgagcaggctgtgcttctggcggatgtactgcatgagggcctcgtcaaactgatccccggcggtggagaggcaggcggaggccaccacgccccccagggcggtgaccgccacgtcggtggtcccgcccccgatgtccaccaccatgtggccctcgggctgggtgatgtccaccccggcccccagggcggcggccagaggctcctccatcaggtagacccgccgggcgccggcctggaggccggcctccaccaccgcccgttccgctacctcggagatgccggaggggacgcagaccagcagacggggcttcagcagccgcccgggggcggccttgtggaggaaggctcggaccatggcctcggcgatggtgcagtcggagatgatgccctcccgcagcggccgcacagccagcaggtcccccggggtccggcccagcatctgccgggcggcctcccccacctggaggacggcgcctgtgcgccggtccacagccaccaccgagggctcctggagcaggatgcccctgccccgtacggccaccagcacggaggtggtgcccaaatccatggcgatatcccgggcaaagcccccttgtacttgcttgtccatatccacgctccctttcttgcggtttgtctcatgccaaaagtatagcccaagcagagagaggctttcccacgaaatatgggaaagcctctcgggttcttcaagggtttttgggcggggtacggcagaaggccgcggccaccacctgccgggcgcccgcctggcgcagggtgcgggccgcctcattcagggtggcgccggtggtgaggatgtcgtccaggaggagaacccgctgcccggccacctgggccgggtggggcgctgtgtagaccccggccacgttggcccgccgctggcggccctgggtcagggaggactggggcggggtgtccctcgttttctccagcaggggaacggcttgggcggcaagggccctggcggtctcctgggccagcagctgcgcctggtcatagccccgccggcggagggtcttcggagagacggggacccaggtgatgaggtcgtaggtccccggcaggtaggttcgaacggcctgggccagcactgggccgtaggccttggcgtagtcccgccggccggagaacttgaaccgccgcaaagaggcgcgcaggggctcccggtaccacccggcgcagacgcaccgggcaaaggcctctcccgtcaccacggcctgggcgccttccagccagacatcgctccccaggcagtgggggcagggcgcggaaaccacggcctccacagggcggtcacagaagggacacctgggtgggaagagcaggttcagaagaaattggggcagggccatggttctcctccttttccgggccgcctcgggccagacgggcccgcagcccgctgtaccgccgctgctggcggtcgttggcggccatgcgggccaccacttggtcgtcccccaccaggatcagcagttccttggcccgggtcatggcggtgtagagaatcccccgagtgagcagcatgggggcggcctccacggcggagagaatgactgcccggtactcactgccctgggccttgtgaacggtgaccgcgtaggccagctccagctgggtcatcatatccgggggataggcggcccggtgtccgtcaaagtccaccgtgaccaggccgctggcggggtcgatggactcgatccggccgatgtctccgttgaagatgcccatgcccacgccgtcggcgtggtcttccc

SEQ ID NO: 2236 - DNA, 33403 bp, KLE1738
ccgccggcgggctcggacaaagacgcgccccgcgcggcgggcggctgcgcggggcggaaggggtggggatcaggggtcctccggcggttcttccgggggcgtgagagcctggcgggcctgctggaggtaatcccggtctgcggttttcttgctggggacaaagttctgggcgggggttttctttttgcccttgcttcgggcataaaagaagccggtgacggagaagaccagggcccccaggaaattcaccatcaggtccttcatggtgtcgatgagcccgatgtccaggtatcccggcagccccaggctgctgccgttgaccgccacatcctggatgttgtgaatggtcaccacctggttgctccgggtggggtccagggtgacggagtggatggtgtggatgatggtgtccttctgcatgtccgtgtgcaggaaggtgtccatgaaaaactcaaagaactcccacaaaaccccgatggtcatggaaaagcagaaagccagcagggccaggaaaaagggggagagctcaaaggtcagcttttcattgtcgttgagcaggatgaccatggagaagcccaccgccgcggccagaaagccgttgagggtgtggagcatggtgtcccagttggggaccaccacgtaaaaggcgttgacctcccccaggatttccgcggcgtagatgaagcagagaatggtgatctccaggggcggcggcagttcaatgcgcagcttcacctgaagccagctgggcagatagagcaggcacaaggccagcagacagaagaaggcgctctcatagcttccccgcatgatctgacgcaccagggagacgatgaccaggatgcgcagcacggaaaagaccagaaaggaactcttgtgttcccgcagctccttggccatggcctggcggaaggttctgcggttgcgccggtcctcctccatggattgcagcaggttctttttctttgccatgggacctccttacttgcccacgcagaagcgttggaaaatgcggctggtgatgtcctctcggacggttcgtcccgtcagttcccccagggcggccatggcctgctccacgtcggtgagcagggcgtcgggggtgaccccctgctccagggcctggccggcccgggccacgctctcggcggcccggcggacagcgtcggtctggcgctggttggtgagcagcagctcggaggcccgctgcccggcttgggggagcagcgcctgggcccggcggaccagttccgcttccaaaaattccaggcccaggccggttttggcgctcaggcccaccacggagagggtgtgggctgtgttctctgcccggaacatggggcagccgtagccgggcagatcgctcttgttcatcaccagaagggtgtccgcctggtccagggcctggtccagcagcgccgtgtcttcttcccccagctcctgggtcccgtcgcagaccagcaggatcaggtccgcctggtccagggcctggcggctgcgggccacccccaattgctcgatgggatcgtcgctgtcccgcaggccggcggtgtccaccagacggaagaggtatccctctaaggtgaccgtggcctccacggtgtcccgggtggtgccggggatgggggtgacgatggcccgctcatagcccgccagggcgttgagcagggaggacttgccggcgttgggccggcccaggaggacgcaggtgagaccctgggagagcagccgcccccgccgactggtccgcagcagggcggtcagggcctcctcctgggcctggagggcttcctggagttgctgggtttggaaggggtccaggtcctcgtcggggtagtccagcaccgcgcagaagtgggccatcacgtcggtcaggccgctgtaaattgcgtcaatccgccgggagagggctccggtgagctggccggcggcctgccgggcggcggcgggggtctccgcctcaatgaggtcgatgaccgcctcggcctgggtcaggtccagttttccgttgaggaaggcccgctgggtgaactccccggcccgggcctgccgggcgccggcagcgaagagggcgtccaagaccagagagaggaccatgggggagccgtggcattgaagctccgccgtctcctccccggtgtagctgtggggagcccggctgacaaaggccaggccggtgtcaagcgcctggcccgcctggtccagcagggtgccgtagaggagctgacggtccggcgcgtccggcagggcgcgggttcccttagggcggaagacccgggccgctgcttgggcggccccggggccggacagccgcagaatccccaccccccctgtcccggggggagtggcgacggcggcaatgagatcagacatggaggacctcctttccaagaaaccatttttggcgaatccaccgtcaaaatgttccttgacagcatctttcggcagccaaaaatgcatgtacgagagtatacacctattgtggacaactctgtggataatgtgtaaaacctttgggaaatctcaggttccgctgggtgggcgccccgttttttccgaaactttcatgcaaaattcgaggaaatttggttggtcagaacgcacaaagggaaaaattccttgtaaaaatgacgaaatattaacagctcgatcacaaaaagtaacaaaaaggattccactatgcctgcggtcctgtggaaaataaacgggaggccggaaggagcgcgcccgccctgtggaaaaccggcggagagagcgccttacgcgccctgaatccgttgggtgatggcccgggccgcccggaccccggaggcccccgcctgggccagcccccgggtgatcccggccccgtcgcctgcggcgaagaagttgggcagggaggtctccagatgggtggagagcttcagccgggcggagtagaacttgacctccgccccatagaggagggtgtcgtagttggcggtgcctggggccagcttgtccagggcatagatcatctcaatgatgtcgtccagctggcgcttgggcagggccagggagaggtcccccggcacggcggcggtgagggtggggtgggtggtggacttgcccattcggtgggcgttggagcgcaccccccggaccaggtccccaaaccgctggaccaagacgcccccggccagcatgttggacagggaggcgatgtgcttgccgtagcggtagggctcgtcaaagggttcggtaaaatggttggagaccaacagggcgaagttggtgttctcgctgcggagcttggggtcggagtagctgtggccattgacggtgtggatgccctccacattctccgccaccacgtggccgtagggattcatgcagaaggtgcgcacctggtccccgtactgcttggtccggtagatgagcttggactcgtagaccacgtcggtgatgtgctcgaagatcagggcgggcagctccacccgcacaccgatgtcgatttggttgttggtcatgggcaggcccagctgacggcactgctgggcaaaccactctgccccggaccggccgggggcggcgatgaggaacttggccagatactggtccccgtccgctgtctccaggcagtaccccccctctgcctggcggatggcggtgacggcggtgttgaactggaaggtgatgtcccggcgcaggtcttcgtagagattggtgagaatccgcaggttgttctccgtgcccaggtgttttacccgggcctggaggaggtggaggtcaaattccagggcctttttccgcagggcctgggcggcgggggtctccgtggaaaagacctcccgggtggccccgtgggcggtgttgatctcatccacgtagtcgatgagctccatgacctcctgctccggcatgaagtcggtgagccagccgccgaaggcggtggtaaagttatacttcccgtccgagaacgccccggccccgccgaagccgcacatggtgtggcagaccttgcagtcaatacattcccgcaccttgcccgccacaatggggcagctgcggtggtagatgtcctggccctgatccacgatcagcaccttcatccccggattgcggcggatgagctcgtagccggcaaataccccggcctctccgcagcccagaatcatggtatcgtaggttttccgcatggtatctcgttccttttctgatagaatgggaagtggaaaaatccaaaaccatctcattctaccataaaggactcgcgtgtcaaggcgaaattgacacgctgtggggtctggccggggaagaagaaacgctgccaaggcgggctgggcagcgtttggcgtcaataccgccggagaagggccaccaccttgccgatgatctgggcgtgggtgccgtcaatgggctggtagtcggagttggcggggaggagccaggtctgcccgtttttctgggagagggttttcacagtggcctcgtcctcaaaaagggccaccacgatctccccgttccgggcctggctctggcggtggatcaccaccaggtcatccgggtagattcccacccccagcatggactccccccggaccttcagggcaaagtattcctcgggatgggggccggcctggaaggggatgtactcctcaatgcactcctccgcccagatgggggccccggcggccacatggcccaccagggggatctgatcggggccggggagggacgcgtttggtagggtgatggaccgggtcttgcccccgtcccactggagcaggccggcctggcggaggtggtccagatggtacttcaccgtggagggggagcggacccccacgtgctggccgatctcccgcacggtgggggggtatcccatttggcgggtaaaggtgcggatgaagtcatagatccgctgctgttttggggtgaggttggtcatggcggcgccctcccaataccaatatcttgtagctaaaaagattgtatcacatagagacgggggaagtcaaacggatgttcgaaaaaagttccccggttttgtaccaaccggggaaccagaatggatggatcaatactgggtggtccacagggagatcagcaggacggggaccagccacagcagcaagaacagggacaggtgccaggcgcacatggcgcccagggccccggcactggagagggaggcggtgagcaccacccccacgcaggcgctgaagttcacaaaaaagctgctgaaggcagccgcccggcggatgcgcttggcgccgatgagggcctgggagaagggggcgattccctcccggcacaggacggccagaatggccggaccgtggggctggttggggcccgacagggtcacccgccgctggaggtccgggaaggtcagctgatccatgggtagccggccccacagccgcagccggtgggggttgaggttgaagtcccgggtgaccatcaccggggcgatccggtgaagcaccatgctctgcagggcgggggtgatggcggggtggagggtgtatttcagcacgaacatccccaccagctcccggtccaccgcgcagaacaccgcgtccttggcccggatgcccggggggagggcgatgccctgccggctcataaagtcgctgttgcccaccaggatctgctgcccctggcactggcccagcaggccggtctcctgcatgacgattttttcaatggggaggtagccgctcccctccgcccggaccagcttgtcaaacagataggtgagccccgagccagaggcccggatgaccgaggcggtgaaggccacggtccgctccatggacaggctgccgaatacccgggaacccgccagggccacggtgccggggggatagatgtcctggtccagcagcagggcggccttgcaccccttgccggccagcaggccgggccagcccgccagggccacccccagcttggccagcttcccccccagcatccgcagggggagattgagggcgagggagacgcccaaggtggccgcggcggtgaacagggccgacagagaccaaaagatcaggttgggctggtggtgggccacggtggtgaccagggacaggcagaagcaggccaccagcagcaccggggtcagccggcggaaccgggcctcggcctggctggtggtgcggatctggctgccaaagcccttgggaacccccagccacttgcggaaagcggtccgtccccccaggacattggggtcctgggtgaccaggtagggctgggacacggaggcggccacccggcaggcctgaaatttggccgaccggtcacagtagcgccccagcagatgaaaggtcagcaccagggcgcagggggagaagaaggggatggcgctctcccgcaggggggtaaagaccatggtgacaccgtccaccagggtgaacagggcggcaaacagggccagggtgtccccgttgggggccaggttggtcagctggaccaggccctccttgagcacgtccaggctcagcaggacgcaccctgcgaacagggccagactgcccagcagcaggatgttggcgggcaggaggctgtccagcaccggcagcacgccgctgtccagcagggcaaaaagcaggagcaccgccgagagcaccccggcagcggtgcattttcccttcagggcctgcagccccaggccgtattcctccgccagctgggccggcggggcgtcggggggcgggggcgcttccgcccgggccttccgttcccggaaggggtgaaaccccgtgccctcctggggcggcgtctggggcttgcccggggggacggtctgcccgccgggggcggccttgggaccggtgggggttccctgtccgggggcttggggaccctgggccgcctggcctgtctggcccggggccggcggaccctgcatgggcggctgttccgccgctccgtccccttcgggggtagccggttggtcctgggcttgctgggcggctgccttggggtccggggtgaaggcgatgagctccggcccgtcgtcctggggcactcccacctctgtctcatcctgggagggcgccggggcctcctccggggcgggggcctctggagcgggggccgcctgttctccttctggcggcgtgtccggggaaggcgccggttcgccggcgggctggggcgtcggggatgcgggtgccggggcgggggccttctcctggggcgggtcctgcttgggggactgggccggcggtattttcttcgctggggcctgattggccggcagcggctggttggcgggtaggggctggctggccggccggggcgccgcgggtttgggggccggcggggcggccggggcaggggagaccggctggggagaggtaatccccggctttgccggggcggctgccggcggtttgggcgcttggggcgcctccgggggcagggggaccgagggcccggccggcgtctccggcggggtgtagtcggcgtactcccacaggatatcccctaagctgaaatgattgtcatctgccatagcatcaaaacctccctgcgcccatgggcgctgcgatggaacgaaatggggcggggtcagctgcccaggcgctgccgcagggcctcatacagcaggatggcggcggccgcgctggcgttgagggaattgagcttcccccgcatgggaatgcggaccagaaaatcacaggtctcggagaccagccggctcatgcccgatccctctgagccgatgaccagggcggcggggcctttcaggtcagccgcgtacagagaggtggttccgtcggcggcggagccaaagatccaaaggccctcctccttgagccgcttgagcagggagggcaggttggccacccgggccacggggaggtgggagaccgccccggcggaggtcttggccaccacggcggtcaggccggcgctgcggcgcttggggatgatgaccccgtgggccccggcgcactcggcggtgcggatcaccgcccctaagttatgggggtcggagagctcgtcgcagaccaccagcagggggggctcccctttgtcccgggcggcctggaggatgtcctccaccgtggcgtaggcccggaccgcggccacggcgatgaccccctggtgggcgtgggtgcggctcatgccgtccagcttccgcttgtccgcgtcggccaccacgatgccctggctgcgggcggtggaggcgatgtgacccagggcggtgtccacctctcccttcataatgaaaattttgtcgatctgggtgccggcccgcagggcctcgatcaccgcgttgcggccctcgatgattccgtcggcgggggcctcgtcccctgcccggtcagggcggggctggttgtgtttgtactgcataagactccaatcccggcgcgtcggccgaaggaagaaatttcagggaaaaaaagcagagaacctgcatattttaggtattatatcatggatttcagggaagaaaaagccccttttcccgggaaatttcaggagagagaattccggtcccgcttccgccaaccacgtccgcctggtcagggggaaaatttcataaattcttaacacctatgtcacaggccgttccttgcaataaaaagggaaatatgataccataccgttatcaaatggggaaagtttttcccggcaaactatctgccaagcgcggtgggataccctgcccgcaaatgacataaaccagaaaaacgggggcgctcccccggaacggaggacagatactgttgagttccaatccaaacaacaagggcaagggcggcggccaaggcccgcgcaaacgcggctttattttcggggccattctctgggccctggtcctggtcattttctttaatttcctggccaagcagattgccaacgccggcaccaaggaggttccctactccgagttcatccagatggtggaggaggacaaggtggccaccgtggagctgaccagcaacaaatataccttttacctcaaggaagacctgcctgccggcgcgggggaaggaggcagccaagacctggcggaggtgctggcccagcagatggagcagggcggcgccacccggtatgtcaccgcgccggtggtggcccgggacgacagcctgatctccctgctgaaagagcatgatgtggagtattattcccccatgcaggaggaatcctcctatctcatgagcctgctgctgagctatgtggtgcccatgatcctgatggtgggcctgctggtcttcctgatgcgccggatgagcggcggcatggggggcctgggcggcgtgggcaaggccaatgccaaggtctacatggagaaatccaccggcgtcaccttcgcggacgtggccggtcaggacgaggccaaggagtccctggtggagatcattgattttctccacaaccccggcaaatacaccgagatcggcgccaagctccccaagggcgccctgctggtgggcccgccgggcaccggcaaaaccctgctggccaaggccgtggccggggaggccaacgtccccttcttctccatctccggctcggactttgtggagatgttcgtgggcgtgggggcctcccgggtccgggacctgttcaaagaggccaacaaggtggccccctgcatcgttttcatcgacgagattgacaccatcggcaagtcccgggacaaccgtatgggcggcaacgacgagcgggagcagaccctgaaccagctgctggcggaaatggacggctttgaccccaccaagggggtcatcctcctggccgccaccaaccggccggaggtgctggaccaggccctgctgcggcccggccggttcgaccgccggatcaccattgaccggcccaacctggccggccggctggccaccctccaggtgcacacccgccggattcgcctgtccgaggatgtggacctgcggaaggtggccctggccaccgccggctgcgtgggggccgacctggccaatctggtcaacgaggccgccctccgggcggtccgcctgggccgccgggcggtgaatcagcaggaccttctgtccgcctttgaactggtcattgccggcacggagaagaagggcagcgtgctgacggagtttgagaaaaaactggtggcctaccacgaggtgggccacgccatggtggcctataagcagaagaacaccgagccggtgcagaagatcaccatcgtcccccacacccagggctccctgggctataccctgctcatgcccgaggaagataaaactgagcttcgcacccgggacgagctgctggcccgaatcgccgtgtccatgggcggccgggccgcggaggaagtggtgctgaacaccatgaccaacggcgcggcccaggacatccaggacgccactgccgtggcccggaacatggtggccatgtacggcatgagcgaccgctttggcatgatggctctggcctccaagcgcagccagtacctggacgggggctacggcatggactgcgcccaggacaccgccgccgccctggacgaggcggtccgggacatcctggaccagtgctacgccacagcggtggagatcatccgggagagccgggcggagatggaccaggtggtggcctacctgctggagaaggagaccatcaccggcgcggagatggtggccatcatccagggccgggaccccgccacggcggactcccccctgctggccccgggccccgagacccccgcaggggcggaagggtccccggaggttccctctgtccccgcgccccagctggggggagaagaccagggggaggcaccgcctcccgtcccagaggagacaccgaaggagtgacccgccctgggcacccatccaaagagcaggccccgcccgggaatgacacccgggcggggcttttttagagaggagggacgccatgagacccattccccccgccccggcccccggacagcggattctgctgatccccgccatgttggacgcccatttccctctgctccagtatgcctttcactccaaggcctattacccggtgatcctgtcccagagcagggggcttgcggacctgggcctgcgctatgcccacaatgacctgtgctatccctttgttctcagcctgggtcagtatctccaggccctgggcagcggggcctatgacctggaccaggtgagcctgctgatgccctcggcgggggatgcctgccgggggtccaactttcccagcctgatccgcaaggccctggccgcggcggggtatccccaggtggaggtcctcacttggaacgtcaaggggctggaacgggaccatgccctgccccttcggccggagatggtctggcgggcgctgtttggcctgttttacggggaccttctcctgctgcttaccctgcagacccggccctatgaggccgtggccggggcggccaacgcctgccgggaccggtggaccaaccagctggccggggaactgcgcagcggcgcccccttgaccctccgcaggatgaaggaagtctttcaccaggccgccggggactttgccgccctgccccgccggccggtggccaggaagcgggtggccctggtgggggagctctacaccaaatactgcgccctgggcaactgggacatcctcccctttctggaggaggcgggctgtgaggtggcggtgaatggcttctcctggtacattctctactatatcagcagtcagatcgccggaacgacggggcccgtccaggccctgtggcggggcttgggcgcctggatggcggggctccagcggaccatgacggcggccctggcagcccacgggtttcacagcctgcccccctttcccgcctttcagcgggaggcggcggactggatcagccaaaccctgcgggtggctgacggatggctcatcggggccgagtgcgccgcccacatccatgccggctgtcaccgggttttggccatgcagccctttggctgtctgcccaaccatgtgtgcggccggggacagtacgcggccctcctgcgccggctgggccggggcaaagtggtcagtgtggacctggacgccagcctgccccgcctgctggtgtacaaccgggtcaagctcctgctggagggcgagggatgaggaaaaccctctccgaaccgcaagggttcggagagggttttgtgctgtttgtacaatctatactggtcgaaagatacagcgtatgtttggggattgggtcagaggagccgttgggcggcctcccagtcggattttttcacatataccaggtaataccagttctgctccatctggtgtagcagagtgccgccccgctcccggctgccgaagtttagggcggaaggggaggagcggtctaccgtttttacagtgtattcgatccctgcctggtccagagcttgacacagagaatcccggcgggcgggatcaaagagagggggcagctgggcacggttaaaaatggagatcatagagaaagcctcccgtgttaaaggtgtgtattttggcgtcctttgcgccgcagtctttaaggcgcggcctcccgcataataatcaggtccaggaactgggcattgcgtaccacataggtggccacggagcccagtttttgcagggggcctcgggaggagcgggtcataaccagggcgtcaaaaccccgctcccgggcgtagtagacgatttccgggccggggctgccccacagcagttcggtgcggactgtccagccgggcagcagggcggcgaaggtttccagctcctgggcggccttgcgggccatccggtcccgggcgaattggccgtcgatgtgcatttggtcgggcaggaccatcagaagggtgacctcggtgtcctgggggcggtaggtctgttggaccatgtcgatggtgcgcaggctgcgggtacttccgtcaatgggcaagagcacgtgtttcatggaattcgacctcctatccagatgggtgggaaccatggtggaaaaggggaaaggcggtggcctttccccttttgtggacagatgacagatgattcacgcctcccgcaggacagtggtggtgatgaaggaggcattctgcacaatataagtggagaccgagcccagcttctgggtggacccccggctggaacgggtcatcaagatggcgtcaaagccgccctccttggcgaactggatgatctccggtcccgggctgccgaagcgcagggcggcggtcgtctgatacccggggagcatcttggcaaaggattccaccagtaggcgggcctcctccttggtctgggggtcttgagtgatctcctcatggtcgggcatgggggtgacctcgtcattttcgtcggtgagcttggagggacgggggtcgggcacgaccagcaggatggtgatctctgtctcagcgggaatgtaggactgcttcaccacctggatggtgcgcaggctgcgggggcttccgtcgatgggcagtaggatcttcttcataagggttacctccaatcatacagcggacacttggcgcggagcaatggggcggtctctgggggcgttattcgtcgccctcctcccgcatgacaatgacatccaggaaagaggcgttgcggacgatgtaggtggccacggagcccagcttccgcaagggccctcgggaggagcgggtcatgataatcatttctgtgccggattccttggcatactctacaatttcaacgccgggggcgctgcccagcaggacctgggttttcacttgataaccggggagcatgtcggccacggcagtcagctcaggctgggccttctccgcgttgtgcttgatctcatccatggagttgatgtacagctgggcgctgaccaccttcacgacggtgatgtcgctgtcggcggggtcacacagctgcttcaccatttccacggtgcggatgctgcgcttgctgccgtcaaccggcaagagaattttcttcatggcaaaaacctccttcggcgtggaccctttttccagcctcattatacaactaaaacaaaataaagtcaaggaaaggggacaagctttgggaaaatatccaaaaatgacgggaggactatttgccgtggatgatggtataggcgtggggaatggcttcaatctccaccgtctggtgggccccgccggcctccccgtccagggtccagaggagctctgcggcggcggtgatcttcaccttggcggtggaaaaggtggtcatcatggagttgagaatggagggatcggtcatgagcagcgcccggctgaactcctccatgtctttgacatcccggatgggggagatgagggtgacctccagaaggccgtcggacagatcggggtttcccgggggaaagttgcggaaccggcccacggaagtggtattgctgaccatgccgtagaggtaatccccctccagaacctggtcttcccactccaccttgatgtggtagggcttgatggaggccaaatttttcaccacttctaatatataggcgttgtaccccagcagattcttggccttttggggggtggagtaggcgatctccgtaaaggccccaaaggcagccacgtagaggaagcttctcccgttgaaccggcccaggtcatgggtgtggggcacgccggtgaccgcggtggcggccagctccgtgagcttgtccaggggcaggtccaggtttttggaaaagtcgttggtggtgcccacggggatgtatccgatgactgggggctccggcagccgggtggcgccggcgatggcttcgctgagggtaccgtcccctccggccaccacgatctggtcaaatgcgctgctccagcggacaatggcatcccccgcgtctccccggtactgggtggggtaggcggtgatgaggcagtcctgctctgtcatggtgttaatcatgtcggacaaattggcccaggtcttgttttttcccgcgtggcggttatagataaaaaggacgtgtttcacgaggtctcctccttatggcaagattggtcagggtcaaggggacggaccctggggcggcagggtttaagatcatataaagaaaattataaacccttggttttccgttgacaataggcacattgacgggatatactgattttcgtaagaaacccctcagggatttacagaaatttccagtcgcgaagggagagagaagggcgtgggaatgcggaaaacggagctgctggacaaatatgcccgggatggagacagccgcctactgctggcccgggtgctggaccagtggcagcgggccgagcagcggggcgttcccacccacaccggctttctctccccggcggagcaggcggtgagcgcggacctgctcatggccgcggccccgggacaggggattttagcgggaggctatcccgacgccgagcgaaggctgtgggcctttctccccgactggctggaggaggagacctggcagcagggggaggagtgccctctgtgcgccctggaggtggagaccccgccgggggccggtctcacccaccgggactatctgggctccctcatgggcctgggcctgacccgggagaagctgggggatattctcctctcccaacagggggcccaggtggtggtgctgcgggaggtgctgcccattctcctgtcccagtgggagaaggtggggcggtacccggtgcggctgacccccatccctttggcgcagctgcgccccgtcccgggggagcgaaagcagattcgggccacggtggcctccccccggctggacgctgtggcggcggcggggttctccattccccggagccgggccgccgagctgatccggggcggccgggtgatggtgaaccaccggccctgcggcaaagccgacaaggctgtggaggcaggggatgtgctcacctgccggggcctgggaaagtgtgtgctgcgggagatcggcggcacctccaagcggggcaggaccattttggagctggaacggtatttgtaaaagagagagagcgaggaacccgctccgggcagaaaagccggcccggggacgggaagttccatagaagcaagaaaggattgcctacgatgacagaagaacgcattgcccgcctgaatgaattggcccggaagagcaagaccattggcctgaccgaggaggaaaagcaggagcaggctctgctgcgccaggagtatctggccgccatccgccagagcctggaggcccagctggacaacgtctacattgtggaaaaggatggcacccagaccaagctgaagaaaaaggagcagggccccctgtcctaacacccgagcaaaccgccgtccggcgttttgtacggcggccccgccgcccaatataaggaggaaacattaccatgcccagtatgtacgtcaacgttccccgtctggaacaggagaccaaaaacaccctggtggccaagctctatgacgccgccgcccccgttctgaaggccccccacatctacaccttcgtcaacgagtatgagaccctctacgaaaacggccagcccgccccccagaagatggtggtggccaacatcgaggccggccccatcaaggaggagaaggtcaatgccatcgccgagggcatgcgcgcggcggtgcgggaggttctgggagaggacaaggacctgaccctggtcttccacgacaacggcctggaccgcattgccattggcggcgtgaccattgccacgaagatgaaaaagtaagctgcgagacaggaaatcgccccctgttcattcagaacagggggcgattctgtgatagggaaaggagttaaggatatggatatactcattgttatgtgcattggaattcttgtgggaaggcttcctttgctgcgccggatgaaaaagaaaaatgaaggtctctctttgctctgtacatttcttctaatttttgctatgggtgttatgcttggggagaaagagaacttttttgaggaactgtcatctctgggattcacaagttttctgttctttttgcttcccaccggattctccattatactggtttattacttaacaaaagtttttatgaaaaaagaaaaaaattctgaggaaagggaagaggcaaagtgattgtcgttttaacggttctttctttggttttagggattgcctacggctatttggacgttgagaatacatttatctctatgatttcccaaaatacgcaggtcattttgtatgtattgatgttctctgtgggcataagcataggaatgcacgatgggataatgaagaaactgaaagagtatcatgttaaaattttcattattccggtggggattatactgggttcgcttttcgggggactgctttgcgcggcaatattcaaaatttccgtcggccatgcaacggctattgcaagtggattgggatggtacagttttgctggtgcgacaatcagcaaattagcgggagcggaattggggagtatcgcgtttctgagcaaccttatgagggaactcttctcgttttttattattccatttttagcggctcaccttggatactatacctgtattgcacccgctggcgcgaccagtgaagacacgacgttacccgtcatgttgaaatataccaatgaggaaacggtggtgctgtctgttttgaatggtatcatttgttccttttttgtccctatactgatatcagtatgtctttctgttgtgtaacaaggttgcgggacagggaagggggaatattggcgcaagatatatcgtgaataattccttgtgttcctatggatgagaggtatttttgtcctttgagggttctttctttataaatcgcccgatatatttattcagctccccgttttcaagaaaacagggagctttttatgcgcgatcaagggacaatctggttttgcactgtgttaggtgccctgtgggacgctgtggtttcaaaggttgttggtacatacgcctgcaaccccgcgggcaattaacggcaggcctcttccggtcggcgtccgatcccttttttctggtcctccaactgtgcttgcaaccgatttgctaaagttggacagccgcagtccaaggagagctggattccatgggccaggaatgaaagggcggtgtttcgtggcagctcgtccgcattgtgaacggcccaccaaggaaatgctctgcagaacccctctttttcagcgatcaggaacagatagccgatcagcgtgtggtctcggaacaaaaaaagatactggggcagcgttcccggccgggatttttccatttcttttttcatggttcttcgcgtcccatgcgcgggagaacaaccgagggaacggagctgcttgcacacggcgtctctttcttggggcgggaggtctaaatagtttagaatgcgttccatggtcacctccggtggcaggatgggtcttgaaaaggggccgggtcaagggatggaaggggaggggcggccctcagccgtcggtctggtccgattccatgtccggaaatagccccaccagcgccccgcccagggaggaggtctcccaccacagggccaggtcgatcacccgcgcctccccctcatccagtatggtgcacaggaggacggattctccctcggtcatggcggtgaggggaacccagtgccagctgtccaggtttttgagggctccgtgggagaagttgaggaaggccacgggacagtcctggtccaggcactgggcgacgaattgccggcactggtccagggagggccgggcctcccgctgggcggggatctccagcacctgcccctggagacggcatccccgggacagggcgaaggagcggcagcccagcaccaggctctccggcttgtccagcccccgggcaccgggggtgacgtagggccagagggcctccatgtagcggagaaagcccgcctgggtcctggccgccgccggtaccatggggcggagcccggggcgggtctgggacagataggacagcagagcggcggcggtggtgggcccgcagcccgcccggcgctgccagaggtcccggtaccattcctggtccccgccctggtaagtctccccctgggggccggtgatggtcagccgttccgggtgtgtcaagctgtggggcataacaagggcctcctttccgtgaaacagaaccgggggacggaatgatccgtcccccagggttgtttgcagtgggcgccagggagaatcacttctggttctccgggtcggccatgcccttggccatgaggccaaggtagctctccgcgttggcaatgctgccggccacgtcctcatcggtgagggttttcttcactttgccgggtacccccaccaccaggcttttgggggggacgatggtgcccgcagccaccacggccccggcgcccacgatggagcccgcgccgatcaccgcgtggtccagaaccacggcgttcatgccgatgaggcagttgtcctccaccgtgcagccgtgaaggaccgccccgtggcccacggtgacgtattggcccaccaccacgttgcagcccgcgtccccgtggaggacgcagttgtcctggacgctggtggccttgcccacggtgatggattcctggtcgccccggaggacggcgttgtaccagatgttggcctgttcgtcaatggtcacgtccccccggacgaaggccccgggggccacccaggcggtgggatggatctttggcatgggggacctccttactggtgcagcacccgcacccggaggaccccgggcagggcggcgatggcggcggtgtctacctgggcgtcggtgtccagcaggaagtagccgtactcaccccgggtcttggaggcggaggccacagcgggaaccgcggcggcgatggcggcggcgtcagcccccttggtgagcacgcacacccggttcttggcggcccaggccatggacaggacgggaagattcacggagttgacaatgttgccgttgtccaggtaatctctcacctgacgggcggccatcatggcgcagttgtcctcgctctccggggtggaggcgcccaggtgggggatggccaccacaccctccatggcggcggtttcgctgttggggaagtcggtgacataggccgcgcatttgccggaggccagggcggccttcagggcctcggtgtccaccagctcacccctggccaggttgacaatgcggaccccgtccttcatggcggcgaaggcggcgtcgttgagggtccccttggtctcgggggtcatgggcaggtggagggagatataatcggcctggccgtagagctcctccagggtggagaccaccttcacgccgggggtcaggttcagggcgtgctgcacggacaggaaggggtcatagcccacaatctgcatgcccagggcggcggcggcgttggccaccagcacgccgatggcccccaggcccaccacacccagggttttgccctggatctccggacccacgtaggcggccttgcccttttccaccacggcggccacgtcggcgccggcggcagcctgctccttcacccaggtgatgccctgggagatcttccgggaggccagcagcagggcggcaatggtaagctccttcaccccgttggcgttggcgccgggggtgttgaagaccacaatgcccgcctcggcggcccggtccagggggatgttgttcaccccggccccggcccgggcgatgcacagcagctcggcggggaagtcatagtcgtggagcttggccgaacgcaccagaatggcgtcctcgtgctccatggtgtcgctgatctcgaaccggtcgtccagctcggccaggccgatcttggagatcttattcatcgtcttaacatggtacataacgacagcatttcctttcttaatctaccgaaaaattgagagcccagcgaagcgggtcttaattttctttgtcgaacttctggatgaagtcacacagcttctccacaccctcggtgggcatggcgttgtagatggaggcccgcatgccgcccacggaccggtggcccttcaggttggtgaagcccgccttcacggactcggccacaaatttggcgtccatctcctcggaggcggagcggaaggtcacgttcatgtgggagcgggagcccttttcggcggagacggtgaagagcttggcattgtccagtacgtcgtagagcatctgggccttcttctggttgatcttctccatgccggccgcgccgccctgctgctccagccagtcgcacatgagacccagcatgtagatgcaccagcaggggggggtgttgtacatggagtccttgtcgatcatggacttgtaattcataatggcgggggtgatgggcaactcctggccggccaggtcctcccggatgatgacaatggtcaggccggcgggggccaggttcttctgggcgccggcgaagatcaggccgaacttgctcacatccaccgggcgggagaggatgtccgaggacatgtcgcaggccaggggcacggagccggtctcggggacgtactgccactgggtgccctcaatggtgttgttggagcagtagtagaaataggaggcatcggggttcagcttcagctgctcctgggcggggatgtagacatgcttgcggtcctcagaggaggcggcgatggtgacctgaccgtacttcttggcctccttcatggccaggttggcaaagtgaccggtcacggcatagtcggcctggccggttttgccgatgaggttcagggggatcatcccaaactgcatggtgccgccgccctggaggaagaggaccttgtagccctcgggcacacccagcagcttccggaatttttcctgggtttcgtcaaaaatcttcagaaagattttggagcggtggctcatttccatcacggacatgccggagccgccgtagttggtgatctccgcaccggcccgctgaaggacctccaagggcagcatggagggacctgccgagaagttgaaaacacgatcatttgccataagaattacccctttctaatttcaaacagagcaaccattgccgggcgacggcaatgggagttatcccgattttatttattatatccgtctaaaccgaccccgtcaagaatccagggaccttctttgcaaaccttagaattttctcaaaaaaaccagaggaggggagcctggcattttgtgaaaaaatgggggcaaattgccctctgcttgtactttctcagggggatgaatgtccgcaaaagggagatttctctggagaaaggaggggaaaaaggccagggcacggcgggaggccgtgccctgggaggggataggaagtattacacttcttcttttaggaatctgcggttttaattgttacgctgagggcccctccgaacaatccaggaatggtgacttccagggtcaggtctgctgattggtcagaagaaatcacaatagtatatgttgcagctgaaagatcactcggaaacgccattgctacaacgttttcttctttgtctaaataacaggtgttcccgatgccaatatcatcgagggaatcttcaaaagagtattccgccgtagaattccttactatacgagatatcttgctcacccatgcctgatccgcttcgtcaaatttcagttcataataagtattgccagaagagtttgtcttcttttcaatactgggcgccgtggtgggaacagaaatagaaggttcctcggggcctgggtccgggtctgtactatctgtcaccaggtttccatcgctgcccacagtgaaggtcaaatcttcgtagccagttgccgagacggtgacagctacctcttctccagaaggaaagcaggctacactaaaatcgaggtaggctgcgccttgactgccaatgccgattttgaagcctttcacatcgtcatcaagaaaagatgttttttcacacagatcaccatttaaggtggcggaggttactgcgttcagataagcactcacatcgtcatcgttatcgcggaaagacacccgataatactcatcgtatcctgtttgatgggtaatttcctgaaccgttgggggctcttttgctgtgggctccggggtttcctctttttctttcatcgtaaaggttaccgtctgtttctcatagccatacgctgcggaaagggtcagagtatatgtccccgctacgtttgcccacgattccgtaaacagatttttaccgagcgttaatgtggttccgttgaaagaatagccatagcctgtgccttcctgaccctcagggaggacggatctttcctgctcattcggccccgtcagttttacagaagtgatgctggcgaagaaatcacacgtgtcaccgctgtgatggccgttgcaggtaattaccacagcctctcccagcgcaatgggctctgccggcgcattcagagaaacctcctccagcgccttctgatacgagaaggtgagcttggcggtctggtagccctccacggagagggtcagggtgttggcgcccagctccagcttggttccaagcttctcttggtccagggtgatggtgcccgctgctttgtcaatggtataggcgtccgtgtccagttccgcgccgctgtacgtggcgtcattcaggtagagcttgccctgttctgccagagcagtcagatatgctttatccttgcacaggaatataggatcggtaccctcggtgacgtgggagaccgcggtatactggccgtcctcctcctttaccagggtcaggtccggcacaggcttgctggcggtctcgctgaaggaagtggtttctcccagcaggttgtcttccaggacctgcttgaccgcgtaggggcggttgagggtggtcacggcactgccggtttggatgtactcggcaaaggacaggtatgtgcctctgctctgcgcggtattgacggcgtcaaagtagccgctggctgtgtagacttcctctgccccttccagatagaccgcgtcgtgggtcatgctgtcccagcgctccacaatggcctgggcggacgcgttgccggttttcagctcggtcataatttctgcgttgatcagcaggtctgcctggaagaccaggtttgcgttcatggtgttgctgccgccctcagacccggaaccggaggtggcgccgccgctgctggtggagccggacagggcgtcgatggcaagccccttgggcaggttggcggaggccgggtccgttcctttcgttacctcgaattttttcgaaaaggactggaacccgtccgcgtataccgtcagctggtatgtccccttggtggggatatgattggttttgtcgttgtacagcacgaaggtatcgccaatcaggtaccagtcgtcaagtttggtgagggtggtggttttgccggcggggtcggtcaggtccacccggtagatgggcatggtgatgccgtaggtcatatcctggacctggaagtggacattcttgccagattctaccgaggcttcggtgagggtcatggaggggacggtttcgtttaccacgtggatggggaagagcttgctctctccctgggaggtgacccgcagctgatagcggccgttggagaagaagttgctctgtcccagggggacctggatgcaggccacggtgccgccgttgtgggggtatgccttgtccagggtgtagtccagcttctcgttgagggtgttgtttctctcatccgcggccaccagggccacgttggtgatcccgtccacccaggctttttccgcctcggtgccgttggcgtagttgaacatcagttccacggtgccgcttacgttatagatgtttccggcggaatcgtccttcttcagaaccgcatcgggagagtagtatgcaatggcatccgcgtcctggttggtcaggctgaaggtggtcttgccgggcttgacgcggacctgtccggcggcgtcgtaattggtcagatgatagtcccaaacatagaccggaccgttggtcaggaagtaataggtctctgctttttctccgaccgccggtgccgtgggattggcgttgtcggtcagggcaaccgtctggcgctggctgcccttggagatcaccactttggcggggttcagggcggtaatctcccacttgaccagggaaccgtcgtcggtgactggggtgcaggcgctggtgacatcggtgccatccacggtcacggtgcagttttccaggctgttgccgtcggtgaagcgcaccgccacgaactggctccagcccaggtccaccagcttggtctggctggccaccaccaggtcctgctgggtggtgccgccgcccccaccggaggaactgcccccaccggaggagctgcctccgccggaaccgccgctggaagagggaacggtttccgttttgccgggggagacggttttgtcgccagccttgattccggtgaccccgtcagcggcggataccttggttccctgggtggagactgtcacttggctggcattggcctggacggaggagaccttgccgttgccggtgatccgggtgttctcggccgccacggtaatggcgtccacggcggcccccttctcaacggtgatgtgggcggactcggacacgagtacccggtctaccttaccgtcgatggagaggtcagactgaaccgtgaccgtccccagatcgcaggcagaggcgtccagacgggtggtgccattggggtttgccaccacggtgccgctgccggcggaggtgccggtgagctggacgccctctccgccgccgcggatgacgatccgtcccgttacacggacgttgtccagggagacgttggccgcgccatcggccaggatcaggtccccgtgaaccgtcaagtggtccagggagacggcgtccccccggacaatcacattgcccgccaccatccgggccgcggggccgctctggtccacataggtgccggccagattgctgatgacctgggcaaactccgcccgggtgatctgggacttggggttgagcttgccattggagccggtgacgtagccgttctccaccagggcggccaccgcgtttgcggcccaggaggagacctctcccttgtccgggaaggtgttcagcgcgtcggtgtcctccgcctccagcacaaaggcccgggccagcacggcgaaggcctgctcccgggtgatgggctgattgggccgcaaggcgccgttgtccccttggaaggtccccatctgcacggccttggccagctcttcatagtaccagtctgtgggtgccacatcctcataaccggacagggaggccgtggctgtggcgccgaaagcccggttgaccatggtggccatctgggcccgggtcagcaggccggtgggattgatttttccatcgtaaccgttcagcagtccattttccacggcctggctcagggccggggccgaccagtccgacggaaaatccgtaaagtcgtctgctgtggcagccacagcaggggttgataggagcagagcccctatcaaccccatgataacagggttcttgtctctcattgtgttcctcctatggatgggattagctaacgctaattcttggggtgaaaagggccttctgccgcagaggcggcagaaggtgattagcgaatgctaaccaacgagccttagtgtagcacggcggttttttcctgtcaattccgtccccgctggaaatccgccggaaacgcccaaaaatccagggagaaacccagtaaaaaacgctgccctggggcagcgcggcaaagggggaagacagcccggccgaccgggaaagtcacaaaagttcttgttttccctcttgctattttcgacaaatattgttacaataaacccgaaaaacaaaaaaagcggcagtttccgggagcggcaactcccggaaacctgtccaggtgaacagagcacctacacaacggccaccaggccgcaccgcaagatgattataccgttttttcaccccgtatgtaagagggtttcttgcctttcaacgggaacaaaccaaccttcctttttccatttttcgtggaaaatacgtataactttcgccggttgacgataccgcgacggacggccgcaggccgccggtgagctggcaagtccttttccccgtcccgccgaggggcggtggcatggaaggaaactcccggctgagtggagagaaaagggcggaagaaaaacatccctgcggcgcgttgtgcgtaccaagacgatgctgtcgtttgttatgctgtgtaggatctgcccctgcacggcattttgtttttctccggccggtctggggaggatggttggcctccccggacgtcaggcggaaagggagtggatgaaagccgccggaggttctccggcggcttttgtcatggggcgatgcggatagtcgggcaaagcggctttccggcatgagggaaaaaaggcggcggtccaaatggaccgccgccaaaattacatgattctgccagagaatggaagtgtattagcacttctcgaagatggcagccacgcccaggccgccgccgatgcacagggtagccagacccttcttggcgtcgggacgcttcatcatctcgtggagcagggtgacaatgatccgggcgccggagcagccgacggggtggccgatggcgatggcgccgccgttgacgttgaccttggacatgtcaaagcccagctcacgggccacggcgatggactgagcagcaaaagcctcgttggcctcgatcaggtccatgtcgtcgatggtcaggccggccttggacagagcctggcgggaagcggggatggggccggtgcccatgatcttgggatcgacgccgccctggccccaggagaccaccttgaacaggggcttcaggccgtacttcttcacagcttcctcggaggcgatgatgatggcggctgcgccgtcgttcaggccggaggcgttgccggcggtgacccgctgcacgccggtgttgtcggcggagggggtcatgtgggtggcctcgaaggtcatctccaccttgtccagcgcaccgtcagcggaggtggggaaggcacccttcagcttggccatcttctccagggtggtgtccttgggatgctcgtccaccttgaactccacggtctccttcttcttctttaccatgacaggcacgatctcgtcctcgaagcggccggacttgatggcggccagagccttcatctgggagttgtagccgaactcgtccagctcttcccgggtgatgccccagatgtcgcagatgttctcagcggtggtacccatgtgatagttgttgtaagcgtcccacaggccgtccttgatcatggtgtcgatgatctgggtgtggcccatccgggcgccccaacggttggtggggatggcatagggagcgccgctcatgctctcggtgccgccgcacatcaccaggtcggcgtcgccgcactggatggcgcgggcaccctcgatgacggacttcaggccggagccgcagaccatgctgacggtgtaggcgggcaccttcaggggcacaccggccttgaccatgcactgacgggccacgttctggccctgagcggcggacaggacgttgccgaacataacctcgtccagccattcgcccttgacgttgccgcgcttgagggcctcggcaatgacggtggcgcccaggtcagcggcggggacatcccgcagggagccgccgaaggtgccgacagcagtacggcaggaactgatgacatatacgtctctcatgatagatcgtacctccaaaaaagtttaacaggtatgcataaagcgtacatttaccgcaacattatacttgccgtgcctgcaaaaatcaactgtatttttgaaaatttccggggcatttccaagttttttggcggcccggcgggttactccgccgaatctgggaagagggcgtccaaagcctggagaatctggctctctcccacaatgacgtaggccgagccctggatgacaaggtcctcgttggagttgcagccgaaaccatagaccgaggcgccgtccgcactggtcagggagacctcatagtaaaccccgccgggaggggcgaccgcggtgccccggccccggacgaagcggacctcagtgtcctggatggcctgccacaggccggacacctggtcggggctggtcacggccagggagacgccgtccttgtgggcctcatcgtaccgggtgatttctccggtggaggggatgtcggtgccggtcatgcagtcaaggaggggctgggtgcgcatgaaataacccacatagcaggccacgatgacggcaatgataacaatggggagcagaatattgcggagtttcttcttgttcatagcatcggttctccttctgtttggcaggggtagaatgctttcattatacgcaggacggcggaaaaaggcaaggaaaatgcaggggagcagaaaaaagagcagggagaaaaaccacccgccgggcaaaaacgcccggcgggtggtctgtgtttgggagagctcagccggcggcctcaaaatccctcaggacgatgccggccagcttcagcacgtcgtccccttttttcagccgcagggacagatagggcttgtcgccggcggaaaagaggaggcggcccttgtacttttccaggccgcacaccgccgccaccttggcaaagtcgggctgggggagggagaagcgcaggctgccctccttctgcaccagctctgtgatgcccagggcggcggcccgggcccgcagcagggcgatggcgatgaggttggccacccccacagggggatcgccgtagcggtcgatgagctcgtcggtgatgtcgtccccctcctcctgggtgcggacccgggcgatgcggcggtagaggtccatccgctgttccggggcggggatataccgttccggaatggccgcggccacggcgaagtccgcggtacaaagggtctcccgcaccacgggcttgccctgctcctccagcaccgcctcctccagcaggcgcaggtagaggtcgtaccccacgctcatgaggaacccggactgttcgggccccagcaggttgcccgccccccggatttccaggtcccgcatggcgattttgaacccggagccaaaggcggcatactcccggatggcggacagccgcttggactggtcctcggtgagcaccttgctgggtcgataggtgaggtaggcggcggcccggcgggtggagcgacccacccggccccggagctggtggagctgggccaggccgaaggtctcggcattttcgatgataagggtgttcacgttgggcaggtcgatgcccgtctcgatgatggtggtgcacaccaggatgtccagctccccgtcggtcatctggctcatgatgtctcccaactgctcctggtccatttttccatgggcggtggcgatgcggaccgactcgcccagcagggcgcggagcttggcggcggtgcggtcgatggtctcggtccggttgtggaggtaatagacctgaccgccccggtccagctcccggcgaatggcgtcggccaccaggccccagtcatgctccaggacataggtttggacgggctggcggttggtggggggctgctccagggtggacatgtcccgcaggcccgaaagggccatgttcagggtccggggaatgggggtggcggagagggtcagcacatccacctggctggtgagttttttcagcttctccttgtggcccaccccgaaccgctgctcctcgtccaccaccagcaggcccagatcgtggaaccggatgtccttgcccaggagcttgtgggtgccgatgagcaggtccacgcttccctccgctgtccggcggaggatgtcccgggtctgtccggcggtgcggaaccgggagatcatctcgatctccacgggaaaatgggagaaacgcttcagagcggtcatgtaatgctgctgggccagcacggtggtgggcaccagcagggcggcttgcttgccctccagcacgcatttcataatggcccggaaggccacctcggtcttgccgtaccccacgtccccgcagagaaggcggtccatggggatggacttctccatatcggccttgatctccgccgcgcagcgaagctgatcctccgtctctggataggggaagagggcctcaaagtccttttgccagggggtgtccggggcaaaggcatggccggccagccgctgacgctgggcgtagagctggatgagccccttggccatatccttggcggcctttttggccttggtcttggacttctcccactccgtgccccccagcttggacaggcgcttgcgcccggggtcgtccccgccgccgatgtatttggacaccaggtccagctggagggcggggacgtagaggatgtcggcgccggcaaactgcagcttgatgtagtcccggtccgccccgtccaccggcatcttcaccatgcccacaaaccggccgatgccgtggtgctcgtggaccaccaggtccccgggggccaggtcggtgaaggattccagccgctggcgggtggtggggtccgccttgggccggcgagttcggggggatcgggcgggcagggcctccccctccgccagaacggcaaactttccgtcggggaagtcaaagcccgcagacagcccccccacggcgatggtgatccggccgggggcgggcaggtcgtggaggcgctcgtccacggcggagaacacccttttctcccgcagcatggcctgaagggcgtcggccttccgccggctggaggccaggagcaccacggcaaagtcctccttctggtactgcagcaggtcctccgtcaccgacgcaaagcggatgccgtagcccgacagctgccgggcggtgaaggagagcagggccgctgggggcaccggcggcgcaccggtggggaaggcgtccaggtagagcagggtccggggggccaggccggcgcacagggcctcaaaggccggggccagcaccggtggcttgccggtgagcagcccttgctccagtagggcggtgatgtcttgacccagctgccacagatagtttttggcccgctcggccacccgaggggtgtcacagaggcccaccagggcgttgccgggcagatagtccgccggggtggtcagctggtcatagaccctgcccagggccaggtccggggggccggtccaggggtcgtcctgggggaggaggacctccccggcgggcaggagggtgcaggtctcccgctgggcggtgcgccgctgggtcaccgggtcaaacaggcccatggagtcgatctcatccccccaaaattccatccgcaccggcaggtccaggccgggggagaagacgtccagaatgcccccccgcagggcgaactgccctgtcccctccacctggtcgcaccgggtgtaccccgcccgaaccagaaagtcggtgagcccctccggctgacagacctggcccacatggagctggcggcagctggcggcgaagaccgcggggggcatggtccgctggagcaggccctccacggtggccaccagcaccggacagtccccccggtggagccgggccagaatttccaggcgctggtgctcccactggcgggaggcggccccggggtgaaagaggaagtcccgggcggggagaaccggcacctccgccccggtgagggcgctgaggtctcccgccagacgccgggcctctccgtcgtcggggcataccagggtcagggggcggccggtggactggtggagggcggcggccagataggcccggtggacggcggacagaccggacagggcgatggtctgcttgccctggtccacggcctccagcagccggggataatcctccagccgggacagaaactgggtcagaccggggagggagaggggggcggacatagcaaaactcctttcagggtaggaatagaggtgggtgggcatagggccccacgacaggtcgcccccaccgccgggggcggtgggggtgggctgttttttcgggcagaatcgccccgacaaacggggcggcggactgggggatcagccgttgtaccgggccatggcctggtccaccccttgggacagcagacaggtcaccgcgtcggcggcccgggcgatggcggcctccatggcctgccggtcggggccggtaaacttgctgaggacccagtcggccatgtcactgtcgggatggggcttgccgcccacccccaccttgatccgggggaactggtcggtgcccaggtgggcaatgatgtttttcagcccgttgtgcccgccggcggacccgctccggcggacccggagcttgccctggggcagggagacatcgtcggagatcaccagcacccggtcgggggggattttgtaaaaccgggccgcctcccccaccgcctccccggacaggttcatgtaggtggtgggcttcatcagcagcaccggcttcccgccgataagggcggtgttggtcagggccttgtgcttgagtctctggaccgggagattctcc

SEQ ID NO: 2237 - DNA, 28705 bp, KLE1738
agaatggcctgagccgccagggtcagcgcaaacagccagcccagggaaaccagacgctctgccggcgggaagggctgccccgcggccagcgcaccgccgatggcgtacagcacgcctgccaaggccacgcacagccagccacccagataccggctcaggacgatctcccggctggcgtagggcagcatggcggcgaaggtatcccacttggcccgctcatcataggacatcagggacatggggagcatcagtccggcgtagaccacaaagaaggcacttaagttaagggcctggttggggatcaggcagaagatggcaattaagagaagaaaggctttcatctgtttccacatcacgcggaaatctttgtacagtagtgcatgcattgggaaggaactcctttcggtttggtttggtcagggggatggggcacggcgaaaaacgttagagaacaaaaaggggaggaagatggccaactgaatgagggtggaggctgtggcttgtatccatgtgtcggcttgaggaagcataagtggcagattgttgttacaaaaatgtatgagaatagccaaccatatgttgtgggtctttagataaatgaaagccagaaaggtcccaaaggcgatgcagttgagacaagaaagcagaaaggaaggaccaatttgtgtcaaggaatcatgatcaaatgacaagctggagggaaggtgccaaagggcccacaggaccccaaagagcaagacgcctcggattggccccgatttcgtctgcaatgccggctgaagataggtccgccagccgtactcttctccaaagaaactggaaaattggaggaagaaagagggcagaagaaggaacagagaggagaaagaaacggctgtgaaggcagcttggggagtacctgtgatcaggttgtttgccacagctcgtaccacgagtagcgccaaaaacagaagcagcagaacaccggataaagtccattgcctgccagttaggccgtaggcggcacgtaagtccgacggttcgtccagataaaagacgatagtggcaagagagacagcaaagtacaggaggggagtgaccgtagacagaaaatgttcagggagaaaaagtccgcatagagcccacagccccacaattgctgtcaaacccagaaaacgccgaaaaaaggttctgggtaacaggggatcttctgctcgatagaccaagcttacaaccattgcgccggcagcagggcagagcacattaaacaaagagaaactggacagggagtggaggctgtttcccgtcaaggagaaaatagctgggaccaggaaccataggaaaggcagagcgaaggcgatggccaggaaaacgagtagttctttgttttcttgacgccaggtggaaaacggccgtagtttcatgaagagatctccttctgaaaaacgatatggaacgttggggaaagagacgcgtgagacaccctactttacttacagggagtcactgcatttcggtttgagttttggccaaaaagaggatgatatcttctaaggtggtgtgctcggtgacgaaggcggcgggaatctggttccgtttgaccagggcctcggccccataggggccctgcttcacgccagccactgcggatcggtccagctccgccagctgggcgggggagagttttacaatggcgtattcctccagcagctggtccttctcctcgaagaggatcagcttgcccttgtgaagaaaggcgatgtagtcacagatcttctccaggtcgctgacaatgtgggaggagaggaccaccgtgtgggtctcatcccgggtgaattcgttgaacacgtccaggacctcgtcccggaccatggggtccagtccgctggtggcctcgtccagcagcaggagtttggccccgtgggacagggcggcggcgatggccagcttcattttcatgccccgggagaagtccttaaactgtttggtgcggggaatgtcaaagcgggtcaggtagctttcgtacaagggctggtcccaccgggtataggtcagggacatcagcttacccagctccaagggggtgatgacctcgggcaggcaggcctcgtccagcaccaccccgatgtcctgcttggtctggagaaagtccgggctttggttgtcggttcccagcagggaaacctgcccgtcctcccgggacgtggcgttcatcaggagcttcagagtggtggattttcccgctccgttttcccccaccagccccaagatgcagccggcggggagggtgaaggtgatgtggtccagggtaaagccctggtaggacttggtcaggtcccggcattcgatggcgttcatagcgtactcctttccatcaggcgtgggtttcatacagcaggcggaacatttgaagcagttcctcctcccccaaaccgcagctgtcggccagggagagaatttccgtcatgtgttcctcgatctgggtcagataggcttcccggaccagctgggtgtttttttccgccacataggagcccttggcggggacggtgtagaggtaccccgctttttccagctcctcataggcccgtttggtggtgatcacgctcacccggaggtccttggccagggcgcggatggagggcagggcctgacccggcggaagggcgccggatagaatttggttgcgaatctgggtgtagatctgttcatagatgggtttgtcgttggcgttgctgatgagaatgttcatgggaaccacctattctgttcatgtacggtatatacagtatacgcagaaaaatgccccctgtcaagggggcaaaaagggagtttcttggtgggagagggagttcttaggccaaatcttccgggagcagggccataaggtcctcccgggagggagccgatagaccggccacccggtcagcctgccgggctatggcgtcctcgaaaaagttccggacctctcgggcgttaccaaaggattcccctcgatggtcatagagggactgaagggccgccgacgctttggtgtcggcctcgggggagagagtatagccattcttttggcacagactgcggaagatctccagcagctgcccggcggtgtagtccgggaagaacagggatttgttgaaccggctttccaacccgggattgctgtggaggaaccgctccatggggccggggtacccggcgacgatcaccaccaagtccttccggtggtcctccatacctttgagaaggacttcaatggcctcccggccaaagtcgttgggactgtccccgggggccagggcgtaggcctcatccaggaataaaaccccgcctaaggcagactgcagtaccgtttgggttttcagggcggtctggccgacgtatccggccacgagaccggcccggtccacttccaccagctgcccttgggacagcacgccgatggacttgtagagcccagccaccagccgggccactgtggtttttcctgtgcccggattgcccagaaagaccatgtggagggagagcgggggcgtggggaggccggcttcctcccgaagctgacggaccttaaccaggttcatcaggctgcggacctcggccttaacggtttccagtccacacagctcgtccagctgggccaacagggcctctgtcgtgggctcctccgtcggggcggagggagcgggggtctgagggcctggggcggggataggcgcaggcggcggagcgggggagtcgggcagggaaggggcagggggtacgggggtttcccggcaggctctcccgctgccattgggtgaaccactggtccagataggacgcgatggccgatgctgcctccggggtccctgggccggcggcctgggcgaagagggtcagcgcggcggccagggtatccagaaaggcccgggcggtcctgtggccggtctggcggtcgtaggtacataaccgggagaaaaaggggggcgcgggaagggcggtgcacccaccggcctgggcggtcagtgcccagaacaggacgtccgggggacggacgctgccggagtagagggcgttgtaccaggcggtatgggccggggagaggggcgtaccgccggcctgccaaacggccagggcgcactggcggaaaaacgggtccccctgctgccgcacggcgatccgcaggccagggtccggaagttgggagaggaaggcggccatggaagccgcgtattgcgtgtgaaactgtgtggtgtccatgtgagtgcctccctgttaagaaaatgtgcccaccaggaagaacaccaggtcaatccccataagcacggccagcagagcggccagcctgccccgggcccggggggagagggcggccaggccccggtccagcaggggctgcaggacatagagaaagaacaggccccccaggccgaagcggatagagggggagagggcgatccgcccttgaaaatggtagcggtaattgacataggtctgccagggccagctccctgtcagtgcctggcagagataggaggcgcccagctccaccagggtggctgagaccatgcagccgacaaagaggagcggcagccagagcagccgctgtttccagggtttgccctggatcagccggtagaacaggagcagaaacagcagggcgcccaccccatagaccgggcagtagggaccaaagagaacccctcggttggagaacccccagcggtagacgaccacctccagaaagacctcgtagcaccagccgaacacggaataaaagacgaaacacaagaaatatttttggaaaaattggcagagccgttttcccacggaaagggaggatacaggggaggagacagcaggcatagtggttcctttcccgggcagacacaagaagcgggcccgtcacaaatttctttcactatactggaaaaatcttggcaggtcaaggcacgcgccatttccccggagaaggttgacgatgttctcaaacctgtggtacaatacgttaaattatgacgagtctttctgaaatggtaaagttttccttagcatagatcacatgaggaggaaaccaaaatggaaaccaaaaagattacattgaggagtcagacggtgcagtgccctcactgtggggagtactattccgtgacctataaatactgcccgttctgtgacgccggccgccaggaggaagagcggaagctggcggagaagaagaaaaagaagcaggctttttttggaaacctcttcggcagccatgaaccggaaaagaagaaaaagcaggccaagaaccccgatcaggtggaactggacagcgcgcacgcagagcgtccactgcgggagaaaggccctcgggagaccgggagcagggaacctgccatgcccagagagcagatcgagaaagcgcatgcgcccaaggactctgggcagaaggagcatgtggggaaggagcccatgcgcaaaaaggaaccggtccgccggcatggcgcccggaagaaaaccagtgagatgacagaggaggaaaaggcggcccacctggccgagcgggaggccagagcggccgcccggaagcgggagcgggaccggttggcccgagaggccgccctggcggcggcggagacggtggaggcacagaaagcgcccgccgaagcgccggcgcaggtggaggtccccacggtggaggcaggccccgtctttgaggaggtcactgtccctgagacctttggctttgccgagccccctctggtggagaccgatccggccgcctttgtccaggcgccggtttctgcggagggaccggtggtgaagacagagcccacgcctggagagagccaggagattccggtctttgcccctggggcagaggcggaccaggcgcctgtggaagagagtgccaagacccagtgggacactctgaaggacctggagaccttgtcccaggccgctgacgaaggcgcccctgccatcccggtcatgccccaggcagagcatacggaggtccagataggggagaccgtgcccgccgcgccggcccaggagacaaagaaacccgacggggaagaaacggccgccccgcaggagggggtcccggcggaaaagcccgtggagacggaggaggacctggacgcgctgctcagtgagattcgggatttgctggcggacagccctgtgcccaagctggacccggaacagctgaaaaagccgccgcagcctgtgccggaagtttccattccggacacggctccggttcccccggcggaggcgcccgcagcggatgctgccccggccagtgcccccgcggagagtcctgcccaggcggagcccgcgccggagatcccggcggtggaggaaccgaccattcccatcggggagattccctcccaggagatcgggcaggacgccggccaggcgccggcggagcaggtgcccgcgtcggtttttgacgaacagcccacccaggtgattcccacccaggaaatcgcggaggaaatgcaggcgcaggaggaagctgccccccaggaggagctgctcgcggcggttcgtccgccccgggagcgggccccccgggaacgtgcagccgcccggaagccggagaagaagacgaagaaaaagggcggccccaatgtggtgctgatccttctgtctctggtgattgtggcagcggccgcgtttattgtggtgcgcaatgtggtgccggccttccaggacggcatccttggcggcggagaaccgaagacggcggaaggcctgaccctggacagaacggcgctggacttggcggaggcgggaaccaccatggcgctggtccccaccttctctccggagggggccacggcccagctcacttggaccagcagcaagccggaggtggccacggtggatgagaaggggacggtcacggcggtggcccccggaaccacggtcatcaccgcctccatggagaatggacagaaggcggagtgtacggtcaactgcacttggtccgcagatgcccccagtcaggagcccgccgggacagagcctgcggccaatggagcggacgcccccgcggagacaaagcccaccctcagcgccaacgacattaccctggacagcgagggggacacccagcagattacggtgaccggcgcatcgggggaggtcacctggaccagcagcgacaccaagatcgccacggtgactgccgacggcaccatcaccgcggtggcccccggccgggccaccgtgaccgccaaggtgggggaccaaaccctcaactgtgcggtgcgctgcatttggtgaggagggaccgccgtgaatgaggtgatacgcgccctgaaggagcgccggagtatccggtcttaccggacagagcaggtccgggaagaggacctgcagcaaattttggaggccgctacctatgcccccagcggcatgggggcccagccggtgatcctggtggcggtccaggacccggcgaccattgcccgcctgtctcagctgaacgccgccgtgatggggacgaagaccgatcccttctacggggcccccacggtggtggtggtattggccgaccaaagccgcgccacctggctggaggacggcagcttggccatgggcaatttgatgcttgcggcccacgccctgggcctgggctcctgctgggtccatcgggcccgggaggtttttgccggagcagaggggcaggcactgctgcgccagtggggcatccagggcaagtatgccggcgtggcccactgccttttggggtatcccgacgggcctctgcccgaacccaagccccgaagggaacatagaatttaccgccgttgaagtacggctttcccccgtaaagcagaacacccccagcgccatccggcgctgggggtgttctggttgtctggagaatggactcagcgaatttgtccatccccgtgaatcacgtatttatagctggtcagctcctccaggcccatggggccccgggcatggagcttttgggtggaaatccccatctcacagcccaggccgaactgccccccgtcggtaaaccgggtggaggcgttgacgtagaccgcggcgctgtccaccaggcgggtgaagaggtccgcatgggctcgggtctgggtgagaatggcctcgctgtggccggtggagtggcagttgatgtgggcaatggcctcctccacgctgtccaccacccggacggccaggatataatccagaaattccgtgtcgaagtcgtcatacccggcggggattcccctgcccagcacctccatggccttggggtccagccggagctccaccgggggctggccggcctcccggcggcggaccaccaggcggtcccacagctggggcagaaagtcgggggcgatgtcccgatggaccaggcagacttcggcggcgttgcacaccgaggggcggctggttttggcgttttccaccaccgacagggccttttgcaggtcggcgtcgccatctacgtagatgtgacagattccggtgccggtctgaatgcaggggaccttggcctggttgacacaggtttggatcagagaggcgccgccccggggaatgagcagatcaatatagcccacggcctgcatgagttcattggcgctggcccgggtggtgtcggtgaccaaactgaccagggcagtgggcaggtgatgctgtgtcagagctttgtgcagggcggacacgatggcggtgttggagtgaatggactccttcccgccccgcaggacgcagacgcttcccgcctggaaggtgaggctggcggcatctgaggtgacattgggccgggactcatagatgatggcgatgacccccagggggacagaggccttgttgacctggagcccgttgggcagggtgtgggaggccagggtccgccccaccggatcggggagggccgccaccgcccggacgccggcggccatgtcggcaatccggccctgggtcaggcgcaggcggtcctgcatcaccggggagatggtgtcctgggccgcggccaggtccagggcgttggccgccagaatggcgggggtgtccgcctccagggcgtcggccatggacagaagaacggctttcttctcctcggtggagagggcggccagggcgggcttggccgccagcgcctcctccagcagggggcgggtgatggtcagctcggtggggtcggcagcggcagaggcggaaaattcgtggccgctgaaagcgggcggcggatagcagggcatctcgccggagggagggggaagattcatggcagtcttatcctttctttccgcggaagcggctgcccacgggcttgccgtccgcgatgtcatagagtacagagggagaggacccattggcaatgaccatgtcacagccggcctgggtgcaaatgtccgcggcctggagcttggtggacatgccgccggtgcccagggaggaccccgacccgccggccagttcccagatctcccgggtgagcgcggggatttccgcgatgagggtggcctctggatgggtatgggggtcggcggtgtaaagcccgtcaatatcggacagcaggatcagcaggtctgcctccatgctcacggccaccacggcggccagggtgtcgttgtccccgatccccatttcctcggtggccacggtgtcgttttcgttgatgatgggcagggccttcaagtccagcagacggcgcatggtgttgtgaaagttttgaaagcggtccgggtgatccacatcggcggcggtgagcaaaatctgggccacggtgtgattgtactcggcaaaggccttatcataggtatacatgagctcacactgtcccacggcggcggcggcctgcttggtgggggtgtcctcgggccggtgggggagggagagtttgcccgcccccatgccgatggccccggaggagaccaggatgatctcatgaccggcgtttttcaggtcactgaggactctgcacagttcctccacccgccggatgttcagcaggcccgaggggtgggccagggtggaggtgccgattttcaccacaatacgtttgttttccatgggaaggctcctttggagaaccgagggcggggagtgcccgccggtattttttgggagttttatcgtttctattgtactggatggagcggggcctgtcaacgccggaaggggaggaaataacgggaacaggagctggggcaccgtggtgtcccagctcctgttgtacaaagaaggcgggggctcacagccccgttaaatgccggcgcagcaggtccagggcggtctgggcggcctgccggcgaatccggtcccggtccacctgaccggcgtgaaggggaaccacctggcactgctcgccccaggccaggcccaggtaaaccaggccgatgggattgccccggtcgtccggctccgggccggccacgccggtggtggacagggcgatgtcacaccccagaacggctttggcccctcgggccatggcctcggctacctggggagagaccgcgccgtattggtccagcagtgtctgagggacccccaagacaccggctttcaccgcattggtatagctgacaatgcccccccgaaacagggcagaggagccgggcaggtcggtgagaagcttggccaggagaccgccggtgcaggactcggcggtgcccacggtgagcccccgctccttcagcagcccatagcagacttcctccaaacaggacacatccaccccaatgaccttgtcccccagcagggccttgacctggtccaccacaggggtaatgcgggccagggcctccgcctcggtccgggcgtgggcggtgacccgcagctccgtgccggtgggcttggcatagggggccagggtggggttgtggagggaattcatcaaatcccgcagcagggcctcggcagcggactccccgatgccgaaggttttcaccgtgcgggagacgatcaccccttccgagagccctttcaggtaggggacggcccggtggcggaacatcatctcacactcccggggcgggccagggagcatcagcacgtggatgccgtcggcctccatggctaccccgggggcggtgccccagtcgttgtccaggacggtggccccctctgggatcatggcctgctggaaattgttttccgtgacaggccgccccatggcggcgaaccggtcccgaatccgctgggccgagggctcgtggtacaccagggtccggccaaaggcctgggccacggcaactttggtgaggtcgtcacaggtggggcccagccccccggtggtgatgagaatgtccgcccgctggcgagcaatgtccattgcttggcggacccgctccgggttgtctcccaccacggtgtgatagtagacgttgatccccagttgggacaatccctcggagatcatttgggcgtcggtgttggcaatgttgcccaggagaagctccgtgcccacggcgataagttcagcggtgtggctcacgggtgcagcaccaccctttcgatgccctgcatggcggtttcgatcagaccgtcgatatccagggcggcctcggcctcctggatttcctccagggaggggcgggttttaggatggcggggggtaaagaccgtgcagcagtcctcgtaggggaggatagaggtctcaaaggtgccgattttccgggcgatccggacaatctcttccttgtccatgcccaccacgggccggaagatggggagagagaccacctgccctgtgaccgccatggcctccatggtctggctggccacctggcccagggactctccggtgaccagcccgtgggcccccacccgctgggccacccgctgggcaatacgcatcatgaaccggcgcatgagcagggtgaagagggactcggggcagctgcggcggagttcctcctgaatctctgtaaaggggaccacatggacggtgaggcggccgcaccagggggtaagcagccgggccagctccaggaccttttccttggcctcgggggaggtgtaggggtaactgaaaaagtggaccatctccagagccagcccccgtttggccatcatccaggaggccacggggctgtcgatccctccagagagcagggagacggcggtcccccctacccccaccggcagtccgccggcgccgggggtggggttggcgtggacataggcggcaaaatcccggacctccacgtggaccaccacctcgggagtgtgcatatccgcctggatgtgggggaaggcctcgttgagttctccgcccacaaactgggacagctggatggaggtcatgggaaaggacttatccgaccgcttggactccaccttaaaggtgcgggcggccatcagatcgtcccggaggtaggttttggcggtttccagaatggcctcgggggttttctcacaggccttggcccgggagagccccaccgccccgaacaggcggcggagggtttcaaaggccccgtccaggtcacagccggcctccttgggctccacgtaggtgatggactggcgggagtaaatgcggaacttgccgtatggctccagccggcgacgggcgttgcccatgaggcgctcctcgaaggtccggcggttgaggcccttgaggaccatctcgcccattttcagcagaaagatttcctctcccaccgggagagactgggaagtatttgacatagcggtgaattcctttcgtgggtgatggaataaacgccggggtccggcggtgtacaaggggcattaagatgcaaaatagtcggattcccggtattggatggcctcggccagatggtgggccaggatggcggccgccccgtccagatcggcgatggtgcgggccacccgcagaatgcggtcatagctgcgggcggtgagccccatgtgctcgtaggcccctttcataagggcctgtccctctgggtccagggcgcaccagcggcgcagggccacctggcccatggcggcgttgcaggtggggccatcggggccgaagcgggcgctctgccgggcgcgggcctgggtgacccgggcgcggatggcggcggaggattccccggggctgcggtcggaaagggcttcaaactccaggggaggcacctcggcgaaaagatcaatccggtccagcagcgggccggagagcttgcccaggtaacgcttcacctgggccggcgtacaccggcaccggccggagggatggccataccagccgcatttgcaggggttcatggcacacagaagggtgaagtcacaggggtaggtctctgacgcggcggagcggaccacggagatgaccccctcctccatgggctggcggaggacctcaatcacgtctttatgaaactctggcagctcatccagaaagagaaccccatggtgggccagggagatttcgcccggcctgggatagggattccctccgccggccatgccgccggcggagatggtgtgatgaggggcgcggaaggggcgctgggtgagcagaggatgctccttggtggtcagccccatcaccgagtgaatttgggtggcctccaaggcctcccgctggctgagagggggcagaatggaggggaagcgccgggccagcatgctcttgcccgagcccgggggccccaccatgagaaggttgtgtcccccagcggcggcaatttccagggctcgcttcaccggctcctgtccccggacctccgcgaagtcaggaagtggaagggcatccggcgccccggaccagggcggggcgggggtgatgggggactggccggtgaggtgggcggccagctgttccaccgtctccaccgggtagacggtgagcccctcggccagggtggcctccggggcactgtcggcggggacgaacagacgctgaattcccgcatcccgggcggccagggccatggggagcatccccaccacagggcgcagggtgcccgacagggagagctcccccacaaaagcgcagtgggggtccgaccaggtcagctgcccgctggcggccaggatgcccacgcagatgggcaggtcgtaaatggtgccggacttacgcaggttggcaggggccaggttcacggtgatccgccccaccgggaagggatagccgttgttcttgatggcagaacggacccgttcccgggcctcttttacggcggtgtccggcaggcccacaatgtcaaaattgggcaaaccgctggccaggtcgcactccgcagttacctcgtaaccggaaatgccctggagcccaagggagcgcaccttatacagcataacagccctccttcccctgtgcagacaatataccatattcactatgccacaaaacgcggggagatacaaggggcggcatacatttctccctgggttttccaaaaataacaccctgccgagggcagggtgttgctgtgggaatggattcttctgtcagatcagagcgccgttgaggaaagtgagacccaaaggagtgagtgacacgttgtcttggattgtgccgtctgcgttttgaatgcaatagcgaatggtaccggtgaccgagcgggtcacgtccacatactccgtgtaggtatcggtgatcggcatggcatacctggggcggccctcccggagatctacgatttccgtggggagggtgtcggaaaacatgagccagcgctgtaaataggataagtcccggcaaatatcctcttgggagagggcggtcccggttttctcgccataagccgccgccaactgggcggcgcaggtctgtacaggtgcactgtttcggtaactgaccatctgagcataggggacggcataaagcgcgattcccagggccagaagcaccgcaagaaggatcggcaggaagcggcgccagggtttggatttcgtcataaaaactccttttctcaagcggggtggaagggacttggggtttcagcccgcatggagccccagaagtgttttcccacacagtagacggtatgggtgccggcgggcagagacaggtcggcgggatcatcggtcgtccagagaagggaggtgccatccgcggagaggaagaggaccttcacatctccgaacaagggggctgcggtgacggagcaaacctgcgcttggtccagatgcagggtacccacggcagtgatcccggacagtccccattgatgggaggagacggtgtggtccatggaggtgctgacagaggaggagatggattcctccaagtggagaaccatgtctttcttgggcagatcgtagagaaacgccaaatcgttggagtgcgtgaaccctcggagaaggagcagcagagagcagcagaaagcaaacccgatgatcaggcggggcagtttagggaggaaacgaaaccgcttcatagaaaccctccttaattgcgctcgaaagaacttttgcaggggagacacaggccagcctcctggaagggaaaaacatccaaaaatggaaaaaagaaacgatggtttctacggattattttatcataagttcatcttttttaaggaaaggtgattcttaatgaaaaactctcaaactgtaattcgttccattttgggtacagccgatgtggatattcgtccactggcctacgcggtggatgctgctgtggagctgatgtttcggcaaggtatcccggaggatgacatcgcggtgaccaaggagctttatgccaaagcggccgagcgcctgccgaaagggaagaaggggaaacgcagtgttaagacggtgaccaaacagattcaacgggtggcgaatgcgtgttgggatactttggtccgggaagggatggtggagcaccacctcggccggccgcgcaaaaccatccctgcgcccagagagatgattttctatctggcctcccaggcctattgggaaataccgtatttccaggcgatggaggaagggaaaattccgcttttttctcctcaggagaaccgaaaaccagccagttccagaagaaaaaagaaggactgagggaggaaaagatactccccatccctataacgaaagaacagaggaatctgtgacgggaaatcccccaaaatttttataaagtttttgggagaagtccataaagagcgcggaacgttgattgccacaagaagaaagcgcaaagggcggagggaaacttctctccgccctttgtgcagaaggcgtttttcgccttgtttttaggcattggacagcatggcgaaaagaagatagcataccaaaaagccaaaggagagaatacagcactctaaggtagggaatttatcttttgcggcttttttcatcatagaggcgaggagaaagggaatgctgcaaaaaaaggcaagaacaatagattcatgattcattaccatcctttgtagtttccaatcggtttttcatagaatgacctccctcattccgacgttcgaaccaaaggcggatgtgcgaacatttctttatgcgggtatggtcttatttgtcgggatgccgaggatatacttttgatttggagatgatttgatcctttttttcttgctttatacagtgtacaggaaaaaagagaaaatgacaagattgatgggggaattgtatctaaattgtaataaggtgcacagatttgtcgcttttcagaataagtaataggcgggtgacccctcaaatccagaagaagaacggcggcggaagggacggaaatatttttcccttttaataacgaaaggacagaggaatttgtgacgggaaatccccaaaaagttgcacaaagtttttgggagcgttccataaagagaacagaacattgattgccaaaagaaagcacaaagggcggagagaaaattctctccgccccatggagagggatacagacttgccagcgagtttcgttcctggggactgggcttaggcatgctctttcaaaaaagaaaatagagcgttgctgtcaagggtatatcgcaggccgtggtagaaaagaaggtttccttccgtgaggaccagtaggtcggactcgccttgtgggtgttccagatagagggtatagcttgtttcctccaaggggtactccatatgggggtccgcaccgtgaaaggttgcgtttacggtctgagcaagggaatagaaagcggcaaaggtctctttgtcccatataacgggagaggttgtttggctgctttgtttctttgttacgctgcatgtaagaataccatcagtctctccaagacggtttgctacggtgctggtgattggaagtatgacgatgcaggaggcaatcagaagacagacaacgattcctatgataagtcgtttcataataatcatttgaaaaatccggaataactctgtgtattcattttatcgtgtttgccgatgccgacagcgccgttaaagacttgccgggcttctttggacaagttttgggtgctctgtttatacttcggggagaacacttggcctttatatccgaagtctttgttgtaggaacccgcatacttgggggagtcgcaaggctggaaaacagcatagggagatacctcatcaaactgctgagctgacggtgtagttggcgtcatccagtgtgcgctccacaaaggtgcggatttcaccgggcgttagcaaataccctcgggaggggaacaggcagccatcggagaacaccatattgaaggggccttctcccacgatgtcgtcctgtgccagatcgatgtttaccaagttggagccattttgaatgacaatcaacatatactgccgctggctggcatcgccgctccaatctgtttcatggttcgggagcagatgccgctggcggctctctgccagaaagtccagaatgaccagttctttttcccggtcttcctctgttttgggagaccacacacggagttccccatcggcgcggagttccactgcctgaatgtgggcgtcaccgctccggggaaggactggcccagtggtgtggggataaagcaggaaaaatgcgactgcggcggttgccagtatggccaggcagaggcataaaattcggttgcgtttcgtcatagcatcctcctaaaggcacatattccccctcaagaggaggcgaacgcctcatcaacaaaggctcgaatttcttccgggtggattagggtacagatcagagcattggggaaagagggatggggagaagatggataggaatagttcacgaaagcatctttgtcgtggtaggactggaatcctgctgggcccaaaacgatgccgcgggtacttccgtctggcatggagagcataagggtcatcacatcccaatcggcggggtacccaccgtaaagggttctctggaaggtataacgttcctgggcagaggaaagatactccacaattttttgggcgattgcctggtcctcctctgtcgtggggacccaagagtaggacgttccggaaccgttgggagaatccatgtgaatgaccgataactgggtgtgttctggtgagcggacaacggcgtgaggggtcaggaagtaggcagcggataaaagcagtgaagtcaggcaaaggatgatgagcagactgagggtgtcctttttggtcatgaaattacactccattcatgaaaggagatgaaagctggggtattagtttagcatagtgtatcaaaaaagttgaacggtagcaagacgggggaataaaagaacagaagggaatgagaaaatgcaagccggagaaaattgttctctccggcttacatttggaaaggaattaaacctgtggattaatcaaagtaggaggccgcttttgcatttttgaatttatccaagaagggctaaatagttgcccttctcaacgtcaatttctaagacagcgtctctcgctgcttgaaaagaactatattgtgtcgaaaggatttcctcactcttttcgatttcaccaaggatttgcgtttgttcagaagtagagatgctgacttgctgggaattgctttctgctgctgtaggattttcctgttggatgatggtaggatcgtaaccgtctaatcccttgtcaaaagatagagtttccaacaatttccaaaaaccatcttccttaaccaattttacctgggcataatcccggttgacagggctggagacggtgtagctgccatcctcttcttgtgttatccacttattccaggtggtgactgtggcagaaactgtggcctgagagccatcttctgacaacgtaatttctgtgatatcgcactgagagactccaccggcaatgcaattgtcaacttcgttctgaagactacggaaaagatagtctcggttaagccatttgtagaattcgttacagtgagtattttgcgcataataacggtcaacttttgcgtcgaattgcgatgacagagtgtttaactcttcttgagtcaaagaagaactttttccgtctggcgaagtaaacattcccatctgtacctgagtttcataggcgccaataatagaaaatctaatctcgtcgatatcttgaggagttgtgtctcggaaagcagaaaaaagtaagatagtaacaatcaagatactaatggacgtaagcgcaaggcctaccttcagcatggaatgtttcattatagatatgctcccttcttgttatgctttgatctcaaatgcatatacacgagtagttgctttttgggtagagttctggcgattatcaggacgccaaagtacttgcttgcgattttctgtgtgctgattaattaggtcgccataaccttctccagaaagagttgacttgccattatttgcgacaaaaaatgcgctatgattcatagtgccatcactttcccagtcataaaacaagacaacttttcccgtcctgctacttgacaaattgctgctatcattaacatatgcgaaagtgagataaggtgaaggggaaccctttaaagaccaagagccaattttagttccccgcccagaggtttttaagtattctttgagtgaatttgcattgacccactgtgtactatcaactcgaactactgtattaccgtgccagttgggaatactcttccatgtggaatcttgagataatcctcctgcatataaacactgggagacaaagtttgtacaatctctactataaacgttatatccaactcctaaagtgttcattttgttcgggtttattgcataggtattagaatatgtaatagctttttgtggagaataagcaaacacagaggtagcaaacatgcttgtaaataacaatatgcataataagaaatagataattttcttcataaatgttgtccttctttctcgtatagtactttgttttttatgttctgggatctaatttgtgtaggtatcaacacctcctttcttgcattggccccctgcccctctaccctatacatgtcgtgccaacccgatttatttgcatcgggatcgaaaaaaataaaaaaatttttcgggccgcatcgtttacggcccgaaaaggaaaagtgacggttatgcccttaccgcattagagccgatccaggtggccccggtgccgctggcgtttttggcgtagcagtgcgcggtgatgtagtagtattttccaggggttcctttgtatgtgagggagattacattggaagcacagttctttcgaatcagattggcgttctgatttcgcgtaaaggtgcgcaccggcttgtacgttccattggcttgccgttcgtgaacaataatttcggtggcccccagctcttgcattataccggaggcagcaacgtccactttaatccgcagagttccgccgcccacggcggttgctgaaacataagtgttgttaaaataatcactggctcgggcgccggcgggaatggccatagtgaacaggagcaccaggcagagcaagagggaaagctgtttttgaccaatgcgtttcatgtgttttttcctttctgtttcattcgtaaatggaatcaatcattcgtttcaaggtgtccgggctgaggaagccgtgcaggctgcattccgtgggcccgtttctccaaacggcggtgttccgctccatatttcccatgatgtagtgggaaatatgattggcgtagtattcctccacgggacctttgtttttttcgtattgacgggtgggtaagtcttcaacagtgtcataaattccaacgcacagagtaaactcctccccattcagagagaaaaccaccacacaataatagccgttctccacggtatgcctctccacctgcaccacggagctgcccggcggataccaggtgggcaaaacaggccggtctgtcagctcggacacggttttttccacctgctggtagtccgggctgcggaggaccgcctcggtcccatcgggttccctggacaggaaggagaagttggcgtcagaccactgcaccaaattttgcagcagactgctgccctgcaccggaaggatggaaaggcagaccaggacacagaccacggccgccaccgccagggcgcggcggggcgctatcttcccggcgcggaaggcattccacgcggcgtccacatccaccgccggggcggcttggggcgttctctgttccatcacctccatgattgccatgaccaagtctggattggagtggtcctctcccgcggcgaaatcctgctggagcaggtcttccagcgcttgggtggagagctgttccaacccggcgtactgtcccagcttgtttttgggatcgttcatagtttggaacctcctctcttttctttatgtcgtgccgtgtcactttttttgcagggcggatcagaaaaatgttcaatctcccggtatattttttgaaatcggagcttgatgcgccggacacgggcggccagggtgttttggttcaggttttcctctgccgccagctcctcataggtcatcccttccaaatacaaccgtttcagcagatccagatcttcttgggagaccaaaccttccaattccaggtcggcccccggcggaggctggaagggttggtgggacagcgcggcctgggcctggagcaggcgggaggcccactgctggtcggcgcggatcatgtttcggaccacgttgtttaccgtgttgtacagccagccggcgggattggggctggcgaacaggtcctcccatttggaccaggcaatggcaaacgcctcctggaccgcctcctccgcccgcccaggatcggatgtctgggcgttcctggtcagaagggtttgggcgtaccagaccaatttgctgtaatgggcgcggaacagggattctacctcccgggcaatgaattgcatttcgggtgcggccatgggggtaccctccttttctttctcttgccatagtatagcaaaaatattggaaaaaagaagatacaattcgatgacaatgactcattccgtgggcggccgccggcggagttcccggggggcccaatgggggagggggaggcgctgcatagcggcgaagacggactccttcagtttgggatactggggttccagggaggcaatgagggttttgacctcctggcgcttggtgtggccgtcggcggggcaggggttgtggaccaccgggagctggaggcggggaaccgcctcccggatcatggcctcgctgacatagagaagggggcggatttgggtgatgtccgtgcggtccagataggttacggggtggaagcaggacaggcggctctcataaaacagggagaggaagaaggtctccactgcgtcgtcatagtggtggcccagggcgaccttgtgaatgcccgcctccagcagggcggtgtggagggagccccggcgcattttggcgcagagggcgcagggatttttctcccgccgggtctcaaagatcacatggtacatctgggtgggaatccggtggaaggggacgcccagctcccggcagtagtccgccagaggagacaggtccatgcccggggtccccatgtccaccgtaaaggcctccacggaaaagcccccaggataaaactgtgccagccgggccagggcggccagcagcaccagggagtccttccccccggatacccccacggccacccgctccccgggggcgatcatatcatagtcctccacacaccgacggagaagactgagaatcttttgcatgacgggtacactccttgcgcacaaaaatgaaaatagaacatgaggattcggaagaatagaagaggatagaagagaaaacgagagttcttgcgggggtaaattaaaaaattcagaaaaagcgttgacaggctcccatggcggtattataatgtagcctgctgaaaacaccggcctgtggtttctccagcattataaaggagaagcaaaccctttgtaaagcgggagaagccaccggccctccttaaaatataaggaagagaaatttttattggaggttcgaccctatgtccacttttatggccaacaagggcaacatcgagcgcaagtggtatatccttgacgccgctggcaagccccttgggaaaaccgctaccgtggcagccactctgctgcggggcaagcataagcccgaatacaccccccacgccgactgcggcgactttgtcattgtcatcaacgccgagaaggccgtgctcaccggcaagaagctggatcagaagtactaccgcacccactccggctatgtgggcggcctgaaggagaccaagtaccgtaagctcatgcaggacaagcccgagctggccatgaagctggcggtccgcggcatgatgccccggaacatcatcaccaaggattccctgacccgcctgaagattttccgcggtcccgagcacatccacgccgcacagaagcccgaactgtgggccgcagaataaggaggagtgagaccatgtataagagcaagaagccttaccattacggcaccggccgccggaagtcctccgtggcccgggtgcatctgttccccaacggcactggtgccatcaccatcaacggccgtgacatcgacgactacttcggcctggagaccctgaagctcattgtccgccagcccctggacaccacagacctgctgggcaaggtggatatctccgccaccgtctccggcggcggggtcaccggccaggccggcgccatccgccacggcatcagccgcgccctgctggagatgaacgccgagtatcgccccgctctgaaggccgccgggttcctgacccgcgaccccagaatgaaggagagaaagaagtacggcctgaaagccgcccgtcgtgcgcctcagttctccaagcgctgagattgccttatccagaagcactgtcctttcggacagtgcttcttttttgcagggatttcttgtctcaaggggcgggttgtgctatacttttttcatccattcagaagaaaaaggagggcgacaacatgaaacaccatggggagaccttttccctggccaacggcgtggccattccctgtctggggtttggcacctggcagatgaaggaggggccggagacggtggcggccatccagaaggctttggaactgggctaccggcacattgacacagcggcatactatcaaaatgagagaagcgtgggccaggcggtccgggccagcggcctgccccgggaggcggtctttgtgaccagcaaggtctggaacacagaccgggggtatgagagtaccctgcgggcctttgaccggaccatggagaagctggggctggactatttggacctctacctcatccactggccggccgcggccaaccggtttgacaactgggaggacatcaacggtcagacctggcgggccatgaccgaactgtaccagcaggggcgggtccgggccattggggtctcgaacttcctgccccatcatttggagcccttgctgaagacggaggtggcgcctatggtgaaccaggtggagtgcaaccccggctgtcagcagaagcaaaccctggcctactgccgggaccatggcatcctggtggaggcgtggagtcccctgggatcgggccgtgtgctggagaatgcgaccttgcaggccctgggaaagcagtatgggaagtccgccgcgcagatctgcctgcgctggtgcctggagcagggggtcctgcctctgcccaagtcggtgaccccccagcgaatccaggaaaacacagccatttttgactttgccctgaccccggaggatatggcgcggattgccgcgctgccgcccttcggcggttcgggacacgatccggatcagattgcattttaatgccttgacagcgcgggaagggagacggcggcgatgttcggacgaaaaaagaaggcgcagaagcgggaggaacaccagcagtccctgcgaaagggcttgctgttttggctgccggggggctcttcccggctggatgtctatgtggattactgtgtgatccgctgcttggggaagaccaagatgaaggagaaagagcgggtgattcccttcacctccattcaggatgtggtctataccccgcccaccgccatgcggctggcctgcctgcagctgatcaccaaagagatgccggatgtgaagaagagctattggtatgcctatgagaacaatctggtggtggtccacccctccacagaggaactggcccacaaggtccgggcctacattctcaatcccaagggctctgatgtggtcccgccggaatacctgaaccagctgcgaaaggagctgaaaagggcccgccgggcagaggcggaagcccaggcccaggcggagaaggaggagaaggcccacaagaaagagaaccctgccgccgcagaccaggagacaacgtaaaaagcgccccctttggaattgcgaaccgaagggggcgtttttgcgggaatcttgctttttcccgagggaaccggtaaaatgaaagaaaacgtcccacccaagagagaaaaaggagacagtttcatgtatgagaagctattttccccgggagccatcggcacgctgaccatccccaaccgcattgtgatgacggcggcgtccgcctccctgtcccagccggacgggaccatgacggaggacatgctggcatactacgaggcccgggccaaggggggcgtggggctcatcatcaccgagatggtctgcgtggatgaggcgcggggggtcctgttcccccgggagctgaacgcggcccgggaggataaaattcccgcgttccgggcactggcggaacgggtgcatccctatggcaccaagatatttgcccagctgttccaccccggcgccaacgccgaccccaagctgaatccccatctccccctggtctccgccagcgacggcagggggaagaagcgggggacggcccaggcggccacccgggaggacatccaggaaattgtccaaaagtttggccaggcggcccgacggatcaaggagagcgggatggatggggtggaggtccacgccgcccaccactacttcctccacagctttctcagcccggtgaccaaccatcgtaccgacgaatacggcggcagcctggagaaccggacccggattctccgggaggtggtggaggccattcgggccgcctgcggccgggacttccccctgatgttccggatttccctggaggagtacatcggccgggagggctaccatgccgacaccggcattcaaatttgccagatgctggcctcctggggggtggacgccatcaatgtcaccgcctcggggaccgacagcaagctcagccagagcgtggagcccatgtactatccccagggctggcgaaagcacctgcccaaggcggtgaagaggacggtcccccttcccgtggtctcggtggccctgattcgggacccggcctatggggaaaagctgctggaggagggggtgctggactttgtcgcctccgcccgcagccacctggccgacccggactggggaaacaaggcgcggcagggccgggaggaggagatcctcccctgcatctcctgtatggcctgctttggcaagtacgagcaggcagggcacatcacctgcgcggtgaacccggagacgggctacgaggcccagctgcccccgctgccccgagatggggagggccgcctggtggtggtgctggggggtggccccgccggattagagggggcctgggtggctgcccgccgggggttccgggtgatcctgtttgagaaggcgccacagctgggcggtcagcttctgctggccgcggggacgccccggaaggagaaaattcagtggcttttggacagcttgtgcttccgctgccgccaggcgggggtggagctgcggaccggctgtgcccccaccctaaaggagctgggccggctgtccccctatgccattttggatgccaccggcggggtgccggggattccggccgcgatccagggggcccgggagagtccgctggtctgcacgccgccggcggtcatcaccggcgccctggacatccgggaggagagcgtggtggtggtgggctcggggatgaccggcctggagaccgcggaactcctctcggaccgggcgcggaacaatgctgtcctggtgctggaggccgccccccggctggcccctggggttcagggctccaaccgcaacggggtaacggcggtgctggaggtgaacaacgtggtcttcctctgcaaccgcaccctcacccgggtgggggaggaccggatctggtttgtggacagccagaccggggaggaatatgtctatccctgcgaccgggtggtcctggccctgggcaccgtccccgcccggccctacggggaccggctgggggaggtctgcagccgggtgatccctgtgggagacgcggtgaaaggcggacagatctgggatgccgtgcacgccggttaccacggggcccggcgcatttgaatctttttgaaaaatccccttgactctccccttgggtcatcctgtatccttgccttgtggtccggacccaccattcaatctccacagggaaaggagggcattgcatgctgaccattcatcagatggcagagcggactggggttaccatccgtgccctgcggtattatgacaagattggcctgctgccgcccggcgcggtttccccggcgggttaccgtctctatggaccggcggagttggaacggctccagcagatcctgttttttcgggaactggagtttcccctggcggaaatcaaggccatcctggccagcccggcctatgaccggacggcggccttaacggcccagcgggcgctgctgcgggcgaagcgggaccggctcgatggcctcctgagactggtggaagttgccttgaaaggagagacaaccatggagatggcgtttaccgcttttgaccgggcggggtacgaggagaaatgccgggcctacgcccgggaggttaaggcccgctggggggatactgcggcctggagggaaaaccaggagagacagcaatccggcgaggagacagcctggggggctgcccaggcagaggcggaagagctgatcgcggcctttgcccggagcaggccgctgcctcccgagcacccccaggtgcaggctttgacgggccggtggcaagcccacattacccggcaccattattgctgcaccaggcagacgctggcgggactgggagaactgtaccggaccgaccagcggttccaggcgtacctggatcaatgggggacgggaaccgcagcgcagatggcggcggccattgcggtgtactgtggggcacaggaggaggatgcttcccccaaaaaataatctattgcacattgcctctgcccgcaggtgcggcgggggatgagatgggagaggataccggatggaaccaagaaccctgctgaa

SEQ ID NO: 2238 - DNA, 24608 bp, KLE1738
gcatgggcggtggccccgccgatgcccaggcggatgtccggggtcatgttccgcatccggccaaagtagttgatgtccgcctcagtccggctggcaatggccgccatggtcttcaccgcctccaccgggtacctgccagcggcggtctccccggagagcatgatggcggaggtgccgtcatagacagcgttggccacgtcggtgatctccgcccgggtgggccgggggttggtgatcatgctgtccagcatctgggtggcggtgatcacgtgctttccgtaccccagggtataggcaatgatgtccttctgaatgacgggaatctcggtgaagtcgatctccactcccatgtccccccgggcgatcatcaccccgtcggccacagccagaatctcgtccacgttgttcacgccctcctggttctccagcttggcgatgatccggatgtccgagtggtgctcgtccagcaggcggcggatctccatcacgtcctgggcagtgcggcagaaggaggcggcgatgaagtcaaacccctcctggatgccgaagaggatgtccgcccggtcctgggcgctcatgtagggcatggacagatggacgccggggacattgacccccttccggtcctttaccaggccgccgttttccaccaggcagaggacatcggtctcggtgcgctccaccaccttcatgctgatcaggccgtcgtccagcatgatctggctgcccacgtggacatcctgggccagatttttatagctcacgctgcagatctcctgggtaccgatgacctcccgggccgtgagggtaaagtgctggccggcctccagggtgaccttcccctcctcaaaggttctcaggcggatctccgggcccttggtgtccagcagggcggccacagggagattcaatttcttccgcagggccttgagctcctccaagcggcgcttgtgctcgtcatggcttccatgggaaaagttaaaccgggccacgtccatgccgttctccatcatggcctgcagaatctccggggaatccgtggagggacccagcgtgcagataatcttcgtttttctcatcaggcagcacctccgtttggctgtcataggattgcatacaattcggaacggtttattttacaccttttgcgcccaaaaggcaatcggtttcctcatcggttgcgggggttgagggccttccgcagcccctcccccaccaggagcagcgccagcccggtggccacaatgcacagccccggcgggagccaggcccaggggcgggtggtgagggtcaccagctccatggcgctctgggtcaggttgccccaggaggcctggggggtccgcagtcccacccccaaaaagctgaggctggactccgacagaatggcccggaccaccttcaggggcagggaggcccacaccggggccaccacgttggggagaatggtgcggaacagaatctcccgatctgtggcccccagggcccgggaggcctccacatactcggctttcttggccgatagggtgccgctgtacaccagccgggccaccgaggcccagcccaagccgccgatgaccaggatgatgttccacaccgagggccccagcagggtcaccatggccagcaccaacaggatgctgggaaaggactggaaggtatcacaggcccgcatgatccagtattcccatttcccccccttatagccggccagcagcccaagggggacccccagcaccccgcccagggcggcggaggcaaatcccaccagcagggagacccgtccccccgccagcagccgggacaaaaggtcccgcccggcctcgtcggtacccagcaggtgcgccgggctgggcggcgcccagaagccggcggttcgatctgtcacattggggtcctggcccagaaagaggggcagcagcagcaccagcagaatttccgccagcagaaacaccgcggctgccgccgcccggcggtccgaccaaaagacccgccaaaaggaacgcagtggcttcatcgtccctcacctccccatcccacgccggggtcaaccagccggtagaccaggtccatgaggatgcccgtggccagcactgtcagggcaatgaccacggtgaggcccataatcacggtgtagtcccggctggagaccgaggtaaacagcaggctgcccatccccggccagccgaagatccgctccaccaccagggagcccccgatgatatgggggatatggttgaggatggtggtgaccaccggcagcagtgccgtgcggaagccatgcttccaaaccaccgcccactcgggcagacccttggcccgggcggtgcggatgtagtcctctcccagcacttccccgcaggcgctggcggtctggcgcaccaggttgcccaggctgctcaggcagaccaccgaggccgggagcaccaagtggcgcagcaggtcccccaggccgcctccgccggcggcggagtacatccccgccgccggaagccagcccaggaccacggaaaagaaaaaaatagccagtacacacaaaaaaaagcccggggcgctgaagctgagcagagtcagcccgccggccagccggctccagagggagcggggcttccaggcggccatcacccccaggggaatgccgatcaccaccgcggccgccactcccgtccccgtaaggatcagggaggggcccacccgctgggcgatcatgcccaggaccggttgacctgtacggtaggacaggcccaggtccccggtgagcagctccttcagccacagcacgtagcggacgggaaggggctggtccagaccaagattcgcctccagcgcggcccgggcggccgcgctggaggcgtcttccccccccgccaggtcggcaatggtggcgggggccatattcatgagaaaaaagacgaggagggtgatgccgaaaaacaccgggagcgcacccagaacacgttttacaagatactgtgccaaaattgcttcctcctacacttccggcccgaacgggcacaggcccccaaaagggccttacggaggttaaattcgaatgcggcgatgccgcttgccattctttggggcgccgcgccgtggaacagcagggcccggcgccgtttgaatggcggcttgtccgggtgggggagcttgtggggttctccctacgtcgttggaacgggcgggaacggggccctcccgggcggggccctatttctttggagaaataggggaaagaacaccaaggggaaggaggttccttccccttggaaccccattctctggtggggggaacgggggaaggtggttccgtcaggtaggggcctggcctgcggcctccaagaccaacgcctcatggcccgcccaccagctcgggcgggcgggagaagtggtttattgacggaaggaaaaacgggaacccgaacggttactctctgccttttcccaaagggtacccacccacgcccccagcccgcccagccggtgggcgggccgttacggaccttccaatgtgagggccgcaggccgggtatcccataagaggtacagcctccccccacccaatcccaccagagaagggagtccagagggaagaacctcttccctctggggttctttcccccatttcttcccaagaaatggggccccggctgggcaagccaccgttccctgccgttccaacggcgtgggagaaaacccgcaacgcccccgccgccgcagaacgcagcgtcaaagctctgcctttacgaggccgtcttctcccactgccagacattctcattgcagcaggacgcggcgggatagtcaatccccgtcaccgtcttcgactgcacatgcagggcatgggtaaaccacagaggaataaagggcttctcctggtccaaataggcctcaaactcgtccaccaggtcaattcgggcggtctcgtgggtctcctgattgatggcgtccagcagcgtggtgtagtggctcaggtccgccacccggaaaatgttgtggtcgggggtaaagcggctgccggtaaaccacaggggcagagtggtgggggtatgactggccacggccaggtcataggtgccgtcgttcatgccggcgaacatggtggccgagtccaccgtctcaatctccacctgaatgcccaccgccgccaggttctgctgaatcaaagccgccaggctggcccgagcactggtgcaggccagggtgtaggtctccccctgatagcccgccttgtccagcagctgcttggcctggtccgggtcataggtcgtcaggtcactggggccggaatagggggtgtccggcaggatgctggagttggtgaccgtccccagggtcccgctgttctgctggcacagcagctgcttgtccagggccttttcgatggcatggcggaggtccgcgctggcaatggactcgttgttgatcatcagctcatagaaggtgctgggaacctccccggcctgtacggtgaagcccgccttctccgccaccggccggttctcctcggagacgctgccgccgaaggtgtagtaatccaggtccccggcgatgagggcggtgaggaggttggccttgtccatcaccgtgatggtgagggtgtcaaaccccggggctcccagctggtagttctggttgctcttgagcaccaaggtgctgccggaaacctcggagacatactggcaggggcctgaacccacaggggccagccagaagtcatcggtcatcagttcctccggggggatatcctggagcagatgggtgggcagcacatagatgtcccggttcttgtccaccaaaaactcctccgggagggtgggggaggtaaaggtgagcttcagggtgtactcatccaccgcctccacccccagcttttccccggccacagcggccccggtctcgtcggtgccggccaggccggcaaaggtggtgcggcccagggtctggcaggcgggattggtcaccagggtgatggtgtccacccagtgctgggcagtcactggggttccgtcgtggaaggccgccttttggttcaggaaaaatacaatggaatagccgtcatcggcactctcccaacgctccgcagctcggggctggcaggttccgtcggcctgaacataggccagccggtcatagagcttatcgtagatgatccgggcatagttgctcccggagacgctgtaatagggcatcagggaatcccaggggttggagatgccgtagttcacattgactgcggctgtctgctcctggggcacctgctggggggactgggacttctccttcccgcaggaggacaggaacaggctgcccaccagggcagcggccagggccagggcggccaggcgggatcggttgtgtggtttcaagggcttattcctcctcctcgccgctgaggctctcatattcgtcatagtcgtccgccgcgtccagctgggagctgagcatcatctgctcaaaatgggcgtccagctgcttggcaaattcctgggccgcgttgtagcccatccgcttgtggcggttgttcatggccgccacctccacaatgatggccaagttccggccgggcttgatgggaatggtgatggcggggatcttcatgtccaaaatggtggtaaactcctcattggtccccaggcggtcatagaacacctggtcattccactgctccaggttgaccaccaggttgatgtcctggtcctcccggaccgcggacatgccgaagagctgctggatgtccaccacgccgatgccccgcagctcaatgtagtggcggatgagctccggggccgagcccaccaggcgggtgccgatgtggcggatctccaccgcgtcgtcggccaccagacggtggccccgcttcaccagctccacggcggtctcactcttgcccacgccggactcccccatgaggaggaccccctctccgtagacatccaccagcacgccgtggcgggtgatccggggggacaggcgggccttgagccagtcagtgaagttggggatgaacagggaggtgtcctccttgctgcgcaggatggtccgcttgtgcttcaccgccatctccatgagctccgggaagggctccaggctgcgggtgaggatcagggcggggatgggcttttccaaaaaggcgtcgaaacatttccggcgctcctccgggctctggttgttcagataggtccactccaccttgccgatgacctggatgcggtccggggcgaagtagtcaaaaaagccgaggatctgcagggcggggcggttgatgtcatcggcgcggatgagacaccgatcgtagttttttccctggttgagcacttccagctcgaaccgttcgaccagtttggtcaatttgattgccgactgagatgccataattcctcctcttccgtgtcgctggggccggggccccggggcgggacgttggggtgcttgcctgggtattataccatagcttggggaaccttggcaagagaagggcccccgggggcggaaaacaaaaaagcacaggcggtggcctgtgctttttatcgggtttggattgtcagatcagacagcgcgggtaactttgcccgaacggaggcaatgagtgcacacatagacgtgcttcggggtgccgttgacgaccgccttcacgcgcttcacgttgggcttccagggacgattggagcggcggtgagagtgggaaacctgaatgccgaacacgacgcccttgtcacaaaattcacatttagccattcgcttgaacctcctcgctggtttatgactccacggcgggaaaaatctcccctccgtgtgttgttattgaaaaagcatcggttagtataataccagaaacagggacaaaaagcaagtcctattttgcagatttctgaaaattccgacgccggctcaggtcagatccaggtctcttccatctcgtggcgcttttcccggcgcatgagctcctggagcaccgtcttggggtcccgtccctcatagagcacctggtaggcggcctgggtgatgggcatctccacccccgcccgcttggccagctcccgggcggagtccacggcgtagtagccctccaccacggcgccgatctcctggatggcctgctggacgggcatgccctggccgatgaggatgcctgcccggtagtttcgggagttcatggaggtgcaggtgacgatcaggtcccccatccccgccaggccggcgaaggtctcccgccgcccccccagggccacccccagccgggcggtctccgccaggccccgggtcatgagcatggccttggtgttgtccccataacccatgccggtgcagcagccggtgcacagggccatgacgtttttcagggcggcgcccagctccacccccaccacgtcgctgctgctgtacacccggaagcggtcgttcaaaaacaggtcctgcaccgtctccgccgccgcctggtccgggcaggccgagaccacggcggtgggcacccgccgggccacctcctcggcgtgggagggaccggagagggccaccacggggcagaggtccccggtggcctggcggatgatctccgtcatgcgcagggaactccccttctcaatccccttggagaccgagaccagaatggtctccggggtgagcatcccccggatgccctccgccgtggaccgcaccccgaaggagggggtggccatgaccaccacgccgcagccccgcacgcaggacaggtcccaggtgtaggacaggctctccggcagggtcacgccaggcagaagggggttctccctggtctgctggagccgccgggactcctcctccaggtaggaccacagggtcacagtatggccgttctccgccagcagcatggccagggccgtcccccagccgccgctgcccaacacagcaattttcatgactggcacctcactttactttcttatggaaatagaacttggactcggtccccgccagcagccgctggatgttcccccggtgcttccagaggatgagaccgccgatgatgatagacagcagcagcaagatcccgtcgtgatagaccagccaggtggaaatgggcaccgtcacccctgtggagctggagcccagggacacataacgggtcagcagcaccaggatgagaaagcccccccaggccaccagggccacccgccagtcaatcataatcacaatggtcccgccggacagaatgcctttgccccccttgaactggaacatacaggggaacatgtgccccagcaggcagaacaggcccgcccagtagtcgctgtacgcctcctgggggccgggcaggccggcgggaagatggcccaccagcagccagccgcccaccaccagggccacaatggccttgagcacgtcggtgagaatgaccccaaaggtcagagggccgccgaaggtgcggtaaaagttggtcagccccgcgttgccgctgccatgggtgcgcacatcgtcccgcagaatgtatttggacacgatgaccgccccgttgaagcagccgcagaaatacgcgatggccgccgcggccaccgcgcgaatccagaattcccccatggtgtcagtcctccttgtcgcccttttgccggatggtcagccggatgggggtaccctccaggccgaaggtggcgcgaatctggttttccagataccgctggtacgagaagtggaagagcttggcatcgttgcagaagcagacgaaatggggggggcgaatcccggcctgggtcatgtagtaaatcttcagccgccgccccttgtccgtggggggctggacccgggcggtggcatcggccagaaggctgttgagcatgccggtggtgatccgcatggacgcctggtcgtttacgtactggatcagctggaacagccggggcacccgctgcccggtgagggccgagataaagacgatgggggcataggtcatataggacaggtcccggcggatgtcctggcgcatacggtccatggtcttgtcgtccttgtccaccgcgtcccacttgttgaccacgatgatgcaggccttgcccgactcgtgggccatgccggccaccttggtgtcctgctctgtgaccccctcgttggcgtcgatgaggatcagacagacgtcggagcgctcaatggccatggccgcccggaggaccgagaacttctcaatctggtcgctcaccttggcctttttccgcatgccggcggtgtcgatgaagaggaacttacccacctcattttcaaaatagctgtccaccgcgtcccgggtggtgccggccacgttggagacgatgacccgctcctcccccaaaatccggttgatgagggaggatttgcccacattgggcttgccgatgaccgccaccttgatgaggtcggggtcctcttcttcctcctcttccgggggaaaatgggcaaagcaggcgtccagcaggtccccggtgccgtggccgtggacggcggagacagcgatggggtcccccagccccaagttgtaaaactcatagatatccgggttggtcatgcccacctggtccattttgttcaccgccaggatcaccggcttccgggcccggagcagcaggttggccacgtcctggtccgcggcggtcaggccggtcttcacatcgcacaggaaaacaatcaccgtggcgttggcaatggcgatctccgcctgcttccgcataaaggacaggatctccgtggtggtgcccggctcaatgccgccggtgtccacaatgtcaaaggtccgtccccgccattcacattcggcgtacagacggtcccgggtgacgccgggggtgtcctccacaatggagagacgtcggcccaccagtttattaaagagcatggacttgcccacattggggcggcccacaatggcgaccagcggttttgccatcgcagattcctcctcgtaatcaattcagttgctttggttgtggctgtggggtacaggtagagggcgttgtggagttcttcctccacgccgttggaacgggcgggaacggggccctcccgggcggggccctatttctttgaagaaataggggaaagaacaccaaggggaaggaggttccttccccttggaaccccattctctggtgggggaaacgggggaaggtggttccgtcaggtaggggcctggcctgcggcctctaagaccaacgcctcatggcccgcccaccggctcgggcgggcgggagaagtggtttgttgacgggaggagaaagcgggaaaccaaacggttcctctctgccttcgcccaaagggtacctacccacgtccccagcccgcccagccggtgggcgggccgttacgggccttccagtgtgagggccgcaggccaggtatcccgtcagaagtacagcctcccccacaccaccccaccagagaagggggtcccgggggaggaacctcctcccccggggattctttcccccatttcttctcaagaaatggggccccggccgggcaggccccgttccccgccgttccaacggcgctgggcccccacagcacagaaccccagcgccggcactacaccccaaacaccgcctcaaacaggtcaaacccatcctggttcaccggcaccaccggcacccccagcccctgggacagctcctccaaggtcatgtcatccaagaacaccgtctccccatggcgcagggtattttggggcagaagcacccgggtccccaggtccttcccccggagctgggccagcaggtcctggccggtgagcagccccgccacggtgatggtctccccaaagaagtggttgacaatggggtaaatttgataatctaatttagtatgacattttgcggccgccctgtcaatgatttcccgcagaaagggggcggcggccacaccggtggcgatggagaagggcgccaccgggatattctgaggggcccccagggcggcgccgttcagctccacctccagcagccggagcatgcccaccccattctccagctgggtgtacgcctcatagaatgcatcctcgggcagagggagctccccctggaggtagaactcgtcggagcaccagaaaatccggctccccttctcccccaggcaccgggccccgtaggcctccacctggcccaccacctcccgggcctcgtctacggtgtagggccgcaggggatagagccccttccggtaccgggtcaggcccacggggacgacggagacgcttttcacctgggggtagagggccgccaggtcctccatactccgctggagcacgccgccatcgttgaggccgggacaggccacgatctggcagttcatcacgatccccgcccgggcaaactgctccatgatctccaggcactccccgccccggcgctggttgcccagcagcaggcggcggaccgccgggtccgtggcgtggacggagatattgatgggggagatgtgcaggtcgcagatccgctggagctcccggcggctgaggttggtcaaggtgatgtaattgcccatgagaaaggacagccgggcatcgtcatccttaaaatataaggtgtcccgcatgccctggggcatctgatccacaaaacagaacacgcacttgttggcacaggagcgggcccggtccataaggtaggtggcaaaggtcagccccaggtcctcccccacgtccttggacagctccaccgtccgctcccccgcctccgaccggagctggaggaccagctcggggtcgtaggcatagtatttgtagtccagcacatccacaatgggatggccgttgatggccagcagggtctccccgggccggacccccgcctgatgggcgggggtgccaggggccaccgactggatctttgtccgggacatggtccccgcctccctttccttggtggtccgcgcctggccaggcgcgaaaaggagaaaaaaagaagaggggcttccccctctttctttttccctattagttctcctgctgtaccggaacctggccgaacaccttgccgtcgtaggtcatgcaggccttgcacagccggtggggcagccgatacgcaccgcacttggggcaggtcgtgactgcgggagctgccagcttccagttggcacgccgcttatcccgtctctgcttcgagactttactcttcggaaccgccatttcgagacacctccttggtgatgccctgtcgggcaaagtggattggttactactcagtttttattaagtagctgctcgagagcggcccatctgggatcggcctgcttcttacaccggcagggcgcctggttcaggttgacgccgcagccggggcaaagtcccttgcagtcttctgagcataagtgttttgtgtccatatcgagaatgaaggccgtgtaggccagttcccccacatcgacctcgccctggtccagcaggacaatgtcgtcgtcctctccctccagcgtctccgccaagaggaagcgcaggctgaccgccttctcccggctgaatcggcacatgcaccggtcacaggtgtagtccagaagggacttggcctcgccctccagcatcagcacatccgccacgttctttacgtgccccgtcaccgtcaccggccgggagatgggatactccccaaaaaatgcctcctggctgagatccagctggaaggcaaaggggatgctggccccgggcacatgcatgatctgttgaagattcagtcgcatagcatactcctcacatggtacaggggatattgtagcaaaaaaaaacgcccttgtcaaatacttttcttcaattttcgcaaattcatggtataataggcaccggaatcccagcttgtctcctctggaccgccgccaacaaagtaggatacaccccttccccgccggcgtcaagaggaaattcatcggagaaaggttgtgctcccatgcgggaattcaccataggccccaacgacgccggccagcggctggaccggtggctggccaagaccctgcccctcctgccggcccccctggcccagaaatacatccgcatcaagcgggtcaagtgtaacggcaagggggccaagcgggacacccgcctggtccagggggatgtgcttcagctgtacatcaacgacgagttttttgacacccccaccccggaaaacgcctttctgtcggtcttcaagccccagctggacattgtctatgaggacgagaaccttctgctggtgaacaagcgcccgggactggtggtccacccggacgagcaggagaaggtcaacaccctgctcacccacatccaggcctacctctatcagaaaaaggagtggaaccccaggcaggagaatgccttcgcccccgccctgtgcaaccgcatcgaccggaacaccgggggcatcgtcatcgccgccaagaacgccgagaccctgcgggtgatgaaccagaagatccgggaccgggaggtggagaagtcctacctgtgcatcatcttaggggccatcacccccccggcgggcaggctggagggctatctgctcaaggacgaggccaaaaagctggtctccgtccacaaaacccccgtccccggcgggcgcaccgctgtgaccctctaccaaaccctggcccagaaaaacggcctgtccctggtggcctgccgcctggtcaccggccgcacccaccagatccgggcccagttcgccgccgccggccatcccctgctgggggacgggaaatacggccgggcccgggagaacaaaaagtacggccgcaccgggggccaggccctctgctcctaccagctggccttccgcttcaccaccgatgccggctgtctggccggcctcaacggccgggtgtggaccgtggaccaggtggatttcgtgacagactacttcccccacgtccccctgcacccgtgacaggagaggcattttctcgacgaaaaattcttttccttgacagggggatttttttctgctaaaatacgcccatatcttaaattggaaaatcaggttttgagtctttccaaagcaagacacgaccgccacagggtctcccgccccgtggccaaggccacacggacagccgggtcgaatgccgagttccgcatgatgcggcggcaacttctgttgccttattgattgggttcaaagcccaagttttataagttggtaactataaaccggtgctcagccgagcacgcagcgcctccacgggcatgcaaacttgtgaaatggtcaataagagtagtaaaagtaagtttctttgctatatagactctcatcccctgattctccaccctcctcttccctgcccagggatgctttgtggagcttttccaagtgactgtatgccgccggcgtgcagtcactttttttgtgtttttgggagggccgtgtatgaaaaaaatcatcgagctgaaaaacatcaccaaagcctttgacggggagcctgtgctccagaacgtcaacctggacatctatgacaacgagtttatcaccctgctgggcccctcgggctgcggaaagaccaccatgctccggctcatcggcggctttgagacccctgatgagggcgatgtcctctttctgggcaagaaaatcaacgacgtgcccccctacaaacggaacgtcaacactgtttttcaaaagtatgccctctttccccacctgaacgtctttgaaaacgtggccttcccccttcgggagaagaaggtgcccaagggggagattgaggccaaggtccacgagatgctctctctggtggccctgagcggttttgaaaaccgcgctgtcacccgcctgtccggcggccagcagcagcgggtggccatcgcccgggccctggtagcccgcccccaggtcctgctgctggacgagcccctgggggccctggacctgaagctgcgcaaggacatgcaggtggagctgaaaaagatccagaagcagacgggcatcaccttcgtctttgtcacccacgaccaggaggaggccctgtccatgtccgacacggtggtggtcatgtccgagggaaagatccatcagatcggcacccccatcgacatctacaacgagccccagaacgccttcgtggccgacttcatcggggagagcaacatcctggacggcaccatgctggaggactacaaggtctccttctccggccagaccttcccctgcctggacaaggattttggccggaatgtcccggtggacgtggtggtccggccggaggacgtggacattgtccccctggaacagggccagctcaccggggtggtcacctccgtgaccttcatgggggtccactatgagatcatcgtggacgtgggcggctttaagtggatggtccagaccacggactttgtggacgtggacgagcacatcggcatcgtgctggagcctgacgccatccacatcatgaaaaagtccgagtactccaaccggtacggggactactcctccttctccaacgagctggaagagctgtccgagatcgcggaggaggaagccgaatgaaacacaccgtcacccgggaccggcgcaggatgctccgggccgattacgcggccctgggcccctactccctctgggccctcctgtttatcctggtccctctggtctttgtggcctactacgccttcaccgacaacaacttccagttcaccctggaaaacgtccagcggttcttcaccgccacctccagcgtcctccaggaggacggctcctcggcggaggtgcacacctacctgctcatcttctggcgctccttgaaattggcggtgatctccacggtgatctgcctggtgctggcctatcccctggcctacatcatggcccgggccaagcccagaacccagaagattttcctgaccatcatcatgatccccatgtggatgaacttcctcatccgcacctacgcctggatgaccattttgcaggacacgggcattttcaacaacttcctcaccctgctccatctgcccaacgtccacatcatcggcacggaggcggccgtggtcatcggcatggtctatgactacatcccctacatgatcctgcccctgtactccatcatggccaagatggacgaaaagctcattgaggccgcccgggacctgggctgcaacggcctgggggtcctgcgccgggtgatctggcccctgagcctgcccggggtgatctccggggtgaccatggtgctgatcccctcggtgagcaccttttacatctcccaaaagctgggcgacggcaagatcatgctcatcggcgacgtgattgagggccagtacgtggccaacaacctccactttgccgccgccatcgcctttatcctgatgatcctgctgctggtgtgcatggccgtcatgcggaagctggccagccgccacgtggaaggagggctgtaacccatgaaacccattgccaaagtctacaccgccattatcttcctcttcctcttcgcccccatcgccatcctcctggtcttctccttcaacagcggcaacagcctgtcggtcttctccggcttttccctgtactggtacaaggagctcttccaggactccaacaccctggaggccctgcggaacaccctggtgctggccctgtgcgcggccatcctctccaccgtcctgggtaccgccgcctcggtggggatgaacaagctgcgcagcaagtacatgcgggcggccatgaacaccgtgaccaacctgcccatggtcaaccccgagatcatcaccggcatctccctgatgctcatgttcgtctttgtggggcagatgatggggctgtccaccagcctgaatttcggcaccatcctcatcgcccacgtgaccttctgcctgccctttgtcatcctccaggtgctgcctaagctgcgccagatggacccggccctgccggaggccgccatggacctgggctgccctcccctgaaggcctttctgaaggtggagctgccggagatcttcccgggcattctcaccgggttcatcatggccttcaccctctccctggatgactttgtcatcagctactttaccaccggcaacgggtttgagaccctgcccatccggatttacagcatgaccaaaaagacggtgacccccaagatgtacgccttggccaccctgatcttcttcgtcattctgatcctgctgctcctgtccaacctgtccgaccgggacgacaaggacccggcccggcccagagcccgccggaagctccggctgtaacccctggatgctctgccgccaaggcggcttccatcacccacccatgaaccacaaaaaggaggacaccccatgaagaaaaagctttctgcccttgccctggcgctggtcctggccctcagcctgtgtctgaccggctgcggcggctccgacaccctgaccctgaacgtctacaactggggagagtacatctccgacggctccgacggttccctggacaccatccacgcctttgaggactggtatgagagcacctacggccagaaggtcaaggtcaactactccacctacgccagcaacgaggacctgtacgccaagctcaaaagcggcgcggtgagctacgatgtcatcatcccctcggactacatgatcgcccggctcaaagacgaggggatgctccagcccctgaactttgacaacatccccaactaccagcacatccacgagggcttccagggtctctactatgacccggacaaccagtactccgtcccctacacctacggcgtggtgggcattatctacgacgccaaccaggtggaccccgccgacgcccagggctgggacctgatgtggaacgagaagtacgccggcaagattctccagttcaacaactcccgggacgcctttggcacggccatgtacaaggacggcctggacgtgaacaccaccgacaaggcccagtgggaccaggccctccagaccctgctggaccagcggcccctggtgaagggctacgtgatggatgagattttcaactccctggagtccggggaggccgccatcggtgcctactacgccggggactacttcaccatggccgaggcccaggcggagaacgtggacctgcagttctactaccccgaacccaccaactacttcattgacgccatgtgcatccccaccggctgccagaaccaggagctggcggaaatcttcatcaactacatgctcagcgaggagcccgcggtggccaacgccgagtacatctcctacgcctcccccaacgccctggtctatgagagcgagacctaccaggccgacatgggccaggaggccatggaaatcctctatcccgacctgggggattttgcccagcagtacaacaccctggcctaccggaacctctccaatgagatgctggactatgtgaacaccctctgggagaccctgaaaatcaactgaccccgcggaaagcaagcagagaagcagcgcgggcccgccgatggcgggcccgcgctgttttctgtcctctcacaggctttcactgtcctcacagcttctggaacatccgcaccgccatgatgagagcctgctcccgggaggcgttggcgtagccaatggcctcctgggcggcggtgacgttccggggggagaaggtggtgggggaggtccccttgatgacctggtttttcaccatgaaatagacgctgggtttggcataggcactgatgtccccgtcgtcggcgaagggggtggtcccgctgtaatctaaggtgtactggtcatcggtggccagggtccagccggggaggttcagggccttgtacacccgggtgagcatggtggccagctgctcccggctgatgtgggtgtagggggcgaaggccgtgggcgagacaccgttggtgatccccagggcgtaggccttcttcaccgcatccgagccggtgtcggcgaaggggctgtccagggcagccgcgtccagtttctggccgcccatctgctcgtacagccgcaccgacacggcgcagaactccgccctggtgatgtcccgggtcaggtcccggttctggagctcggcggggatgaggctgtcaaaaatctcctggttgatgttgtcccccatggcctcgtcctcaaaccactccgaccagccgctctcctcatcataggccataacctggaggatgggatagccctggttgaccttttgggtgtcggcagcaaaggcgctgcccagctgggcagcaaaggaggcctgcttcatggccccggtgcccaggagggtgcagccggtcaggcggctggcgctgccgctgcccagcagggcagtgcacaggtctccgttggcgtggaggttgcggtaggtgccgctggcgtccaggtggcccagcaggccgccgatctgggcccggccgttggtgttggcccggatggtgacagcgctgtaaccgttctccagtgtggcccccgactgataggtctggcccaccaggccgcccatgttcagttccctatcggtccgggcaaaggtcacggtggcgtccatggagcccaccacatagcagttgcggatggtgccggcgtttgccccggcgatgccgccgatgttcacccggccgctctgagaggaggaatctaccgtgaggtggaagtcccgcagagtcacggtggcgaagcactcctcaatggtgcccagattgcccccggcgatggcgccgatgtcagggtgatgggacacggtatcctgggtggagatggtgccgtccacattgagcccccggaccacgccgcccttgcccacgatgccgaacagcccgcccccccagagggtgctgcccccggtgctggtgccggcggaaaggcggctgatcttcaggttccgaatggcgtagccgttgccttcaaaggtccccacgtatcccgacgaactcaggccgatggggtcccagtcctggccggccagatcgacgttggcgatgaggctggcgcacaggtcccggtccccggcgttcacctggtcccggaagttcttcagctgctgggccgtggcgatgaggtagggatcgttccgggtgccgctgcccccggcgtagtccaccgccccggcgggcaggaccatggtcaccagcagagagagggtcattgccagggtcagggccgcgctgcacacgcgtctttttactttcattctctttcctcctttgtgcatgttctgcacgaatctatcaaaatgatatcacattttccctctattttctacttttttctcaaaaaagaaaaagagaaacccctttttccgccggcggcggaaagagggatttctctacgggcagctgtcgaaacgcaagctcacccgaacaagctcatctgactggtctccggcagggtgcccagggcgccggcgtcccggagctgctccacgtgggttttggagaccttggggcaggcggccagcagctcctcctgggagatgaaggtccggcccacccggttctccacaatggagatggccgctgtctcccccaggccggggatggcggtgaaggggggcaaaagggtccccttctccccgtccatgagaaacttggtggcgtcggagcggtagaggtcgatgtcctcaaactggaagccccggagatagaactcgtagcacacctccagggtgaccatcatgtcctcctccacggcggcggcctccttgtccttggcctcgatctccttcatcttctggcggcagacctccatgccccggcacatgcaggtggcgtccagggccttggcccggatggagaaataggcggcgtagaaggccaggggccgatgaaccttgaaccaggcgatgcggaaggccatcatcacgtaggccaccgcgtgggccttggggaagaggtagccgatcttggccagggagtcgatgtaccagtcggggacgttgtgctcccgcatggcctcctcccagccggcctggaagccccccttcttcaccttgccctttcgcaccgcctccatgatgtcaaaggccattttgggctccaccccctgctccatcaggtagagcatgatgtcgtcccggcagcccaccgtggagtcaacggtggccgtgccggagacgatcaggtcccgggcgttgcccagccacacatcggtgccgtgggagaaacccgacaggcggatgagggtgttgaaccgctccggctgggtgtcgcagagcatctggcgggtgaatttggtgttgaactccggcaccgccaccgccccggtggggcccaaaatcgggtcgtcctcgtaccccaggggggcggagttggtgaagatggtcatggtgtccttgtcgtccaggggaatctcctgggcgttgaccccggtgaggtcctccatcatacggatcatggtggggtcgtcgtgccccagcatgtccagcttcagcaggttatcctccatcttgtggtagtcaaagtgggtggtgatgatgtcggtgcccgtgtcgtcggcggggtgctggacggggcagaagtcgtagatctcccggtcctgggggatgaccaccatgccgccagggtgctggccggtggtccggcggaccccggtgcagccaatggccaggcggttctcctcggccttggtcacctggagaccccgggcggccaggtacttcttcacatagccataggcggtcttctccgccacggtgccgatggtcccggcccggaagacgtggccctccccgaagagtgcaaaggtatacttgtgggcgttggcttggtactccccggagaagttcaggtcgatgtccgggaccttcttgccgccgtagcccaggaaggtctcaaaggggatgttgaaaccgtccttcacatagggcgtcccgcacacggggcacacctggtcgggcatgtccgccccgcagccataggcctccccggcggcaaaatccgcgtgcttgcacttggggcagcggtagtggggaggtagggagttgacctcggtgatccccgagagaaaggccacaatggaggagcccaccgacccccgggagcccaccagatagccgtgctccagggagttctggaccagcttctgggcggacatgtagatgacatcgtacttgcgctcaatgatgccgggcagctccagctcgattcggtccttgacgatctggggcgggtcctccccatagagctcgtgggccttgccccagaccaggttgtacagctcctcggcggagttctccagcttgggggcaaagagcccgtcgggcagaggcttgacgttgtcacaccaggaggccaccagctgggtgttggtgaccaccacctcataggccttcttctcccccaggtaggcaaactccgccagcatctcctccgtggtgcggaagtacagggggttgggggcgtcggcgtcgtcaaagcccttggtgtccagcagcacatggcggtaggcctcgtcctccgggtccaggaaatggacgtccccagtggcgcagacgggcttgcccagctcctcccccaggcggaccaccgtgcggttccattcccggatctgctcccagtcccgggcgatggtcctgccgtttttgtccgggcggaccatgaagccgttgttggacaggggctggatctccaggtagtcataccaggaggcgatccgcagcagctcctcccagtccttgccccggacgatggcctggtagagctccccggcctcgcaggccgagcccaggatgaggccctcccggttccggttgatctcgctcttgggcatgatgggaaagcgtttgaaatagttcaagtgggccagggagatgagcttgtacaggttccgcaggcccgtctggtttttggccaggacaatgaggtgcttgggcatccgcttggccttgcccagggagctggtcttggccagggcggggtttacctgctggagggtgttcaccccccggtcccggagcatctggatgaaggggaccagcatatatcccaccatggccgcgtcgtccgaggcccggtggtggttgaagtccggcaggttcaggtggcggcagacgatgtccagcttgtacttgcccagctccggcagcaggttctgggccagggggagggtatccagaaaggtgggagtaaaggcaatgccgtacctctcgcacccggcccggacaaagccgatgtcaaactccgcgttgtgggcggccagcgggcggccgtccacaaaggccagaaaggcccgcagggcctcctcctggctgggggcccccaccagcatgtcgtcggtgatgccggtgagctggacgatgttgggggccagcttccgctgggggtccacaaaggtctggaaccgctccttcacctgccccttctccaggaccaccgcgccgatctcggtgatcacatcctcggtccggctcaggcccgtggtctccaggtcaaagcagacgatggccccgtccaggtcctggtcctgggggccccggacggtgaggcggtcgtccacgtcgttgatatagtaagcctcggtgcccagcaggaccttcagcttgtccttgccggcgctccaggcatcggggaaggactgggccacaccatggtcggtgatggcgatggcgggatggccccaggcaatggcccgcttcaccgcgtccttggtgtcggtgagggcgtccatcagggacatcttggtgtgtaggtggagctccacccgtttttccggggcgttgtccttcttcacgggcttctccgccgtctcaatgatcaggggctccaggaccatgtcgttgtcaaaccggttcaggttcagccggccggagatcttcaggtgcatccccgtcttgaccccctccacaatggggagtccctcgtccccgggcatgaacttgctcacccggatggagctggtgtagtcggtgatgtcaaagctgatgacccaggcactgcgctttttcagctcccggtgctccacggcgaagacgtccccctccacggtgaccacccccatgtccagctccagggtattcatgggcttgggggcctttttgatctggcgggtgccgtagatccgcttggcggaaaagccctgggcctgcttgtgggccgcccgggcctccgccatggccttctggcgcagggcctccgtctggcggaacagccgctcctgctgggagagggtctcctccgacggggtctccttcggcgccggggcgggcgggacagccgccggggcttccggcggggggggcgcgtccgccggggctgcctgggcgcaggccgggtggaaggtcacagcggacaggccatagacctgggccagctcccgttccacctgccggagaacggcggggtccgggagccgggggcagaggagcttggcctcaatggtccggttctggctgtccagcaccgcgccggtgaccagccagcctgtcaggacagcggccagggcgggggcggggcggtattgaaaaaacatctcaaaaaagggcagatttttctctggcataggtgacttcccttctcaaaaatggcaaattgtgctgtggggggacaagccctgggcggggggcggtgtggggttcaaagctcttcaatcagcgccatcagcgcatccagcagctcctcctggggcacctgccgcaccacttccccatggcggaacaggattcccttcccattccccccggcaatgcccacgtcggcggcggcggcctccccggggccgttcaccg

SEQ ID NO: 2239 - DNA, 30987 bp, KLE1738
ggggaaggcccccgccatcatttacggcgccctcccctacgccacccgccgcaagcagatggaggggtttctggccggacagatggactatgtggtctccaccgacgccatcggcatgggcttaaaccttcccatccgccggattttgttcatggacacagaaaaattcgacggggtagagcgccgggccctcaagcccgaggaaatccagcagatcgccgggcgggccggccggtacggcatgtatgacaagggctatgtgggcgccacccagaacttaggggccatccgggccgggctgaacaccgtggttccccccctccagcaggcggtggcagggttttccgacctggttctcatggtggacttcgacctgttggaggtcctcaccgagtggaacaagatgcccacggtggagccctatgtcaagctggatatcacccggtatcttaccatcatctccaagctccgggagcagggcttccaactgaccaaggagcaggagctccgggcagccaacatcccctttgacgagactgaggaaccgctgcgggcgctcttcttccacttcctccgcctccatcagcagggagaggcccttcctcagcccgagcttccccaggagggcccccggaccctgccggacctggagctctattgccggaagttagacctgtacttctcctttgccaaagcctttggctgcccggtggatgaggacgccctctatgaccggcgggaggaggtcgcagaggagatcaacgaaatcctcctgcaccgtttgaaaaacaacattcgcttctgcgccctctgcggcaccgccctccccctccatcaccatggccggctctgtgatgcctgctttcgaaagcagcgccggcgtggtttggggcggacgtaagaaagaaaatcacaggaatgagatgatacctcattcctgtgattctttttcctgggagacacgcctcccacaaatcatttttcatcctgcccagctcatttctgataagcagaacctgcccatggtcccccaacaatcggaacctggtttccaccatgccgtcttgccatttcacctgcaaaaacgctgtattctccgcaatggtttctttttggtgactacggcacattaaagtgcttacttcactttttatcccaatggatatattataatcctgcaagcgggaacagcaaaccgcaaataaaaacaagaaaactatggaggtatctttcgtatgaaaatcgcagttgtgtgtgcaaacgggaaagcaggatcgctgattgtgagggaggctgtggagagaggtctcgacgttaccgccgtggtacgcagtgagaatcagtccgcaacacagcaggtgatacagaaagacctgttccatcttaaagcatctgatttaaccggttttgacgttgtcattgacgccttcggcacatggacgctggagacactgccccagcacagcacgtccctgaaccacctttgcaacattttaagcggtcaagacaccagacttcttgtcgtaggcggtgcaggcagtttatatgtaaacccagagcacaccgcgcaggtcatggacggggtagatttcccggcagaattcaagccgctggcctctcatatgggaaaagccctggaagatcttcggaccagaaacgatgtgaaatggacctacatcagccctgctggggattttcagccagacggagcaaaaactggaaaatatattctgggcggggaggaattggtccgaaatgccaaaggggaaagcgttatcagctatgcagattatgcgattgctgtggtcgatgaagcggtaaaggggaatcatatccagcagagaatttccgtcgtcgccgaataaaccgtcgagggccctttgacgtccttcctggataggcagaggttttcttacagaagggagatattatgacacagaaagaacggcgtgttttcttaatcaactatttgaaaaacgaagaagaatctttcaaaggaattgtcatcccccatgatacagaggcacaaaaacatctccttcgcgctttgatgaacgtgcgtccgcccatgcctgtctcaaaggattttacggacatacaggacgaatatttacaacaggagaacaggcagcgtgggattgtatcccttggtgatttatctcaggaacagccggagatctatctctggcaaggggatattacccgcctttctgttgatgcaatcgtaaacgctgccaattctgccatgttaggctgctttgttccctgtcatggttgcattgacaatgccatccattccgctgcaggcgtgcagcttcgtctggaatgtgcccgcatcatggataagcagggaaaaccagaagaaacgggaagggcaaaaatcacaaaaggctataatctgccttgtcagtatgttcttcacaccgttggtccaacggtccatgaagccgtcacagagaaagactgcgaacagcttcgaagctgctaccgctcctgtttggaactggcggcaacgtatcatctgaaaagcatcgctttttgctgtatctccacaggagaatttcattttcctcacgcgcttgccgcagaaattgcaacgcagaccatactgcactaccagcagacacaccaaaaccgcctgaaggtgatttttaatgtttttaaggacaaggactatgaactctacaaacgcaaactggaaagacattgcccgtctaagggaaacgatacaaactgctgaggccatcatcatcggcgcgggggcaggactttccacttccgccggtttttcctattccggcaggcgttttaaggagaactttccagattttattgcaaaatatggcttttcagatatgtattctgccggtttctatccctacgaaaccttagaagaacactgggcttattggagccggtatatttttatcaatcgctatcaaaatccaccaaaaccagtgtatcaaaacctatttcatctggtacagagcaaggattacttcgtgctgacaacaaatgtagaccattgttttcagaaagctggatttgacaagcagagactgttttatacgcaaggagattatggtttgtggcaatgctcaaagccctgccataaccgcacgtatgacaacgaaacggttgtcaaaagaatggtgcgggaacagaaagcgatgcgggttccgtcggaattggtgccatattgcccgctctgcggcgcacccatgtccatgaatctccgcgccgacagcacctttgtggaagatgcaggctgggacaaagcggcaaacaggtatcaaaattttttaaggcagcacaaggggcagcacattctatacttggaactgggcgttggcgaaaatacaccaggaatcatcaagtatcccttctggaacatgacacatcagaatgcaaatgcgacatacgcctgtgtcaatttgtcagaggcagatattcctgcagaaatcaaaccgcaatccatcggtgtctatggcgatatcggcgacgtgttgcgagaaattgtgccgcagcggcaaacaccattgcgccggccaacggcaggataaccccctttccgcactgccgcgcgcttccgttgccagcgcatctgtaagaagaacaccactgtctgcaaaacccaatggtccacagccgcaagccatcgtttgaatggcctgcggctgtggttttggcgccctatcctactctgtcaacaattcccgcacggtatccacaatctccaacacgctgtcccggtccaccagcaggcgcgtctctccgttgaggcccaccagacagctgctgctgtcatactggtagaacgccagctccactgcagggtagctcgcattgtcctgctggaaggtgaagacgatctccgtcttatttcccgccgcattggcatcactgcccgtgggctccagttcctgaaggcggtccagcgcgtctgtaatctccacggtcttcccgtcccgctggtagacataggtctccgtcgtcgcaccgtcctcgtctgttgtctcctgcaccgtcttttccagggtgtaggcctccccatctaactggatctccacccccgtcacctggctccagtccagcaaaataacatcttggggcagcagatccgtcccattggcggccagaatagcgtcacacagggttccatccacctggtacaccatggaggaaccgcccagacgagcatagcaggtgtccccatcatagtcccccagctccagaacaaaggtcttgtctgtctgctgggtctcataaaccggctcgccgttctcatcggtctcgttggtctccacttggctggtctcggtgtagcggacggtgaccgtggccgccggtttgtccaggccgtagcgccccagatcgtccgccgacgcctggtattccacacagctgttccaggtcagaccggtgatgttctggaccagggattccgccaggtccgtgtccagtgccgtgtaacccccgtcagtcttccagaaccaggtatactggtcactgtatgccaggccgctgtcctcctggtattccatctccagcgtgcccgcgttggtggtgatctgtaccccgcgcaggtctgtcatggagggaatggtctctttttccacaatgtcatacagccccagggcaaaggtatccagcaaggaggcgtccaccaggtaaacattgccgtccccaatagaaagataccgctgtccccctaacccggtttcctcgccaatggccaactggtattccttctctccctggactgtaatggagcagacagcattctccaggccatactcgctcaggtcctccacattctcaatggtcttggccgcctgaatctccttcagggcctgcaccatcgcatccggataggactggtccaggggaaacgccgcgtccgccggataggtccagttgttctcctggtccttctccagggaaatggtctcctcctcatattgccaggtcagagacgtcacctggtccgggtccagggtaaaaattgtaacggcagtcgcttcctctgtcccctcgccgtccggggccagctccataaccacaatggtcaaaaccagcagcgccgccagggccagcagcagcaaccctaactttcttcctcgtgtcattgacgtttcctcctgatccagattcgaaggccaaaggctaaatagcccgcaggcaacactgccacaaccagcagcgtcagcagggaggcggtggaggcgctcatggtgaggtattccgtggtcatggtcttggcatgaatggagattccctcctccttttcacaggtccaccccatacagttgaggaaaaaatcctgattcgcgccggagacctgctggttgtattgatcattgagcagagacgtggaggcaatccaaaccacatggctctctgtgccgtccgccagggtttccgtggccgccgcggccaaggcaaagggccccgcctcatccccctcttccttttggtacgtctccatgccatatccggccagcttggaataggcctcgtcggaggtggtcagcagcgggctcaccgataagccctcccgggggaattcctccagcttcagtccctgggccagcgccatgagaatatagtacccgccctcctggaggggcgaggtgatggtatggctctccagattgggtaaaagatatactgggctccccaaagcgtagtgggaggggtctccttccaccaccaccccttgggccgacgacatgccatactccgccattagctcctccaaattgggccgctcctcccccgtctgggccgggtccgtgagcaggatcaaatccccgccctcctggaggtaggccagaatggcctccttctcctcctgggagaggtcactctccggcccacagatcagcaggcagtccgcgtcttcgggcacctcttccgccgtgagcagggagagctcctccagttccatattctgcttttccaccgcggactggaagctggcgctgagggcggactccccatgccctgtgagcgtgtacagtttgggcagggtgtcacggatcacatagtcaatggcactggtcagggcgctctcccccgcgaagttcatgtagtaagaggccccgtcatccccgtactcataggtatagatgtcctcatagcttacgtaggtgtaccgggcctcagactccacaatcaggctgttgttgtaaaccgtccccgtcacatactcctggacaaaattggggtccacgtccgggtcccgtttttccagggtcacacggtcgctgcgggacgtatatcggtccagcaaagttcccagggtctcatcctcctggccgctctgcaccagccaatagacggtgatgtcctggtccagtccatccagcagctgctctgtctcctgagacatggtgaacatagacccggcggagatgtcaaactgcgtcgccccggcaggcagcgcgttgaccagcagattggccaccacggcgatcaccaccacaatggccgccgccgccacactgtatccccccacccggaaggagcgggtccgcaaagatgccttccaggcgtccttgctggtttttttcccgttccactggggcagtttccccctccacgtcggcagcttcattcgctccacctcctcttctccagggactgcacggtcaggaacagaaagaccccgatcaccgtcagaaagtagaccagcgacgtcaggtcaaataccccatctacaaactgataaaaccgttcaaacagggacagcccttccaccatactgggaaacagtccggcaaagtcctctccgcccaggacagagcccaagatcaaaaggccctctaaaatacccaccaggaccagggagaccccgttgttccgggtcattagacggaaaattcctcccaccagaagaatcaaaaccgtaaaggcccaaaaagacgccatcgccgaggcggaaaagtaggacgccaaatcagaaatgaagtagttcaccagcatcaccacaaagcacagcccggcagccaccccctggctctctgtaatggaggagagaaacatgccaatggccagcagcgccgcgcccaggaagaaaaagcccaccgccgtcccgaaggccagcggcagatagaccgagccaaaggccgacaggaccaggggatacaggcagatgatccccgtgggaaccaggaaaaccaccaaaagggcggcatattttcccagtgccaccccggtcatggacagcgggagggagtagagcagctggtctgtccgctgccggcgctcctcggcaatgacccgcatggtgagaatgggcacaatgatcagaaaaataaaagacagattgctcagcacatattcaaagttcgacagccctgcgttcaaattgaccgccatggtataaatccccgcgaaaagcaggagaaaggccccgaacacataccctgtcatcccggtaaaataggacgacagctcgtggcgaaagaccgctttcatccttctgcctcctctccgtcctgccgctgcccttccccgggcagctggaccacgggggcttccgcagtcagctccaagaagatttcctccaggctggtttgggccgtggtcatccgcagcagggccttctgcgcccggctgaacgcgaagaaaatttcccggcacagggcgtcctctccatcggtctccagcaccaccccgcagcgtccccggggctcctcccgcgttgtcacctccagaatgtggtccagcggcgccagaatggcacggacctcttccgccgtggcctccgcggtcagctccacggtggtggtgccggcaaaccgtttctccaggttctccggcgtgtcacaggccaccagccgtcccttggagaggatgaggatggtctgacacaccgcctgcacctcggatagaatatggctgctgaggatcactgtgtggtctttgcccagggactggataagggcccggatttccatgatctgcttggggtccagccccaccgtgggctcatccaggatcaccacctccgggtcccccagcagggcctgggcaatgcccacccgctgctggtatcccttggagaggttcttgatgagccggttggataccgactcgatctgggtaaccgccatgacccggcgcatctgttcctccagggcgctccccgtcaggcccttggcctgtcccacaaaggcgaggtattccaaaggcgtccggtccaggtagaggggaggccgctcgggcaggtagccaatgcgccgcttggcctgggccgcatcctcaaagatatcgtatccccccaccgtgacctccccctccgtggccgccaggcagcctgtcataatgttcatggtggtggatttccccgcgccattggggccgagaaagccatagatctgtcctgtttcaatgtgaaacgacagattggacacggcggtatgggagccataccgcttggtgagatttttcacttcaatcaaaaaggttcctccttttcccgttcactgggtccggagacccgtcgcctcttacggtagcggaggaagcttaactgaacctaaaaatttccatgaacaagatgtgaaggatgtccttgacctcaccgttataccattgtataatattatcatccaagataattttgtccggaggtgatcccatgccctctcgtcacagcaagcgcctgggggaggcggagctggagatcatgcagattctttggtccgcccaggccccgctgaccgcccgccagattctccagcagctgggggaccatcgaacctgggccttgtccaccctgatgaccgccctgtcccgcttgggagaaaagggcttcgtccgctgcgaccgaagcacccgcaccaatctctacaccccaaccctctctgcccagacctaccaggcccaggagggccaatcctttctggcacggctgtacggcaattccctgcccagcctggtggccagcctctacgacagtcgtgccatcggcaaagcggagctgcaggaattaagagactacctggatcatctggaggaggatgcgcgtgcttaatctcctgttcaccagcgtgctggaactctccctctccacaggtctggtcgtggcggttttcctggccctttcccccgttttaggcaaaaccgtctggccccgctggcgctgcctgctctggactctgctggcccttcggctgctgctgccgttctccctgcccggccaggacgccccggttcacctctccctgcccacccaggcggtctccgcaccggttgtttccaccccctccgcacctgccagtgatcaaacctcctctgaggcggcagctgcggcgtctcccacctggctggacctctcggcactggcttgggccgccggcgggacgggctttctggcctggcaggggatcgcctatatccggttccggcggcgtatccttcggcggcaacaccgggaagcagacccgcagctccaagcactgttccaagacctggccatccaaatgggcctggctcgccccgtgtccctggtggtgagcgaaaatgccccctcccctataacgctgggccttctccatcctctggtcatcctgcctcccctggacgctgaccaggaaaagctaatctggattcttcgccacgagctggcccaccaggccggggggcatctgtggtgcaagcttctgctccttctggcccgggccgtccactggttcaaccccctggtccatcaaatggcccggcaggccgcccgggatttggagctggcctgcgacaatcgggtggtggcaggcgcctccccggtccagcggcgcgcctacgcccggacccttctggccgccctggaaactgcgtccgcctccactacgtccctgtccaccccatggcaaggaggaagttccatgatgaaacaacgattccacaatcttttctcccccattccccgtcggcggggacgcatgttgcccgccattgcgctggcggcggtgctgtgcctgggcgggctggtatcctgttcctccggaccccagaccacgctgccccaggaacccacagacctccaagctctgccccatctccaatacacggcccgccctggcatgctcatcaaagacgcccagctcaccacgcccttttgtctctcccccaccgacaccgcagacgcctccggtgcgcccgcagaacagatgatccccctggcggacgcgcagcccctgaaacaaggggacgttgtgctgatcgtgggcagcataggcagccactaccaagttatcctgcccgcattggacccgcctttcctggagggaaccctcccgcaatccgctgtcagcacagaccccgggcagtttgcccaggcaaacctgggaaccgtcggcgcggacacgccctgttatctcaccccagaggatacctcggctgtctccgtcttctcagacccctgcctggtatccgtgtcctcccgcgcaggcggctgggccaaagtacaggcccctggcggcggggccccggtctgggtccgctcccaggacctctcctacgatttcacctggaccggacgcaccgtggacctctcccaactgacggtttgaccgcaaaccaaaaaagctgccggagcgaagtttcgctccggcagcttttacgtctctggcttctcctcctctgcctgggccaaaagagattccagcagggccacatactgggtaaattgctcccgcccataggggagcagacgataggtggtattgggccggcggcccacgaactcctttttgctgtccaggtatccctcttcctccagctgttccagctgtttgcccaggttaccggcggtggccccggtaaggtcctggagggtccggaactttttgggcccagacagcagcgccgcaatcaccgacagccgcagacgggattgcagggcagcaggaatctgcgacagttccatggtctcaagccccctccggccgccgcttcagacggcgggccagcagaagcagcgccgcgggctggaagaaatactgcagcagccccagcgcccctatggaaagcagcacctgccgcgacgccggctggggatagcccgtcagcagaatcccgcccaaggagagaattcctcccaagacggccatccccacgcccaaccaccacagtcccctctcccgcagcaggattcctgtgattatcaggggcatccccggaaaaatcaccggcagaaaccactggaaggccatgcacaccgtcatgatgtcaaagacacccatctccatgcccaggttgggtacaaaacgaagccccgcctctaccacgccaaacagcagaaggtacagcaccaagaacagctgccaaatccccagcagctgcccgctcagagccgcaaagcccccttttctcctctgccacagcacacactgcaccagcagatagaccaccagcaccaccttggcccaggtgaggagcccatacaagctgaggggcagcgcaagaggaggaaaataatagcctataaaatccgaggtgtttacaaaaaacgccagaaccccatagagcagccacaccagccccatccgccaaaagacaggcgccagggtctgaaacgaggtggccgtctggtccagcacctgacggataagatgcaggtcctccatggccatggttcgggtggtctggttattttccatttttacctctcctttcaagattactctataaaatagagtatatgagaaaaggaattttgtcaagctttctttggccctattctctcccctcctcccctgtcagccgattcccttgggcgcatttcctgaaattttttcaaaaaggcctctgccgcctgggaaaagaccgggtcctttttccaaaccagattgagacggctctccagcttcggcgtcagtggccggaaacaaagctctgtcccggcggtgttcaccagcttgtccagggccagggcacagccaacgccctcttccaccatacgtgccgcattatagataaggttgtaggtgcccacctgcctcaggcaccggacactctggcccagccacccggagaaagtgttgtccaccatccgctggcgggacaccagcaggggaacccccagcaggtcccccgggcaaatgacctgcttccgggccaggggatggtcccggcgcatcagaagcccccaggtatccgcagcgggcagctgaatataatcgtaccgctccaggctgaccggttcaatcagaatgccaaagtccagcagtcccttgtccagccgctccgtgacatcctcggcgttgccgctgtacaggtgatagcgaatgttagggtgttcccgggtcaaggcccgggcggcccgggcaaccagacgcatggcgtctgtctccccgccgccgatggcgatctctccgctgatctccttctggggcgcctgaaaggaacgcaacgtcttgtctgccagggccacaatctcctccgcctgccggtgcagacgtttgcccgcctctgtcagggcaacccgccggttcttcctcccccggtcaaagagctttgcccccaattcctcctccaactccatcagctgccgggacaaagtcggctgggtgatgtgaagctcttccgcagcagcggaaatgctctgcatgcgggccaccgccaaaaaatagcgcagaacccgtagttccacaggcttgtcctcctctctgttctgggtcagcgtatcacctttttccatgcttatcaagcatatcttactattttttatgggtatttgctattttttcttccctctgctatcctactgacaaaccaccagaaaggaacctatccatggatttaccagcgtttttagatcatctcaaccggggtctccccgtggagggaggctctcccgttcatcagttcatgcaccagctcagccaggaggccctggccatcaccggcatgctgaacactgggtaccatcctcccgaggagatccgcgccctgttctcccagctcatcggcaaaccggtggacgaaagcttcaccttgttccccccttttaccaccgactgcgggaagaacctctcccttgggaaagaggtctttctcaacgccggctgtcggttccaggaccaagggggcattaccatcggcaacggcgtcctcatcggacataacgtggtgctgtccaccctgaatcacgaccccgcgcccgcccggcgcgcctggctccacccagctcccatcgtcatcggtgatcgggtctggatcggctccaacgccacggtgctccctggggtcaccatcggtgacggtgccattgtagccgccggcgccgttgtcaccaaggacgtcgcccccaacaccgtggtggccggggtccccgcccgtctgctgcgtccgctgacagaggaggaactccaatgaaaaaacgcgtgctgattctctctaccagcccccgccagggcggcaactccgatgccttggcggcgtcttttgccgaaggggcccgctctgccgggcatacggtaagccactgttctcttcgggacaaatcccttcacttctgcctgggctgcctctcctgtcaagagacgccaggctgtgttctccaggatgatatggcagaaattctatcgcaaatgcgtaccgccgatgtgctggtctttgccacccccatctatttctacgaaatgtctggacagatgaaaacccttctggaccggaccaatcctcttttttctggagaatacgccttccgggcagtttatcttttggccgcagctgcagaggcagctccccaggctgtggatggtgcgctccacggtctggagggctggcttgcctgttttcccaaggccaccctgcaaggggttgtctgcggctgcggcgtcaccggggctggagagatacaggattctcccgccctgtcccaggcccgcgccatgggggccgctctatgagatgggcgttcttcctggcggccctgttcctctgtctgtccggctgcagcgggccggctgcacatgcggaactgccagaaacatttccaaccatggagggctctcctatgcctaccctatgcctcgccgtccacggcgcagagtatcctgtcaccctgcgggacagcccaagtacacgcgccttggtccgccagctgcccatgacccttacactggcggaactcaatggaaacgagaaatacgcccgcctgccggaggcactccccactgacgccatacaacctggcgcccttcagaccggagacctcatgctctacggcgcaaactgccttgttttattctaccaaagtttcccctcttcctattcctatactccgctgggacaaatagagcatccagatggactggcttccgttttaggcgctggctctgttactgtaaccctttccattctgccataaaggtcccccgccccctggcaaaggccagggggcgggggattttacagctgatccaaatacgccgtcacgggaaaatcccggaccttttcctcttttcgcagatacagcgggtggtgaggatgccccttcttggaacacttccccgcgcaaagccaccgggcgccgtattcctccccgatggcgaccatgtcccggacacagtcccggagataggggcgtttttctatgatggtgccccaagccgcccaaaccgcaggggtaaaacccgcccccacctgggagaggacataccgaaacgccgtcatattctcccggtggagggcctggttgcattgggcatccatgtcctccggtcgggtggctcgctgggcatagacattgaacatcaaaaagctgtcgtagccgttgcccgccgcgatccgttccaccgatttcagcgtattgtccaggtcccccggcaccgcggtggaggggttgatcccgatacagatcaggggattctctccccgggtccccagcaggtaccggtactccgcgtagtgatcgggaatatacaaccacttctcccggtcaaaatcccattgggtcgggaccagggcctgctcaaaggtcaaaatctccagttcctgggtctggcaagtgggaatatgcatctcacgtccccctttgtttccgtttttttccgcatgttttttgtatcttaccacaaaggccccgctgtgtcgagggtttgcgtctccgccccctcttgtatttgttccggcggcaagctataatgaaaaaacaaagtacagggacccatcccacagcgatgtcccccgccccggccaaacgccgccggtggccggcagtacgccccctttctcccggagggaattgccatgctccacacagccccatccattctgtgcgtcaccgaccgcaccttatgtcctgaacactttctgtcacagatttcccgcatcgccgcggcaggtcctgccggggtgatcctgcgggaaaaggatctgtgtgaatccgcctatcggtctctggctgcccaggttctctccctctgccggcaacatcaggtcccctgcatcctccacaccttcccctccgccgcccgggccctgggggccacggcccttcaccttcccctgccccttctgcgcgccatgcccaaggaggaacgcgctgccttctcctccctgggtacctcctgccattccattgcggaggccttggaggcccaggcactgggggccacctatcttctggccggacatatttttgacaccagctgcaagccgggcctgcccgggcggggattggatttcctggcccaggtctgcgccgctgtccccctgcctgtttacgccattggcggcatcacggcggaaactctccccggggtacgccgggccggggcccggggcgcctgttttcggagcggctttatgacctgtcccgaccccgcatcctacctgcacacattggaaaggagcttttcccatgccatttcaccctgatcagcttctcctttacgctgtcaccgaccgggcctggaccgggcggcaaaccctgttggaacagctggaggccgccctccagggcggtgtcaccctggtccagctccgggaaaaagacctggacccagccgccttcctggcagaggccctggaagtcaaggccctgtgccgccggtatcacgtccccctgatcctcaacgaccaggtggacctggccctggcctgcggggcagatggcgtccacgtgggcagtgaggacctgcctgtggcgcatatccgccggcgggcgggcccggactttatcattggggccacggccaaaaccgtccagcaggcccaggccgcccaggccgccggggccaactacctgggggtgggggccgttttcccctcccccaccaagcccggcgcccagcgccttacgccagaggagctggggggcatctgcgcctcggtctccatccccgcggtggccatcggcggcatcggcccaagcaacctggcccagttaaaggggtccggcgcggcgggcatcgccgtggtctccagcctctttggggcagaggatatccaggccgccgcccaggccctggcccgccaggcccggcaagttttgttcccccatcccattccttagtccctccctcacagcctgcggcctctgtgccgccgggttttgatctctgtaccaacgcagcaaaggagacacctccatgaaaacagcattgtcgatcgccggcagtgattccagcggcggcgccggcatccaggcggatctgaaaaccatgaccatgaacggggtctacgccatgagcgccatcaccgccctgaccgcccaaaacaccaccggggtgtcggccattctggacgtcaccccccattttttacagcagcaaattgacgcggtgttcactgacattcccccggacgcggtgaagatcggtatggtctcctccgcccctctcatccagaccatcgcccgctgccttcggacctatcaggcggccaacatcgtagtggaccctgtgatggtcgccaccagtggggcccgtctcctggatgaggacgcggtggaaaccttgacccagaccttgctccccctggcagaccttctcacccccaacctgcctgaggcggaggttctgtccgggtgctccattcagacagaagccgacatggtaactgccgcccggcggatcagccagacctatcactgcgccgtgctgtgcaaaggcgggcacagtgtcaacgacgccaatgacctgctctacgccgacggcaccctccagtggtttcggggccgccggatcgccaactccaacacccacggcaccggctgtaccctctccagcgccatcgcggccaacctggccaaagggttttccctgccccaggcggtacagcgggccaaggactacgtctcccaggccctggccgctatgctggacctgggacagggttccggtcccctgcaccacggttttgccctctccggcacatgggcccaggaggctccgccgcctgtccgttaacccgtttccccctttgtttctttccgttgcttgccgcaacggggcaaattcactatgctgagagaagaaatacaaggaggcttctgtctatgttccaagaaaatctcaaaaactaccggaaggccaagggcctaacccaggaagatctggccgtccgtctgcatgtggtccggcagaccatttccaagtgggagaagggcctgtccgtcccggacgccgccctgctggtccgcctgtccgaggtattggaggtccccgtcagccagctgctgggcgcccccctgccgccggagtcctccacggatcaggtggccgaacaactggcccggatcaacgagcagctggcccaaaagaaccgccgggccaggcggatttggcaggtggtggtgggcatcctgttggccttcgtccttctatgggggattctttgcctgctctcctaccactcctatacccagtacgtctccccaccaaaaattcaggtggagccgctctcctccattccggtagaaagaaggtgctccgatgcagtggcttgaactctcctttcaggaccgctcccccgcgtggatcgcccggctggaggccctctggaccgccactgtccaggctgaccacagtgccctcccccgccacaccgtacaggacctggccgccggggtggtccaggtcctccgcaccgtggcccatctgacggtggccttggatgacaccggcgccccggtgggcgttctgggcgtcagcggccatagcctggagctgttttttcttccccctgaccagcagggcacggggctgggaagccgcctgtttcagcatgccatggccaagcactacctcgcccagatcactgtctgggaggccaacactcgggcactgggctttttcctgcggcgcagctaccggatccaccaccgcacccccgctgatccccaggggtaccccttccccaccctatacctcaccctctcctgctattgagaaacccgcagcctgtgttctctacaacacaggctgcgggtcattttctccccggcaccgggcgtacatcttcatatccagtactcgtccgtccttgactgcgttctgccgcaagaccccctccagctggaatcccgctttctccagcacccggcaggaggcgtggttctctgcgaagggttccgcaaagattcgcagcaggtctgtccgggcaaagacccattgaaccgcctcccgcaccgcccaggtgccgattccctgaccccagtggtccggccccagataataccccagttccgccgtgcggcggtggatatttccctgccggaacatgcccaaactgcccacgggaatatcctcctgggcaatggcaaaggcaaacacctcttccgggtccgatgccagcgtctccgccagaaaggcccgggcatccgcctccgtatagggatagggcaaaccatcccggagcatgcgccgcacccgtccatcctggagcaacgcggccagggccccggcgtcagacatccgccagggacgcagcgtccatgtcatgctgtcatacctcctccttctccgcccgggccaaaaccgccagaaaggccgcgccatacttccgggccttgacctcgcccacaccggacactgacaggaattcctccatggtctgcggccggcggcgggccatgtccgccaacgtggcattggaaaaaatcacgtacaaagggacctcctcctgccgggccagctggagccgggtggccttcagcgccgccatcagttcctggtcctccggctgctgtcccgaccgctccagtccctcttccctgggacggaacaccgccggcgccgcccgctgagttaagaataccttgctcccccggaaaaggacctcccccgcctggggagtgggccggagggtcttgtgaacaggctctgtaaccagataccccgcctcctccagcgcctccagatagcggcgtgtcaaggcctccgaggtgtcccgcagcaggccataggtggtcagcccatccaatcccagcgtgagcacccgctggctccggctcccccggagcactttgctcagcaggtccgcgcccacatagtaccccagctttccctggacccgcttgacgcaggagaggatcatctgcgcctgccgggtgatgtccacctggacaaattggctccggcagtttccacagttgccgcaggtgggatcgtgggcctggccaaaatagtccagaaggtgccctcggaggcagtgggtggtcttgcagtagttcaccatggcctccaggcgccgggcgtcccgcgcctgaacctccgcccgttcctctggggagaggtcctcgttctctcccgcctgttgcaggaaaaactgggcagtggccacatcccccggcccgtagaggaggatgcactccgccgcctccccgtcccggcccgcccggccggcctcctgataataggcctctaaactcttgggcatgttgtaatggataacaaagctcacattggatttgtcgatgcccatgccaaaggcgttggtggccaccatcactgtcttgcggtcaaactgaaaatcgtcctgattccgctgccgttcctcctctgacagccccgcgtggtaacgggtggcggggatgccccgctggcacagcagatcacagatcttctccaccccagaccgggtggcacagtagacaatgccgctccggtcccgccgcgcctccaccagggcggtgaggaccggctgcttccgcttgggctgctgcaccgcaaaatagaggttgggccggttaaagcccgtcaccaccttcaccgggtcccgcagctccagctgggtcagaatgtccgcctggacctccgccgtggcggtggcggtaaaggccgacagcacaggccgccggggcagccgggccacaaactccgtgatcttccgatagctgggccggaaatcctggccccactgggagatgcagtgggcctcgtccaccgccacctgggcaatcttctgctcctgcatcagcgccagaaacccctcctggagcagccgctccggggcgacgtaaatcagtttgtgcatcccctgccgaatctcccggcaaaccgcctggaatgcctgggcatccaaggcactgttcaggaaagccgcgggaatccccacgccgttgagggccgccacctgatccttcatcagggagatcagcggggacaccaccagggtcagccccggcagcagcagtgccgggacctgatagcacagggacttgccgccgccggtgggcatgatccccagggcgtcccggcccgccaggatgccgtcaatcagggcctcctggcccggccgaaagctgctgtgcccaaaatactgccgaagaacctcgcgctttgccatggtgcccctcctttcctctgtacttctgtcagcaatcccactggtcccgggccaaatccacacaacctctctggttcaggaagaccccctccgccgcgagcagggccgcctgctccggccagccgggggccaggcggcctgcgtggtttaccacccggtgacagggatagctcccatactgctcggccccccggagaatccgccccaccaggcgggcgttcctgggccggccgatgagccgggcaatctgcccataggtggccactttccccgccggaatctcctccaccacagagagcacctcataggccagcgtttcctgcagcatgaacccaccttctctccggcctgttggcctgtttctctggattacaggaatagtataccaaacattgcccggcatggacagccccattttccgctccctaaagcacaataggaacctgccccgaaacagggcaggttcctattgtgtttggggattcagccgccgctgccctccgcctcaatgggttccaccaccgacgcaaagagggccgtgagctttgccatcccctccgccgggggctgctgagaggcccgggcaaaaatgtcgtacttggccgactgatctgtggttcgggtattctcatgggacgtggtcaccttcccggtcacgctggagctgaacccccaagcagagaattttgccattgtgtccagggaggaggcgctgccgctcttgtcggttttgatgtctttgacctccatggtaaactgcaccgtggcctcgtccatggtaaacgccggcacaggcaccagggacagcagcggggcctccacctccagttccactgtcttggtgtcgccctcaggggtcacgatctggcggggcagcttaaattttacgctgttaatccccttttccgggtcgccctcccgaaacgccagttcaaataagtagtccaaatacaccctgcacagctcagactgtccctgggccaccgcgatgatcggcccgcagatcagctgccccatagggagcgtggcaaaacttctcccaaactcttctgccatggtcaatatctccttttcttataatgatttgttcatctcggtggtgacccgcgcggttccttccggcgggtcatcacagcgaaaacacagctccatttccgtcagcagcgggggttctccgctggctctccccggcggggagaaatccagcagcagtttctcctcctcgtccaccgcggccgccgcacacagcttaatgcggacgctgtccagacccacggcgttgtggtgggccagggtcaccaagggcaccgcaacccgtgccccctcctctccgccggtggatggggggaacaggatcgaggtcgtgttgggtgtatagcccgcgcccccgtcctggtcggcgggcccgcgccggaagtaggccagatagtttccaatcgcgtgggccgccaccgcccgctgtgcctccgagaccgcctgccccagggccgtgaccaggcggccgaactcaacctgcatcgctctgcctcctttttacgccaggacacacacccggctgtcgggaatctggtatttctccaccagggcctgcaaatcgcagcccacctccacaatctggtggcggctggcgtttcggatgggggaccacaccgcgtaccggcccaccacggtgtccacgccgttgatctcagcgtgccgctcctcacccaggtcggtgataaacgtcttgccgcccatcattgcttcccattgttccatggttctgcctcctatcgggaaaattgaatccagtgtgcctgcccgccccctgagaccacgcccctgtcctgcacatgggggaggtgggccgacaaactctggtaccacctgaccgcctcctccagctttgcctgggcagacatgccctccacccggggctttgggcgggccagatacgccgccgccccaggccgtcccaggttggcagggcgcctccccgggcgcaccagaaccggctggggacgacgggccctctgccccgcttggacctgccgctggattctgtccagggaaaagggaaacacacaccaggcgctgtcaaggtcctccatggagaccgggccatagatgccaacctccgcattgccccgccctgtccagtccatggccagaagggtctccagcgtctgccgctgctttgtctgggagaagggggtcccgttgatgttccccatgccgtcccggtcactgacatacccgcctctgctggcggtccatatcctgggccggaacagcatccgcgccttgtactccatccgggaggagcccacgctgccaaaggccatgcgaatgggcgtctctccccgtttcatcacccggaaatacacgtagcacgcgcccggcttgtttcggtcccgcacgctggcatccaccatactgccgatgggccgaagatgcccgtcgcccagggctttgagcagtacgctgcaatgctccccttccacaaaccccgccacgctgtctggaagcagacagttctccacgccgctcccacactgcgacatcagccgccgaaaggccccgggggttcgttccgtggtgctgcgccaggcctcttcctgcgccgggcattctgtctgtggcatcccgcatccctccttccccttaccctatgcggcagggtcacgggatcatgcccacaaaaaaaggaacagacgaggggttctcgtctgttccttttggctgtgttgtccgggaaggggacgcagcggttatcccgccacgtcgccgggattctcggaggagttggcgtccgaccactccttttccagggcctcccagtcccgaatgggcaggatcttggtccacacctcatactcgttgccctgggcgtccttcttcatctggtactcgtgggagttggtggcctcctgcatgtcggcatagtaccacgcctcggtgtccaggttgtccggccagaccagcatgtccttcaggaaatggtccgggtcggggtgccggtccagggtgcggttgaccatggtcaccgcctcggcccgggtgatctgcttctgggggccgaaggtcccgtcgggatagccctcgatgatccccgcgtccgcggcctggttgatgtagtcctgggcccagtggccgtcaatgtccgggaagaggtcctcgccctggtagctcaggtcgaagaaccgcaccgcgatggtggcaaactccgcccgggtgatatacccgttggggtggaagctgccgtcctcatagccgtccaggatgcccgcgttggccatggtggagatggcgttgttgtaccaggcgtccgccgccacgtcggtgaagctgttgctctggctccagtacgcgttccggctctcgtcggtgagcatccggaagaagatggtggccacctcggcccgggtgatcttcccctggggcttcacgggctttctggcctggtcgtcggtgggctcacctgtctcatagtccacgggatagcccacgatgtagccgtagtggtcctcggtgttcaggctgggcttgttgccgccgcctcctccgccgccgctgctgttggaaacctcgtcccaaaccagcacaaagggagagaactcctgcgtcgcaaacttcagatactgttccccgtccagggtgacgatctccagcccgccattggaggtagtgtacgcctctacttcgtacccctcctggccaatcaggtctgctgtatcaccgtcatactgccggtccagcccggtgaaatggacaagcttaaagtcatcgttgctgtcagagcccttgggcagtttccagtagacatccaccagccgatccgcggtgacccaggcccggccgttggtctcatccaccaggtccaaatactgatagatgtagtggtcgtcggtctccgcctggtcattcttcaccagatagttcttcagaatctgctggctttcattggccgcatcgccttctgcggtatccccctgggacagctcatccaccagcaggtgaacattctctgcctccactgtgacatgggagtcgttgatcacgtactgggtgtccgcatccgcaaccgctgtgatggtacaacccgttgtctcatcaatggtttttgtgtttttcgtcacgtcatcggttgtggtggcaaccttcgttgtcacctccccattggtggtgccgcggactgtgagggtcccattgcccaccttaacgggtaaggtttccgtatcatcctcaccgtttaacttaacttgtgcttccaccaaatcctgctccagcaggccgggatagatggtcatgtcatactgctgatacagcgtccccaggtccagcgtgaagtcatcgctgagtgtgggaatgccaccttcttcacccttgggggtaaactgcactctgaccgggattttctccccgccaactaccgccgggttcatacggtaaacataacggttccgtgttacgtctccaaccgtcgtctcctcgtagctggtgccgtcctcgtcatcgtagtacagagcaagggaccactctcgcgtctgctcctcatccgcatacgtgaaagttaaaatcttagacagatcggttgctccctcctgggtgggatcctcttggatattcagttggtcgttgagccaatcgggcagcgtgatatagtagccaggctcaggcaggccgttgctctgctcacccgtttcctcatcctctcccgcccgggctgctccagattggttgccaaccacactctcgtacccagtgccgccggtgtacacaatgatgtccgcgggggtgatgataatggaccgctcgctctcgtcaatttcggtggattccgtgttggtgctcaccgtcgggccgtcctcgccaatctggaccgaagcagtgttttccacggtggtttccgcgccggagactactttaacggtcatagtgacctcaccggtggcgcctggttgcacctcgttcagcgtccaggtcactatacccgattcttcgtctaatgcaccgccattgtccgccgatacaaattctgttcccgtgggaaccttgtccgtgatggtcaccgttgacgctgtgtcctcggtgttcttgtaggagatggtgtaggtcagctggtcgcccactttgaggccggtttgcggcacttccgtggtggcatctccgtccttcggctgatactttgtgatagacttttcggggacgtaggtctctgtcgtcgtggtttgttttggatcattgttccccaccttgacatctgcctgattaacaatcgtgttgttttcgtcgtccttcaccgccgcttctgtcaccttcacccggaaggaaacttcgccggtggcgttggcggcggcattgtcgattgtccaggtcagggttttggcagtgtcgtcatagttcgcgcccccatctgccacacactcggttccctcgggaatggtatccgtcacaatcaccgtagccgctgtcgcgttcccattcttatccaccgcgtcgttgacccactggatggtataggtcaggatgtcgcccacgccggccactttgccgtcggggtcaatcccgtcagggtcctctgttgtgcctgttgtgaccgacttggtgtttcctttttccgcaacggtgttggtgaattggagcgttgtcgcgccgacttcggatactgcgtctcccttgtcattggttgtctgtgtcacggtaacttccggcttagctaaggttccatcctcgttctcatccacctgcaccgtcaccgtgtactttgcctgagagtacgtaacaccttcgatagcaccttcgccgggtttcatctccgtaacggtaaaggtatactttcccgtctcatagaaggtgatgtccccaaacgaacccgtcttggtgttgctgatgacgctgttccccgcctggatggtcttagactctggaatcgttgtcaccattgcatcccccaaggcgttctcaagcttcactatcccatcctcaagcgccttgctcgtatcatcatctcctgccgcaagctggaaagcaaactgatccgtcggcagccagccgcgcccggtgagggtcttgttcacggtgagcgccgtgcttccgtctccacccaaggtagcttccttcttgacgttgcggaaggtcagggatgcattcttttcagttactgtcccatcaccagcatccacagacacgattgcattcaggcccttgtcctcatcataggtcaccgtgactgtgacaaccttttcttcctcgtcatagaccatgccgggttctttgtcttccgggacaacttcctggaagtaatacttgtaggttcctgcatcctgcacatcgtaagtaatggtgccgaagaaaatattgctcgggtcactctctatagaaccgttggtcaccgtccctccgatttccaaatctccaggcagaggaatgtctccaacatcattctgatcttgaatgacctctccattgtctttctttaccccggtcagttgaaactggaaatctttcgcttcaaggatttcccctttcagctctttgctcccggaaatacgaactgtctgtttgcttgtatcatactgattggtaaataagagtttatttatattgtattcagtatagtcgctactcttatccccttgctgtacctgatacgtcacttccggcacaagcgtaccattttgaactgtcacctgaacatttacgatgtaaaccttcgtgtcactgctcatacccggaatatccgaatgtccctctcgaatgctatactgataggtacccggttgtttataaataatattcccgaaggaggcagtatgaccttcagtactattgctgatggttataatttcctcgtcaggcattggcactcccgtatctgcagagatgctaaaggtaaaggaatcgtcctctccccaggtataggtttcaccctctgcttggatttccttttttactgtcagataggtttctcctggaaggatgagaggtccaacgctatatttattggtaaattcagcgttgttcccttccccggaaatagttccattgatggattcttgctctgcctcaaaccccgtcgggatttctgtctctgtcacggtataggtcgttcccacaggaagtcccgtaatggtggcagtttctcccgcctttagtgttatcgttgcaccgtcggtaacgttgccgttcccagtctccgatcccgatacagtgtaggggaactcacctttaagaacatcctttccgttaaaatcaaccgtaaaggtaaattcttgatcgctatccgcctccagtccactctctgccgtgaccgttttggaaatagccaaactccccgttgccaccgggtcaatcaacgtgccgtcagtaatctccttcgcagtcacctcgccgtacgacactgtaacgtcaatcggctttactgctacgtacccccccggtactttagtttccgccaaagtatagacatggccggacgggatatctgtaaaggagattttgccgctcttatcagatgtagcttcccgcttccaattcccattgtcctgacaggtcagcgtaaattgggctccttcaagtatttttccgtccgatccctttttggtgaaaatcagatctccggcaaagcccttcaccataggaactaaaagttctgtcttatataattggggttgaagttccccatcctctgtcaacatataagtcagaaccgtatttccattagttgcatactggttttccttggaaaacccgctttttagcgtgtctaatgtaacagaatacgttaatttataagtataccaaccatcgactggccctgttcttgaggtatcgtttctcagattccaaaccaacgtattcgtacttgtattgaacgctacagtgtagtccccttcctcacctttttccgtaacacgtggaatctccgtattatccccaaaatcaatatactctcccatcggatcagttaaaatccaggcttgggcctgattaacaataatctccgcaatattttccagtccttcaaaaatatcatcgccagccttgatcagttgagtagaaaatgcggaaagccagcttccgatatccatactgcctactgtaccccaattgtttttataaaatactgtatatagttttgctttctttttaattgacttggggacagtatcacctttttctggctggtagggatcataaatgtcgcaataatcgttatccgttgcccaattacctcctcctctcttcccatacataatatcaatgctgtccgtttcttcatcttcttctacatgatatgtaggtacgccatccgtcataagaacaacatatttgttttttatatttgtgacttgatcattacttagcaaattgtctgccaaacgaaggccaccttcaatgtttgttcctcctgaatctttttcccattttccccagtatgaaaaaccattttcaaccgctgtaataccattctcaattttatttttcccctgtgaactatttgcttccgtccaacctaccaccgtcttcgcattgcttccgaattcaacaatggcaacctttcgttgggcattttcgcttgcgtcatcggttagtttctctacaaaattccttgccgcttcttttacactttgaatatctttcttatccatgctattagacacgtctaagaccaggacaactgcggcatcttcagaaaccacttgttcttcaatggtttctttcgtctgaacagtcaacgtaatatcaaacgtattttcatcggtttgttctattcttttagaatgcttaactttcttatctttggttgttttttcttctccctgcttcgcaatctgattcgcagcttcctggtctccaccgccatcgcccggcgccgccatcgcgctcataggcagaatggagagggccatggacaagaccatcagcatggccaataatcgtttcttcatattttttgtctcctcctctggttgcattgcttcggcttccacccccgggaagcccgctgttgatttactccggcgctttctccgccccgcccggaacaaggggaacctggtaccgccccagattcttctggctgaccttcccggcacacaccggacagccgcagcgtttgtcgctggtgcgggagtagaccacggctttccacacgtggttctccgggcaccgccaccacaccttcttgtggcttcccggggtgaccatggccggggtcaaggctccgttcaggacagggtcccacgtctgggccagctcggggtaccgggtcgccaggtcgttgaaccccgccaggaccttccgcccggcgcagtaggggcagtcgctcccccaggcccgggtgctgatggccgcgtgccagctgtgccccaggccgcaccgccaccagacggcgcggttgctatacggtgaaacctgctggggggtcaaggccccgttcctctcctggtcccattgccgggccagctggggaaacactgtggccaggtcgttttcccccggcagcaccgtcctgcccgtgcacaccgggcaatcggcgccctggctccgggagaacaccgccgcctgccatgtgtgcccttggggacactgccaccacacccgccgccggctgccgggggccaccgccgccggggtcagccccccatttttggtggggtgccattgccgggccagagcgggatacagggtggccaaatcattttccccgggactgatccgccggccggtacaataggggcagccggcgcccgccgcccgggacttcaccgacgcggcccagacgtgcccactgccgcactgccaccacacccgccgggtgctcccacagaccacctggtccggggtgagcgggccgttcctctccgggtgccactgggcggccagcgccggctcctgggaggccaggtcattaaatcccggccagggccgcttccccgcgcagtacgggcagccgctctccgctcccgtccgggtgtagaccgccgcctgccaccggtgccccgccccgcagcgccaccaaaccttctggcggctgccatgggaaagggccaacggcgtcagtgccccgttgccttccacatcccactcttccagcagtgcttgccggcgggttcgtgtgcagtagtcatacaagctctctcgcatcctccaccccctttgtgggcgcttccccacagacgcactaccacaaaattctga

SEQ ID NO: 2240 - DNA, 23235 bp, KLE1738
cgtccacaaaggacagataggttccccgggcctgagccatgcccaggttccgggccgagctcaccccgccgttctccttgtggaaaacccgtacccggctgtcctccccggcaatctggtcgcagagcgcgccgcttccgtctggggagccatcgtcgatcagcaagacctccagctcccccatcgtctgtgccaggatggattctgtgcacttacgcagaaatgcctcggcacgataaacgggtacaatcaccgaaatttccggcatacacgcccctccttttcggtcatatccttccggcgccaccctgggggccggcccggcaggccatggaatccatgccggccgaaccccttcgggcatgctccggttttgttactggcaggcggccttcagctgctctgcccggtcggttttctcccacaggacccccaggtcctcccggcccatgtggccataggcggccagctgccggtaaatgggcttttggagccccagatcccggatgatggctgtgggccggagatcaaaggtcttccggaccgccttctccagcacctcatccgccacggtgccggtgccgaaggtctccaccaggatggaaaccggctgggccacaccgatggcgtaggccagctgaatctggcaccgcttggccagcccggcggccaccacggttttggccacccaccgggcggcgtaggccgcggagcggtccaccttggtggggtcctttccggagaacgcgccgccgccgtggggggcggacccgccgtaagtatccacaatgatcttccgtccggtgagacccgtgtccccctggggcccgccgatgacaaagcgcccggtggggttgacatagatcttcgtgttctcgtccattaagtgggccggcaccgtgggccggatcacccgttcaatcatatccttgcggatctgatccagctctgccttggggctgtgctgggtggacagaaccaccgtatccacccggaccggctggttgttctcatcgtactccaccgtcacctgggttttgccgtcgggacggaggtaatccacctgcccctccttgcggacctgggtgaggcgctgggccattttatgggccagggaaatggccaggggcatgcactccggggtctcgtcacaggcgtagccaaacatcatgccctgatcccccgcgccgttgtccagctggctgtcgccctcggccttggcctccagcgactggtccacccccagggcgatgtcggcactctgctcgtcgatgttggtgatgatgccgcaggtgtcacagtcaaagccatacttggcccggtcatagccgatctcccggatcacctgccgggcaatcttaggaatgtccacatagcagctggtgctgatctcccccataatgtggatgagacccgtggacgccgtggtctcacaggccacccggcccgtggggtcctgggccaggatggcgtccagcaccgcgtcggagatctggtcgcaaattttgtcgggatgtccttctgttacggactcggatgtaaaaaatctgtggctcattgggaaagagtcctccttcatataaataatctatctttcattccgtgtttctcaatcgagttactggcacgggttgatctgatccaaacccgtcttggcgggaagaggtccgccctcactccaccgaccagctgctcaggtaagcctcctgttccggggtcagcgcgtcaatggacagaccctgggcggccagtttggcccggccaatggcgtcgtcaatggtgtccgggaccgggtagaccttcttctccagaccggtctgtttggtcagccactccgctgccaaggcctggaccgcgaaggacatatccatgatctccgcgggatgtccgtttccggcggccagatttaccaggcggccctccgccaacacattcagggtatgcccgttggatagggtatagcccacaatgttctcccggcgcacctcagactgtaccgccatctcccgcagggcagccaccgccacctcgcagtcaaaatggccagcgttggccaagagcacattgttcttcatggccgcaaagtgacggcccacaatcacgtcccgacagccagtcactgtgacaaagacatcccccagaggggcagcctggtccatggtcatcacctggaagccgttcatggtggcatcaagggccttgaatgggtcaatctctgtgacaatcactcgggcacccataccggctgcccgcatagccacacccttcccacaccagccgtaaccggccaccactacagtcttacccgccaccaccaggttggtagtgtgcataatgccatcccaggctgactgcccggtaccgtatttgttatcatagtaatgcttagccttggcgtcgttaactgctaccatagggcagggcaggatgccttctttttcccgggccttcaggcgaagaataccggtggtggtttcctcacagccgccgatcaggcagtctgcatacgcctggcacttgccccccagtagatcgattagatctccaccatcatcaatgacaatgtgaggatggcacttcagggtctccgtaaggtgccgctggtactcctccgggctggccccgtggatgccaaaggtctccacccccatggacgccaggccggcggccacgtcatcctgggtggacagggggttggaaccggtcaaatagacttccgcgcccccctgctggagcacatagcccaggttggcggtctttgcctccagatggaccgacaccgccacacggagcccctgaaagggtttctcccgcagaaaccgggcctcaatctgagacagcgcgggcataaagtcccggacccattgaatctttttccggccggcttccgccagcgcgggatctttaacaatgctcatcttcttccgctcctttcttcacattctatgtgaaaatataggcgctgaccggccgcccacaaaaaaaggcttccgtcaggaagccttggtcgctggacgcggcgcctccttatcgctgttagcagaaccaccttgcccgcaggcaggttggtgtgaggtcatcaagctaactctctcgcccactctcgataatgcgctcctattcaattcacgcgaaaaacatttacgctatattatacaccatccgccggaaaaggcaagaaaaatttttcaggatgcggacaatttgaaaagagaggcaattgtttacagtttattgtagacttcccgccggaaagcgggtagaataaggtagacaatctatcccatttcacaaggaggtcatttctttgcgcgccatgcaacagtggctggaccgtttctgctacaagcacccccgtctgagcatcccgggtctcatgcggtatatcgtcatcggcaatgtgctggtttttctgctggacctgttcagcaccggcggctatcccattgccaccagcctgctcagtttcagttctgatgcgatcttacaggggcaaatctggcggatcattacctttgtctttgtccccgccaccagccgaaacattttcctgtttgccatcaccctctacttctactacttcatcggcaacgccctggagcgggagtggggttccaacaagttcaccattttctatttcttcggcattctgctgaacattctggtgggctttctggtgggcaccgcgtccatgtactatgtcaatatgtccatgttcttcgcctttgccaccctctatcccaacttgcagttcctgctcttcttcatcatcccggtcaaggccaagtggctggcctggattgacgcggcctactttgccctggcggtcctccagtatctgctgacggggcacttcctgtacgcgctgattcccattgtggctgtgctcaactaccttctgttcttcgccgcggacatcggcagccagttctcctactggaaaggccgggccaagaaccgggcaaggcagaaccagtaccggcaggcctacaaccatcccggcagcggccccaaggtggtcaacttccacgacgccaaaaccaagaccaaaacccaatacctgcacaagtgcgccgtgtgcggcaagaccgacctgaccgacccgcaaatggagttccgctactgctcccggtgcaacggctactactgctactgcgccgaccacatcaacaaccatattcacatccaatgagagcccgaacgggctcctctccaggaggcgatattctatgaccgatcaggctctggtggagctggccttcaccatgctggaaaaatcctatgttccttactcccgcttccccgtgggcgccgcgctggaggggacggacgggaccgtatataccggctgcaatgtggaaaacgccgcttacggctccaccctctgcgccgagcgcaccgccctggtcaaggccgtcagtgagggctgccggtcctttacccgtctggcagtggtgggcaacagcgccgattactgctggccctgcggcgcctgccggcagatgctctatgagtttgcccccgacctggaggtgctggtggcccggcaggatcacacctttgtcaaatacaccctgcgccagcttctcccccagggcttcgggccggactccctggcctgaccccgtccctataacgacgcccccgccccggcggagacgccgctccgcccccgcgtctcaaaggaggtatcctgatggatctgcaagaatatctggcccgtatgaattccggcgaacccgtggagggcggcggcgagatgcaccgctttatgcgggaaatcaatgaggtcaccatgcgcctgacctgtgagctcaacgccaagtaccacaccggggaggaaatccgggagattttctccaaaatcattggcaagcccgtggataagagcttccgcctctttccccccttctacaccaactgcggcaagaacaccacggtgggcaaaggggtctttatcaacaccggctgccacttccaggaccagggcggcatcaccctgggtgacggtacctttttgggcaacaacgtggtgctgaccaccatgaaccacgactttgacccagagaagcgctccaccacctaccccgcccccatcgtcaccgggaagaacgtctggatcggctccagcgttacggtggttccgggggtacatatcggggacggcgccatcatcggggccgggtccgtggtcaccaaggacatccccccctacaccatcgcggcaggcgtccccgcccgggtgattcggaagattgaccccaaaacggatcattacccctccacctataaaaatcgaaaaaaataaggcctctctaaacagggagacggcgggtttgccaccctgccgtctccctgtttgcatcattctgcctgtgcagattgcttctcactggcttgccccgcctcgtcgttcatgttttggttctgctccagaagcgccaaaatgcgccggagcaaggaaatacaccaaacccccgtaatggcaatggccataacgatcatcattgcccctacaagatagagctcgacgaaaaaggccagtatcatcgtccaaaagcaggataccaaaacaatccaaaaggttgaccagttaaatttcaccatatcatctcacctctccatacgtgcaagacacaaatgcttctctctttcctctctttgcgtatgtacagtttaccataatttctcattctctgtcaaacttatttgtatagtttgttttttcttttgcgcgagaacagaaaacagaggaacgatgttttgaaacaccgttcctctgtttgttctctcctggatggcagagctaacataagcgttttctgtttctccgccgatcaaggggttgggttggattttacgcattcccgcgcgctgtccgctccacgcgatcctctcggaaaaagagagtgatgcaccaaatggcagacaggcaaaccaggatatacaccagccggctcagaccgctggcggagccgccaaagagggccgccacgatgtccaggccgaaaatcccgatgctgccccagtttaagccaccaatgatgaccaagaccagggcgattctgtcgatcaccttcatagggaacctcctggaaccacaactgcgtggtccattggattttcgaagcccggcaagaggcattgccccttccggtctccgtaaggtagtatgtcccgcccctccggccgccatgctggaacatttttctttttttcagccgggatagtaattgatcaccaaaccggtgacccgctcgtccccggcgtttcgataggtatggtccgccgtggagtcaaagcccagcgcatcccccggccccagccggtaggacttccccccggtctccactgtcagctccccctccaaaaccgtgatatattcctgtgcctgggccaagtggcctggggaggtgttggcggtatgggggtccaattccatgtaaaacagctcaaaggaccgctccggccccccctgaaaatagcagtacacccgatagtggccgttcccctcggtctggggagagagctcctcccgccggaccagggtggggccgggctcacttccctccagcagccgggtatagggcaccttcagtccattggcaattttccaaatggtgttgatggtgggatttcccatccccttctccatctccgagagcatcgccttgctgatccccgccaggcccgacagctggcccaacgtgagattgcgttctgttcgcatctgctttaggtttgccccaatgcgcttgccccaatccatgcaaaatcctccttcggcctcttgacaaaaaaatcgaacagttgtaagatatagcagtcttttgttcgatgttttggatttttgtacagtataataattttattataccggacccgccgcaaaaaagcaagcaggattggaggtatgtcccatgaaaaccaaggccttccgggccgcgctcccctacaccttacccatctgtgtgggatttctctttctgggcatgtcctatggatttctcatgcgcagccagggcttttcctttgtctatcccatgctgatgagcctgttcatcttcgccggctccatggaattcgtgacggccaacctcctgctcatgcccaccttccagccgctccacgccttcctgctgaccttgatggtcaacgcccgtcatctgttctatggcctgtccatgctggacaaattccagaacctgggctggaagaagccctatctgatcttcgggctgtgcgacgagaccttttccatccactgcgcggtccctcccccggagggggtggaccggggctggtttatgttttttgtcactgtactcaatcagctctactgggtggccggggccaccctgggcgccctgctggggtacttgatccactttaacaccacaggcattgaattcgtgatgaccgccctgttcgtggtcatgtttctcaaccagtgggaggagcggaaagaccaccgccccgccctgatcggggtgggctgtaccctgctgtgtctgctggtcctgggcagtgaccattttctcctaccggccatgggcctgatcatcctctgctttctctggctgcgcagaagatccccccaggaggtgtccccatgacaattttacagcaggttctcactgtggcggccgtggtgctgggtaccatgaccacccgctttctccccttccttctcttccctgaaggcaaacagcccccggcgtttatccgttacctgggcacagtgcttcccagcgcagtcatcggcctgctggtggtcttttgtctgaaagacgcggtcttcaccagctggcatggcctgccggagcttttgggcattctggtcgtcgctttgctgcaccggtggaagaaaaatattctcctgagcattgccggaggaaccattttttatatggtcctggttcagatggttttttgatccccgcccccaccaaacatgccgcacggcctgccgcggttcctttgagaactgcggcaggccgtgcggcgtatcattttttatagtgtattttgaaagagcgtccagggctccgtcgccggcggggaaagacgaaagtccatggcctccccggtttccggatgggtaaaggccagatggctggaccagagggcaatctgccacgatggggggtcggggtatttactgtacttccggtccccagccaggggcattccccgggcggaaaactgggctcgaatctggtgggttcgcccggtctccaggcggatctccaccagggaaaatccctgccggttgtccagcagccggtagtgaagcaccgcctgctgaatccccttgccggggaccttggccacataggttttccgggtcttttcattccggcccaacagatcaatataggttcccgcatcgtactggggacgccagtggaccaccgcctggtattctttttggaactgatcctcccgaatctgccgggagagctccgaggccgcgtggcctgtcagtccgtagaccatcagtccccccaccacctgatccaggcggtggaccgtccgcaccttggcctggggctgcccgatggcctgtcggatcaggtcgggcatccccccgggctcgtcggtggagagcacccgaaagggcttgacgcagaccaccagggcctggtcctgatacaggatttcaagcatactatttctcctctttttgcggcagtgtctgccccgcatttttgggggactgcggcgccccccggacggacagcacattatacagcatcacgctgacaaagacaatcccgccccccagaagagagagcctggtcaaggtctcccccagcaccagtgccaccaaaatgggattaagcaccggttcaatgcccgtaatcagggaggccgtcacaggcggaatgtaccggattcccgtggtaagcagggcataggccagccccagctgaaacacccccagcagaatcccaaagcacagcgtggtcccatcaaactgagtctcccgcaccaaccagggcagaccgattaccgcccccatgctctgtcccaggatggtagaccacagagggtctccccccggaatcttgttgagcagaaagacccaggcatagcatatccccgccagcacggcgatcacatcccccaggaagcgcccgcttcccaagctgtccaggaaaaagcaaaacaccccgccgaacacacagacgcaggccgccaggtccagccgcttgggccgctcccgaaagaccgcccagctgcacagaatgacaaagatgggcgcggtaaactggagcagcaccgcgttgcccgccgtggtcagtttggtggcaacggtatacagggccgtggctccgcacacggccagcccccctaaaaccactcccccggtcaaccggagtctgcgccgggttaaccgggcaaacaccagcagaattcccaccgagataaagctccgaaaggaattgatagacaggggctgccagggaatcatcttcacacagagaccgccgatgctgagcagcagggcagcggccaccaccatagctacgccttttttggacaccattgcaatcgctcctatccataaaatgagaagcgtgggacaagcaaactcacacctggtccagggcctgctccaaatctgccagaatgtccgtgatatcctcaatgcccacagacaggcgaatgaggtcggcggagacgccggcggccgccagttccgcctcggacagctgccggtgggtggaggaggccgggtggagcacacaggtcttggcgtccgccacatgggtggcgatggaggccagcttcagccccgccataaaggtctccgccgccttgcggccccccttgacgccaaaggtcaccacaccgcaggtccccttgggcatatacttctgggccaggtcatggtatttgtccccctccagaccggggtaattgacccaggcgatcttggggtgcttctgcacgaatttcgccaccgccaaagcgttggcacagtgctggggcatccgcaggtgcagggtctccagacccacgttgagcaggtaggcgttcatgggtgcgggggtggcgccgaagtcccgcatgagctggaccgtggccttggtgatgtaggccccgcccagaccaaaccgttcggtataagtcacaccgtggtagctctcatccggggtgcacaggccggggtagcggtccgggtatcgggtccagtcaaagttcccgctgtccacaatggcgccccccacgcagttggcgtgcccgtccatgtatttggtggtggagtgggtgacaatgtccgccccccactggaagggccggcagcccaccggggtggcaaaggtattgtccacgatgagaggcaccccatgggcgtgggcggcgcgggcaaacttctcaatgtccagaacaatgagggcggggttggcgatggtctccccaaacaccgccttggtgttgggctggaaagcggcgttcagctcctcttcagagcaattggggtccacgaaagtgaagtcaatgcccatccgcttcatggtaacggcaaagaggttgaaggtccccccgtagatggccgcggaggccaccacgtgatccccggcggaacagatgttgaacacggcaaagaagttggccgcctgaccggaggaggtcagcatcgccgccgtgcccccctccagggcacagatcttcgcggccacccggtctgaggtggggttctggagccgggtgtagaaatagccctccgcctccaggtcaaacagcgcccccatggcctcgctgctgccgtaacggaaggtggtgctctgcacaatggggatgtttcgcggctccccgctctcgggcacatagccggcgtggagacactgggtccccttttgatactcctgcataattttgctcctccttatcagctggttccgccggagtgattcgacgggtgattgacaacgggtaattgattaagaacgacgtattataccgcttttttcccgccacggtcaatcccttccggcaaacctgctggtcagagatcgctggagaacagggcctgcgggccccttgcctgtattgtaggccggcagccccgggatttccatgctctctttttgtgaaaaatcttccccgccgatgctatttctactcattttatcccctctatacggatttttgagcaattctttttctggtttcttcctttttgttgctttcctctctctttttccacaaaaatggtaaggttaaaattttctattgcatttttcgtcatttccgattatgatatacgccgtataaccgaattctaccttgttttttcccgatattttggacttttgggacaaaaataatcggtttccaatcaaacgcgctatcccacccaaaggaaaggagaccactgattttgagcagactgcgtatcaccccatgggagaattcccagcgcacagtggacgatctctacgccgacatggagcgccgcatctctgcggccccctgcggaaactgtcccgtagagctcaccagcgcctttttgaaactctgcctggcccagagctgcggcaaatgtgtgccctgccgcatcggcctggaccggctggccgccctgctggaccagctgctggacggtcagggcagccaggccgatctggacaccatcctgcgcaccgcgcagtccattgtggacagcgccgactgcgccatcggattcgaggccgcccaaatggtcctggacgggtatgtggccttccaggacgattacctggcccacgtgacccagggcagctgcaccgccaactttaagagcgtcccctgtgtggagctatgtcccgcccacgtggacgtccccgggtacatctccctggtgggagaggagcggtacgacgacgccatccgtctgatccgaaaggacaacccctttccctcggtctgcggcctggtgtgcgagcacccctgtgagacccactgccgccggaccattgtggactctcccctgaacatccgcggcatcaaacgcttcgccgtggaccacgccggagaggtgcccgccccgccccgggcccccagctcgggcaaaaccgtggccattgtgggcggcggcccctcgggactcaccgcggcctatttcctctccctcatgggccacaccgtcacggtattcgagcgcaagcccaagctgggcggcatgctccgctacggcatccccagctaccgcctgcccggctcctacctggaccgggacattgacaccatcctctccaccggcgtgtcggtgcgggtaaactgcgaagtggggaccgatgtcaccttagaggagctccgccgggactatgacagtctctatctggccatcggcgcctccctgcacaagggcctcggcatccccggagaggacgccaagggggttctctccgccatcgagatgctggacatcaccatccgctcggtaaaacccgactttaccggcaagcacgtggtggtggtgggcggcggcaacgtggccatggacgccacccgcacggcagtccgcctgggagccgcgtcggtcaagtgcgtctaccgccgccggatctctgacatgaccgccctgccggaggagatcgagggggccatggcggagggctgcgaagtgcttcccctgaaagcccccgtacggattgagactgatgacgatggcgctgtcaccgcccttgtggtacagccccaggtcatcggcgaggtccggggaggccgtccggcccccagaaaggccgaccagccggaggagcgaattgcctgcgacgtggttctcatggcggtggggcaggtggtggactccaagagctttgcccaagcaggggtccccacagatcacaacaacatcgtcaccgccgacgacggcagcgttcccgggctggaaggggtcttttccgggggcgactgcgtctccggccccgccacggtgatcctggccattgaggccggcaaggtggccgcggccagtattgatgaatacttgggcttccataccgatatttcggccaatctggacattccccccgcccccttccgcctcaaacacgccaccggccgggtggacctcaccgagcgggaggccaactggcggaaaaacgactttgagctcatggaaaactgcatgtccgagcaggagatggcccaggagtgcagccgatgtctccgctgtgaccactacggtcacgcgggcttcaaaggagggaggctgatcaaatggtgaccctgaccatcgacaacaagcaggtctccgtccccgccggcaccaccattctggacgccgcccgggccgtggacatccatatccccaccctgtgctacctgcgggagatcaatgaggtggcctcctgccgggtgtgcgccgtggaggtggagggggtggacaagctggccaccgcctgcaacaccctggtggaagagggcatggtggtccacaccaatacccagcgggtccgtctgacccggaagaccaatgtggagctcatcctgtcccagcacgtggaccactgcgtcacctgcgtgcgcagcggcaactgctccctccaggccctgtccaaggccatgaacatccagtctgtccccttccgaaaagaggccactgaacgcccctgggaccctgcccttcccattctgcgggacagttccaaatgcatcaaatgtcttcggtgcgtctcggtctgtgaccgggtccagtccctgggcgtttgggaggtcaccggctccggcgcccataccacggtgcgcatccggggcgggctgcggatgaacgaggccagctgcgccctgtgcggccagtgcgtggtccactgtcccgtgggggctctgcgggagcgggacgacacggagaccgtcttctccgccctcagcgatcccaccaaagaggtggttttccagattgcgcctgcggtccgggccgcctggggagagagcttggggctttccccggaacaggccacggaaaagcgcctggccgcggcagtccgggccctgggggtcaagcatgtgtttgacaccaccttctccgcagacctcaccattttggaggagagcagcgagttcgtggagcggctgtcccacccagagtccagcaagctcccccagttcacctcctgctgccccggctgggtccgctttgtccgcacggaatatcccgagctggccggtcacctctccaccgccaaaagcccccagcagatgtttggcgccatcgccaaaagctattacgcccagaagctgggcaagagcgccaaggatatcttctgcgtctccgtgatgccctgcgtggccaagaaatacgaggccgccacccccgaggtcagcgacgtggccgaccaggatgtggatgtggtcctcaccacccgggagctggaccggatgctccgggccatgcagattaacgtggctgccctgccggaggaggactttgacagtcccctgggccgggggtctggcgccggggtgatctttggggtcaccggcggggtgatggaggccgccctccgcaccgcctattggaagctcaccggctccaatccccctgccgatgcctttcaggacatccgggggcaaaagccctggcgggaggcctccttctccattggggagaccaccctccgcctggcggtggcctccggcctgggcagtgcccgggctttgatggacgccctccgggccggacaggtctcctacgattttgtagaggtcatggcctgtcccggcggatgttccggcggcggcggtcagcccatccacgacggggaggaccacgccgcccagcgagggcagcgtctgtacgccctggaccaggagagccccatccgcttctcccatgaaaatcccaccatccagaccctctaccaggaatacctgggccatcccctgtcggagaccgcccatcacctgctccatacagaccagcgcaagtggacgctgtaatcccatcacagcaaacgcggcaaaggaactggttcctttgccgcgtttgctgttctttaccgggcgcccacctggcaccggcggtataaacgccgtccccccaaggccagcagagccgtgagaaggaggtaaaccaccggcgtaacctgccaagtggtcagggaaaggccccccactgagagcagatcatagcgaaacgccccctgcagtgagacaaaattgctgggcagaagataccacagcacggagagcagcctggggctttctggcaccgcggtgatgagcgtggtcagcaggagaatccccaccaagattcccatggtagccacactgttccgggtcacttgggagagcaccatcgcggccaggctggtgaccgccgccgcggccaaaaaggcgccgaacaaaatcagcgtcacctgcccgatggatgctcccaagggcatcagcagggtaaagagcgcggagaccccgaagccctccagcccatagaccagcccggtgacccccagcagagtggccagaagaagcaggccaaagcccacccccactgtcaggcccgccaagagcttcccggtgtacagggccgttctgccccggcggctggacaggatcagctgatcagtccggtgctgcgcctcttggggaaacataccggaaagggccaccgacagaaagagaacttccaggaacgtcatcaccttcatcagggaggccatctggctccacccctcatgataccctccatagaccagcggctgggagagctgctgctggaccttgctctgccagtaagaggccgcctgctccgtggcgcttcccttttccgcctctgtgcgcagcttatcttccagccggtcatacagcatctgctgatccacggccagaatctccgcgctggccgcagtgtccagcacatggcccaaaaactcataaatgtcgatgcagcccatcagctccctggcgtcccctgcaaaaaccattttttcataggccggccgaaattggtccagcatatcctggtccacggtctcaccggccagcgcggcgccgccctctcggtgaagacggatgatctcctcgccccgcagcccgctgtccgtggtctgcaggcaggctgccgccccccacagacacaggcacaacagcaaaattccccctgtgatccagagcaccttctgctgcaaacattttttcagctcaaagcgatacagttccgccatgctctccctcctctccaaacgcttccaggtagaatccttccaggtccgcgatctccgatgccgggccctggtgaatgatccgtccgtctttcatcagcaggatcacatccgcaatgtgcgccaggtcagagacaatgtgggtggacaccaggacaatgctctgcttccccagggatgcaatcagcccacgaaagcgcacccgctcctttgggtccagccccgctgtgggctcgtccagaacaagcagcttcgggtggcccagcagagcctgggcaatgcccaatctctgtttcatgccgccggagtaggtcttgatcttccctttcgccgcctgggacagccccaccagctccagcagttctttggcccggcgcctggcctgggccttgggcagccccttcagcgcccccatgtaccatagaaattcctcccctgtgaaccccgggtaatagccgaagtcctggggaagatagcccaggcacgcccggtactcctcctgtgcaacccccaggccgtccagggaaatctccccccctgtgggatgcaaaatgccacagagcattcgcatcagggtggtcttccccgcgccattggcgcccaaaagtccgtaaatccccggcgtcagggtcaggctaacccggtccaccgccaatttatgggggtattgtttgctcagcgctcgaatgacaagttccatgcttcctccactcctttcttggttagggccagttccctggccagagccgccgacagcactgccgccgccaaaagccatcctggaaaattccacggcgcaaacagtgtctgcatccaccccaccgccaaaagatagccgccgcttaccagtactgccagcaccgccgccccatagaccatctcccgcccccgcagccggcgggacagccacagcccgccataggcggtgagaaggtaggggaccaaaagatacaccacggtccgtccaaaggaggccgccccagtcccccggcacaggagggtcaggcagagcagcaggacggcgtgcaggctccccaccaggcaaagccgggccagcaggacacttttcagagaaaaccgggtggccagttccagctcctccatgccgtataccgcagacctggtcccctctgtcaccgccagcagcgccacaaagggcagcagcgcagcagtgatccagagaacattgggattcatacagctcccgccccaaaccgccggaagcagcaccccgcaggacagcagccaagtccgcttccgcagataggggatctggttccaaagaaaggtccccagggagaggtccggctggggcagggtcctgagaaaaaccgtttttctctgggggggcggcggggaaaaggatgcagcaagggcacgcttcagtcttcggttcatgttctctcctcctctcgcaatgcctctctgagttgggtcagcagcctgccgcaccttcgatagatggcaaaccgggacagccccgtcagccggctcagcgcctgcaggggcacctggttggcatagcgcaggagcagcagttcctggtcctggggggtgagcgtctccagggcccgttccaagtcccatcgctccaccagcgtgcccgcggggtccgcggcaacctggtcggtctcctgcagcgggagggtttccctttgccgggtcacgtccacacacaggttccgggcaatggtgtacagggtgggcagcgcctcccgctcccgctggccgggataatggtccagccagcgaaggaaggtctcctgcaccaggtcctcggcggtctggacgtccctgacccgaaaatagcaataccggtatagcttatcatattgatcttccaagtccatggcagggtctccctccttccactttgtataacggccgtccccggcaaaatgtgcggcctaaacggtatttttttatttttcacaaaaaaagcccccctgaaacaggggggcggcacaaggggccaactatcgcaagtctaattgtagttcgtctcctcaaaaattaggacacatcctgggctgtttcctccgacatacctgactggagcgccgaccaggcctcctccgcggtcaagcgctggtgatcccggaaggaaagcatctctccctcggcggtaatcatcaccgcctccaccccctccagctgggtcagagtgagcaccacactgtaatcggccaaagtcaggtcaatgccggagagcaccccatatccactggaaaaatccaccgtcaacagtccgttgtacagggtccacttccgcagcgtcaccccgctgggaatggccatcgtcagattctcgctctggggcgggctcagcagcaggttcagaagcccctccaccggctcggtgtccgggggaagcacccgcttctccgccaccagggcggcctcctcccccgcggcctggttgcagtagtacaccgcgtattcggttcccttcgcatttcccccgcagcccgccagcgcgaagaggcagagggccaagagcagggccccggcgcatctttctttcatcccccgctctcctcctctctccacgccggaagaatcaccgtaaagaccacgccggccggctgcctggcctggaccgtgatggtgccgccatggtggcgcaccgcgtcccggacaatggacaagcccaaccccgtgccgccggccgcccgggagcgggccttgtccacccgataaaaccgctcgaaaatccgcggcatgtccgcctcgggaatgcccacgcctgtgtcggccacggacagcagcacccgcgctccttggcggcgtgtggtcaccaaaacttctccgccggtgacgttgtacttaatggcgttctccatcagattccgcaggatctgactggcgtcctcctggttacaccggacaatacagtcctcccccaggtcggtctccagcgtaatccggtcctcctccgccagcggcgccagcatccgcccgatcttctccacctgctccgtccagtccaccggctcctgggccatgtcccgcccctcgtccaggcggttgagctccaataattcctgactgatgtggatgagacggtccgccgcctccccgatgtccgccacaaactcccgggcggtgtcccggtcaatggaggcatcctgtaaaatggaatcggtgagcagccgaatggacgccaggggggtcttcagctcatgagacgcatcggagacaaaccgccggcgctcctcctccgtgacctggagccgtcccgtcagctggttaaactcctcagccaactgcgccagctcatcgtgtccatccatggagatccgatgggtgtactccccggcccgcaccgtgcggattccccccaagagggtcctgacccgccgggaaaggaacgtggaaaaggccccaaacagaaccagtaccgccaggcagaccaccacggagatcagccgcaggttccgctgcagctcctccagcaatgccccctggtcactgtcctggtcatacagacagaccgcccccaccacctggtttcgattcatcaccggggaggcggcccgactggagaaggccccgtcctggtactcactggaaaaggcgtcgttgccccggagggcggagaccacctctccaatgagggcatatttccccagggcggagggctccccggtatcgtagagaacccgtcccgccccgtccgtgaccagaacccgccggacctccagctcctccagctggccaatggcctgctccaccgtctccggcgtgagctcgtcggcggtggtgagggtgttggtgatcaaaaccagctggttggccagggcggtctgctgggaacgaaacatcagattctgtcccataatcaggggataggtattcatcagaaccagcaaaacagcaatgagacaggaataccccagggcaagacgcatttgcagggagtggctgatgttccactttccccccatggggccccctttttttccgcgccgtcccatcacgcctccttaaaatagtaccccaccccccatttggtgcacaggtgggcggggtgggcagggtcttgctccaccttttcccgcagacggcggatatggacgtccaccgtgcggtactccccggtatactcgtagccccataccaggttcagcaactgttcccggctgtaaacccggttggggtttttcatcagcagctccagcagatcaaactcccgggcggtgagctccacggggttgccgtccttccaggtggtccgggccgcactgtccagggtcagtccccccaaggtcagccgctggtccgagcccgcctgccgccgggtggcggcggaccggcgcagcagcgccttgacccgggccttaacctccaaaatattaaagggctttgtgatgtagtcatccgccccgtactcaaaccccagaagcttgtccgtgtcctccccccgggcggtgagcataatgatggggacggtggagaatgcccggatctccatacaggcctgcagcccgtccagctccggcatcatcaggtccagaataatcaggtcgtactcgttggcccgggccagctccaccgcctgacggccattgtaccccacatccacggtatatccctcgttctccaagttaaaccggatgcctttcaccatcaccttttcatcgtcaaccaccagaatccgtgccatggtctcctcctttctccaccgccggaaccccaacggtcacataggggcgcagccgctccagggtggcctccccaatgcccttgacctccagcagctcttccaccgcggaaaatccgcccttctcctggcgccaggccagaatggcgctccccttcttctccccaatgcccggcaggcgcatcaggtcggagagggtcgccgtgttcaggtccaggacctctccctccagcattcccggcgcctctggttcctccgccggctggctggtctgggcggtcggattcttcgtcacctggacttcctccggctgcaccgtatggaaccagaggagggtccccgccgcaaaacatgcggtcagaagaaggactgctccctccaaccatgaaattttcgcaaattttccggccattgttcccctcccccattgcgtcttgtgtcgagctttgttatgataatgagtgaatttcctttcaatttcattccattccccggtccttggcctggaatgtgaagatacaaaatgattataacacgggatgtggatgtttcctatgaaaaaaacgctgattcgcgccatttcttttttcctgaccttgtcactgctcacgggcttgctgatcccttttgccagcgccatcgagtacgaaggggtggagtccatgacggtggacgccaccgccgcgcttctcatcgacctggacaccgatcaggtgctttacgagcaggctgccgatgaacagcgttatcccgccagtatcaccaaaattatgaccgccctgctaaccttggaggccattggacggggggagctggacctgaacaccgagatcaccgtggacgccgccgccctggcggacatcacggaggactcctccaccgccaatcttcaggccggcgagaaaatcacggtgaagaatctactttactgcctgctgctggcctccgccaatgaggcggccaatgtattggccatggccgtcagtggagatatccccacgtttgtggagctgatgaaccagcgtgcccaggagttggggatggcgggcacccactttgtcaatccccatggcctgcacaacgccgaccactactccacagcccgggacatctaccgcatgtccaagcaggccatgacccacgcgacgttccgggagatcgtctccaccggccgctataccgtccccgccaccaacctgtccaaggcccgcagtctgctcaacaccaacggtctgctgacctccgccaagcattacggctacaccatggacggcaccatcggcatcaaaaccggcagcaccggagaggcgggctactgcctggtggccgcggtccagaaaaaggggcacacactggtctccgtggttttgggggcccaaaaccccacggacagccggggcaatgtccagcgcaagcagttcaccgagagcaagcggctgctcaactggggctttaccaatttctccgacgccaccctgctggatgcggagacctacctgcaggagctccctgtccgcttctcttcggaggccagccacgtggtggtgcggcccacccggtcggttcaggtcatggtccccgggacctatgacccggagcggctggagctccgccttcgcttccaccgggatgtggcctccgcccccattgaagcgggggatgtcctgggcaccgtcaccgtgatttacgccggggaggaatacgccacggtggacatggccgcggtgagcgacgtgtccttctccccttttatggcctttgtctccagtgtgaacaccgttctgggaaacatctatgtccggctgctgctgctgatcgccttggccctggttgtcgtgggacttgtccgccggttccaggagcggaccaaggaggagcggcgggccaaacggcagctgcgccagcaggaaaagatcgccttccgccagcgggaggccgaggcccggcagcaggatgaggcccaggccaaactggaaaaagaggcccgggagcagcagcgcaaggaagagctgctccgccgccagcaggaggcccaggagcgacaggccaagcgggcccaggaagcccaggaacggcaggtcaagcgggagcaggagcgactggagcgggaggagcgaaaccgccagctccgggcagagcgggaagcccggcaggccgaggaacgccagcgccggcaagccgaacgggaggagcgccagcgccaggccgaggtccgccgccgacaggaagaggaagcccgtcgccagcgggaggagcgagagcgccggcagcgccaggaacgggaagccagacgccaggaagaactggcccgccgcaggcaggaggaacggcaggcccggcagcgggaggaacggcgccggcaggaacaggccgaccgggaacgccgccggcaggccgaatgggaacgccgggcccggc

SEQ ID NO: 2241 - DNA, 23179 bp, KLE1738
ggcggagataaaaccgccgttggcggcccggcgcatgttggcccggttgaccgtgagggtgtcgatcatggcggtgaagacgggcaggcagagctctacggtgtcaatggtgtcaaacaccggctccttgtcctcctgcatgtccttattataggccaggggaatgcctttcatcaccgtgagcagggtgatgagggcgccgtatacccgcccggtttttccccggaccagctcggccacgtcggggtttttcttctggggcatgatggaggagccggtggcgtaggcgtcgtccagcgtgatgaactgaaactcccagctgcaccagagaatgagctcctccgagaaccgggacaggtgcatcatcaggatggagcaggcggagaggaactcaatggcaaagtcccggtcggacaccccgtccagggagttgtccatgggttttgaaaagcccagcagctctgccgtgcggaaccggtctacgggatgggtggaggtggccagggccccggaccccaggggggactcatccagccgggcccggcagtcctccagccgggtgatgtcccggcggaacatgttggcataggccatcatggcgtgggcgaaggtgatgggctgggcccgctggaggtgggtgtagccgggcatgatggcgtctaggttgctctcggcctggcggagaagggctttctccaggtccagcagcatccccacaatgacgggaatctcatccttgacaaagaggcggaagtccagggccacctgatcattccggctgcgggcggtgtgcagccgcttgcctgtggctccgattcgctgggtcagcaggacctccatgttcatgtggatatcctcgctgtccttggtgaattccaccttgccttccttgatctcctccaggagagtctttaaggtggttacgatcttctccgcctcctccttggcaatgatgccctgttcccccagcatggtggcgtgggcgatggacccggtgatgtcctgccggtacagccgggcgtcaaaggaaatggaggagttaaagtcgttgaccttgtcatcggtctccttctgaaaccgtccagcccataatttcatagcaaacgaatcctttccatagaacggcgcagagcaggacctgcagatcctgcccccgccatggttttcctgtcatactggcctcggacttgcctccaaccggggcacagcccgaaaagcctcgcagagtttcccgccccgcagggcgggaaatccaattgcaatctattttttcgccggctccgccggggaaaatccggatcagtccgggcgtgcctggccccgccaggcgcggttcggactgcaacgcgcaaattttgaagcccagcgaagcgggttcaaaatttccccgtctcaaagtttaccaagctcccgcagcgcctgcaccgtgtccggcaggccccagaggttgatgaagccggtggcgtcatcctggttgtagtcgctctcctcgaaggtgaccagtttctccgagtacaggctctcaggagaggtgacggaggaggtgatgatgttgcccttatagagcttcagcttcaccgtgccggtgacgtgcttctgggtgtccacggcgaaagcctggagggcctcccgcaggggggtaaaccacttgccgttgtacagcaggtcggcaaagtcgatggccagcttctgcttcatgtgtttggtgtctttatccagggtgatcatctccagcacctcgtgggcccgatagaggatggtgccgccgggggtctcgtaaaccccccggtccttcatgcccaccagccggttttccacaatatccagcaggccgatgccgttggcgccgcccagctgattgagcccctcgatgatcttggaggccttcatcttctcgccgttgagggccaccggtacccccttttcaaagtccaaggtaacgtaggtggcctggtcgggggcctgcatgggggacacgcccatctccaggaagccgggcttgtcgtactgaggctcgttggcggggtcctccaggtccaggccctcatggctcaggtgccacaggttcttgtccttggagtagttggtctcccggctgatcttcagggggacgttgtgggcctcggcatagtcgatctcctcgtcccggcccttgatgtcccactcccgccagggggcaatgatcttcatggtgggggcaaagcgtttgatggccagctcaaaccgaacctggtcgttgcccttgccggtgcagccgtggcagacggcgtcggccccctcagccagggcgatctccaccagcttcttgccgatgatgggccgggcgaaggcggtgcccagcagatagtcctcgtacttggcccccatcatcatggaggggatgatgacgtcgtccaccatctcgtccaccaggtcggccacaatgagcttggaggcgccggttttcagggccttctcctccagcccttccagctcgtcggcctgtcccacgttgccggagacggcgatgatctcggggttgttgtagttctctttcagccaggggatgatgatggatgtatccagcccgccggaataggcgaggacgactttcttaatttcagacatggtgatgacctcccaaaaaagtttccgtggaattctcattggggaaagcatagcacgaatccatgcaaattgcaagagaattatgcataatcattcgaaaaagaagggaaaaaccccaggcaactttccacaaaaatgaatatttagggggagtattcgcatatatatactgaaaaatacggaaggagaagagaattgacttttttccggaaggctggtaagatgacagcacagcaccagacggaagagaaggcagatgtacaaagggtttgcagtgtgcgcttacaaatgaattaatatattatgatttctcatgtcattatgaaggttgagtaaaagacattgtcctctggattgatagaatgattatttcaacctgattcgacaagaacaggttccaactgattttataaatgcggaccaagagggatgctccgcctcgggcatccccttcccgtgtaaaaatagagggaaattgaatatgcgggtatggcggaattggtagacgtgcaggatttaggttcctgtggagcagtccgtgtgggttcgagtcccactgcccgcaccaaaggcggtgggttcgaagagggcctgccgtctttttccatatgaccacttattgcatagaggaacaaggcccgcagacgtatgatagtgggatgtccccagtgaaaaaggagaagattgtatgctttatagaaaatgcctgagacattacggcgcggccctcctcctgggccttctgctggcagctggcgtgagcggctgcggagagacagaaccggcccccgaggccacggagcttccgccggcggaagaggcggaggagccccaggcatctgccgagcgggagatttcatgggaaccggtgacggtaaccaccagcggccggggggaggtttgctttgacctgcggccggaacacttcataaggcggtacaaccagctctaccggcaggactggggggaggacctgctccagcccctggaccagtggatggactatggagtgggctttctctcccggtcaggcggggcggagggacatcagtatgtctcccaggtggacgagagcaactacgctgagcccttcctctccctctgtgtgacccaggacggcgcccgggtgatggagacggtgacgggcttgtctcagaaaaactatgacggcggccccatcgaattctttcaggccaaggccttttacagcctgcgggtgttcttccctgcaatggagcgcgccgactttgaccgcctgtacgaggccctgttcgccgggggaagttatgcggagacgtatgagaccccgctgcccaaccgggtgttctaccaggatggggtggcctgctatgctacccttcagattggagagtgcgaccagatccacgtcatggcggtgacccaggcccagctggaccagtggcgggctgccggggtggaggtgacagagggatttcccgcaggggagccatgagctgcccaggtttgggttgacaaggtctggggcggagagtaaccttactatataaggaatatgccacaggcgattcgtcttgtatgaaaaaaggagtgtgatcccatgctcacccagcgtatcgaagccattcggcaaaattatgtcaatacaaagccccaaatctcctgcgagcgggccaaaatctggacggattcccaccgagagaccgagggacagccggtggccatccgccgggcccgggccttctatgactgctgtgaccggctgggcgtccatatctttgcgggcgagctggtggtgggggccatcggggagtttcggaagtgtggtatcctcaccccggagttctcctggatgtgggtggaccgggagatggacacctttgacacccggccccaggacccctatcggatgaccgatgaccagcgggcatttgtccgccgggagattttcccctattggaaaggaaagtcgctggaggaggccttcctggcccgcctgccggaggatacctaccggattggggtggacacaggggttctggacaacgactccaagtggcgccaggcggtgggggagatcaccccggactaccaggatgtactgttcaagaaggggttcggcgggattctgcgggaggcggaggaccatctggcggctttggaccccaccaatccagaggacctgtccaagcgggagttttacacctccgtctgctggacctcccgggggattatccgctacgccaatcggtatgcccaggcggcggaggccatggcggaccaggagaaggaccctgtccgagcccaggagctgcgccggatcgcccgcaactgccggcgggtcccggagcatcccccggagagtttttacgaggccattcagttcctgtggtttgtccaggtggggggcattttgtcagaaaatcccctgtcgctgaatcccgggcggtttgatcagtacatggccccatactatgaggcggacctggcccaggggaccctggacgaggcctttgcccaggagctggtggatgccctgtggctgaaatactcggagtgggtgtggaccatctccgccaatacggcggattattttgccgggtataaccagttccaaaacctcaccgtgggcggcaagcggcgggacggaaaggacgggaccaatccggtgacctacctggcgctcaaggccacagaagaggtcaagacccaccagcccggcctgtccgtccgggtgcaggcggactgtcccaaggaatttctggacgcggtgacccacctggtgtccaaaggcactgggtttcccgccattcacagcgacagcgtgggctatcagatgcttctcaacgccggctatgccccggaggacgcccgggactggaacaactgcggctgcgtggtgccccactaccggaagacgggggagtggactgcggcggtgaacatgaactttggctctgccttggagtatgcgctgaatgaggggaagagtctgatgacaggccgtcagatggggttggcggagcggcctgcggagaccttccgcacctttgaggaggtggaggcggccttttaccgccagttcgatttcctctgccgccacgcggtgattatgactttggaggcccagcggcttcaccaggagatggtgccccgtcccttcctgtcctcctgcatcgagcactgcatggaatcggggaaggacttgtcccaggggggcgccaagtataccattggtccggtgatcaccggcattgggctggcggtggtggccaattccctggccgcggtgaaaaaactggtgtttgaggacggggtctgtaccatggccgaactggccgccgccctgcgggccaactgggaggggtatgaggacctccaggcccgcgccaaggcatgccccaagtatggcaacgacgaggacgcggtggacgacttggccattcgtctggccaaccatttctatgaggaaatccatccgtaccacgatatatttggcgcccccttcctcaccgcgttcatggggatctccaattacatccccatgggccgggtgctgggggccaccccggacggccgaaagcacggggaaccctccagcgagggggtctccccttatgtggggaccgaccaatccacccccctggccgcgatgcgctccagcgccaagctcaaccaggaggtccattccgggggaaccctgctgaacctgcggctgagccccgagttggtggccaccaagcgggggcaggccaatttggggggcatgattcagaccctttttgccctgggaggctttcatgtgcagtttaactgcatctcctccgaaaccctgcgggacgcccaagcccatccagagaactaccgggatctgctggtccgggtggctgggtattccacccagtttgtcaatctctcccgggccatgcaggacgccatcatcgcccggacggagcacagaggctgagggggggcttatgggcggctacatcacccaaatccagcactgttcggtcaacgacggagagggcattcgcacgctgatttttctggctggctgccccctccgttgtgcctggtgcgccaacccggaggggcagacccgggagaatcccatgacccggtggatggagacgagggaagtcctccaagcggtccggcggcaggccattttctaccgcttttccgggggtggcgtcaccttttccggcggggaggccacggcccagggggaattctttcaggaactgacacagcggctctatgacgagggatatgacctggcgttggagacctgcggcgtgtttgactttgaccggatggcgccggccttagggaaaatgaatcaaatttttatggacctgaagcacccggacccgatggcccatcgacggttcaccgggctggacaaccggcttgtgctggagaacctccggcggaccgcccagctgggcccgccgctggtggttcggattcccgtgattttgggggtcaatggaaccgatgagaccatggccgcctgttttcgcctgttgggacagctggcgccgggggcggccctggagctgctgccgtatcaccggctgggggaggaaaaataccgccagctgggacgtccggtgcccagcccggcctttggcattccctcccaggaccagttggaccactggcgggcgatggcccaggccatggggcgtcgggtggtgtcctatcgataaggaggaaattccatgaaagaatatcagctgcatggactgcgggccctggcgcagtcgccaaaggggacggttcccgcctttttgcaggccccggccacccagggggcctggcggtttcaccacgccctggaggactatgggccgacgcctctggtccggttaaatggcctggcggaggagctgggcctgggcggcgtctttgtcaaggatgagtctcaccggtttggtttgaacgcctttaaggggctgggcggcatctatgctctctcccgggcggtggcccgggagctgggtctgccggcggaggtgaccttggaggaattacaggctccgtcggtgcagaaagaggtcaggaatatggtgtttgtgaccaccaccgacggaaaccacgggcggggggtggcctgggcggcccggaagctgggctgtgaggcccatgtctatctcccggcgggctccgcccctgcccgggcgcaggccattctggacgcaggcgcggtggaggcacgggttctgcctctgggctatgacgacgcggtgcgctatgcggcccaacaggcccaggagaaggggtggactcttatccaggacaccagctggcccggctatgaggagattcccacttggattgtccagggatacaccaccctggcccgggaagcggcggaccaactggccgaggcgggggttgaccggcccacccacgtctttttgcaggccggtgtcggggccatggccggcggcgtgctgggatacttggcggaccggtatggggcccaggcgccggtctttgccgtggtggagccggagaacgtcgcaggcatctatgcctctgcccaagccggtgacggtcagccccatccggcccagggcccgggggagaccatcatggcgggccttaactgtgcagagccctgtaccctgacctggccggtgctgcgggacctggccagttggtacatcgcctgcccggaccaagtggcggagcggggtatgcgacgtctggggcgccctgcggcgggggacccggcggtgatctccggcgagagcggcggcgtgaccatggggctgctggacctgctgatgacggcgccggatttggcacccctccgcagggacatggggctgaaccggcagtctgtggtcctgttgatcagcacggagggggacaccgacccggtgcattaccagaaggtgatgacacatgattgacaaatgaaaaaaacgtggtatcgtataggcagtacattccgatatccaatcggacaggagggactaccatggcaaagaaacggaaatggggccgggtgctggcctttggcgccatcacggccgccctgggcggcatcgcggcgtataagcaccggaaggaaatcgagcggacgctccaggagatcgcggaccagatggacgcctgggaggagagcagcgagttttttacggaccaggacaccgttgttcacacggtaaatcccgcccctgagggggtcgaggaggcacccgcagcggaaaatgagcccgccgagagcgactttgtggacgcggccccggcggagacggaagaaaagccctctacggcagagtgattccttgcacacagacagcccgccctccgtcccaaaaggcggggggcggcggtattttcattccagggaggagaaaggaccccagtggagatcaccatccaaccggcctaccaggaaccggaggccattcgagaactgcttgtggaatacaccggcatgctgctggagcaaaatcccgcctttgccggctacctgaagcagcaaaacttcgcggcagagctggacaacctgcaggaaaagtatggggtgccagaggggcggctgtatctggtccgggcagatggggcgcccgccggctgcgtggcgatgaaaaagctggatgcccagcggtgtgagttgaagcggctgtatatccgccccgcgttccgcggccagggcctggcccggcggctggtggagcgtctgctcaccgacgcccgttccgagggctaccaggctatgctgctggacacctttcccttcctctccggggcgatccgcctttaccggaccttggggttctatgagatccccagctacaacaacagtcccttggacagtctcatttatatgagaaaggacctatgtcctgcctgctctttttgcggttaggcgtcatcatgggacagaaaagcgaaacagacttttgtatacacagaattgcaagcgagttggtccgcggaccaactcgcttgttttagagtaatgcttcttgcagacttagccagcaaatctgattgtttcagaaaaacaaaaagatgagcccgataagggctcatctttggtcggagtgtggggattcgaaccccaggcctcttggacccgaaccaagcgcgataccaaacttcgccacaccccgataagcctttctattatacttgtattgtggggaaatgtcaagtgggaaaacgggaaaaagtgaggtatattccgtggagggatgccatagagatagagtagccaagcaaagaaagggggcgggatgatggccggggaagggacaaggaaaaagagccggaagaaggagagcctctccccaggggagaagcggcggctgcggcagctgctcatttgtctggtcctcttcggcgttgtcttcgtgggccgggggatggacttggggccggtgtcccagctctccgccacggtgggggaactggtccgggcggacacggattttcaggcggttttcgcgcggatgggggagtccttctccaagggagaaccagcggtggaaaccttccgttccctctggagcgggatgttttcccaggaggaaacaccggcccagacgccggagaagggggcggcgccggaacagccggcggcccaggaggagcaggcagagggaggcgcggatggcgcggaaaacaattcatagcaccggtggattctggctgatcctgggggcgctgctgttggcggcgtcccttcggcttctgttctgggcggcggtggcggcggcagtgcatgagctggggcacgtggcagcggtgcgggccctgggcggccgggtgggcagctttcggctgacgggggtgggcgcggtgatccagccccggcgggagcggatgttttcctatggagaggagtgcctggtggcgttggcgggccccgccgccagcgttttgctggccataggggctgcggcgtggggcaggcattttggcggcgcggatgcctatctgctgacgggggtaagtctggcgctgggggtgtttaatctgctgcccataggtcctctggatggaggccgcattctccgggcggtggcctcccggtgggcgggaccggatgcgggggaccgtgtgtgcggtctgctgacaaaggttctggccgcgggcctggccgccctgggcgtatgggtgttggggaagagcggaaattttacccttctgctctgcgccggttggctgctgtggcggcgggaagggagccggtgaaaaaccgggagccatctgaaccctttttggggacggatgactcccggtttcgtttggcgggaagcccagggcaaaccgatttggtcagcgtgttttctccataatgtagttggttagaagaatcccccggcgttccacctgctgagcccggaggacctgatatcctcttttttcaaagaaaggccgcgcggtgatggaggcgtgggtgacaaggaggccggcggcggaggcctccagacgatcacagagggcggtggcgattcccatgccctggtggtccttgtggacatacagacggtccagataccctgtgttgctgtctatgtccccaaagcccacggcgcagccgtcctctaccgccacgagggtgtggtggacctgaagagaccggtcccatgcccccaggtcgatgtcctttggcgcccatgcgtccaactgcttttctgtgtagtctcttcggttgacggtgtggaccgtctgatagaacaacgctgccaatgggaccgcgtcgaacggctggtaggctcggatcaccatgcgcctccccctctcttttttggatgttcttttactctaccacattcgatgccctggggcaactggggctgtgggttgccagatgggcttttttttgctataatttactatcaattcccaagacaacagcccgcatgggttaaggaaggccattttttggcatactggtggaaggagacagcgtatgggtatgttttctcagttggcccagggggtggactggtccagcatgggcgcgatggcgctgcggatcgtggcggtgctgctgtgcctggtggtccatgaggtctgccatggcctggcggcctactggctgggggaccccaccgcgaagcagagtcaccggctgtccctcaatcccattcaccatctggacccctttggcctgctcatgatggtggtggtggggtttggctgggccaagcccgtgccggtggacccccgctacttccgcaagcccaagcagggcatggccatcaccgcgctggccggaccggtttccaacttcctgttggcctatgtgtcggcgatcctttacagtggattgtacgcggtgctggtggtgcggggggagaccacggggctggccttggcactggagtttttcggcgtactgatgaccctgaacatcggcctgggtattttcaacttgattcccttcccgcccctggacggttccaaggttgtggccatgttcctgtcggaccggcaatacgtgcagtggatgcgtctggagcggtatgggatgattgtgctgatggccgccctctggttcgggctgctggacggctttctggggacggcccgctcctggatgctggactggatgctccggggggcctccttcgcctacaccggggtgctctccctgctgatgtgacggccatggaacgcccggtctattacattaaaggtgtggtgcgggacggcgcggaggccacccaggactttgtgggcccgctggatttgatcctccatctgctgcaaaagaatcggattgccgttcgggacatcccccttgcgggcattctggcccagtttttgacctggatgtcctcccggcgggcgctggacctggaggtggcgggggagtttatctccatggcctcccacctgatgcttttgaagaccagaatgctgctgtccgagcaggaccaagaggcccaatcggagatggaggaactcattgcctccttggaggcccgccagcgccatgagaactatgcccggattttggcggtgctgccccagctttcggaggggtaccagcaagggagagcggcctttcccaagggcccggagccccaatttgcccgccgggtgtaccggtatgtccacagtggggaggacctgcgcgctgccgtggcggcctggcaggcccgccaacgccgggcggcgcccccctccctggaggaattccgaggggttgtgcggccggcgccctaccgagtggaagaaaaggcggcggagctcctctcccttctgcgggcggagggaccccggcggctgacggacctgatccgccgcagcgggagccgctcagaggccacggccacctttctggcgctgttagagctttgccgggagggaaagattcacttggccggggagatggacaacccggaggtctcctggcgatcggggacctgaggctctggggagaagggcggacaaggggaggaggggatggcaatggagcgaaatcaatgggagagcgccgcggaggcaatccttttcgcgctgggggagccggtggaggaaacccggctggcccaggccatgggctgcccccgggaggcggcggcccgggcctgccagtccctggcccaaggctatgaggcggaacaggcgggggtccgtctggttcggctggaggagagctggcagctggtctccgccccccagtggggggagaccatccggggcctgctgtcccggcgcaagccggacaagctctcgccggcggccttggagaccctggcggtggtggcgtattttcagccggtgacccgggtggtcattgaccaggtgcggggggtggacagcgcccattccctggccctgctgctggaccgggagctggtggcgccctgcggcagcttggacgcgccgggccgccccatcctctaccggacgaccccggtgtttctgcggagctttggcctgtcctccctggaggagctgccgccgctgccggagtccggcctgaaccgggaggagggacagccatggtaggatggattctgctgctggtggtcctggcgctggtattgctggcctgtgtgctccggctgggggtggcggcaggctatgaggaggggggcggctgggttaaggtacaccttggccccaaatgggtctcgctttacccagtcccccaggcgcggaccgcccggcgccgaaaaaaacagcggcggaaggaagcaaaggccgaagcgacagaggatcagaaggaccgggaaaaattctccttggggggggcgcttgacctggcgctggaactgctgccccaggtcaaggcggcggcgggcaaattccgccgggcgctgcgggtggacgagctctgtctgcggctgacgtggggagagcctgacccggcggacgcggcgattcactacggccgggcctgggggattgtggaggcgctgctggcttttttggaggcaaactttgtgctgaaacaccgggaagtctccctgcatttggactaccagatcgagcgcccccggctctttgtccgggccagcctgtccctgacagcggcccagctgctgggcatcgtcctccctttggggtgggcggcgctgaagactttgtggaagcatcgaaaacaaacggccgcggcgggggccgccgcccatggaaggaaaggggagccaagcaatggaaaagaatcatcctgtcagtgaactcatggcggagaccattgagaagatcaaagaggccgtggacgccaacaccgtggtgggggagcctattgtggcgggggagattaccctcattcccgtctcaaagatctccctgggatttggcactggcggctcggagatgggggggaaaaccccgaaggtcatgggggagaatccctttggcggcggcggcggcgctggattgaaggtcacaccggtgtgtttcctggtgatcaacgccggtatggtgaaagttctgccggtggacaccagccatgagaccagtctggaccgggtggtggacctgatccctgacgtggtcaatcggattgccggcctggtggaggagaagaaagccaagaaaccggcgtcggaagaaccggacggtccggcgggaaatccttgaaacattcgtataaaatccctttcccgctccatactaaaggggagcgatcttgtttggatggagggattttgtgcgaagacaactgattgccctggggatgctctgtgggctcctgccggggtttgtggtccatacccacgcggcggaggcgcctgcggtttccgcggcctccgctgttttgatggatgcggagaccggccgggtgctctatgcccataacgagcaggaaccccgggccattgccagcaccacgaagctgatgaccgcgctggtggcggcggagtatctggggggagacctgtcggaaaccgtggagatcaagcgggaatggacggggattgaggggacctctctctatctcaagccgggggaaacgatcaccttgaaaaccctgctctacgggctgctcctccactcgggcaacgacgcagcggtggccctggcaggaatctgcgggggagaggtggagacctttgtggggtggatgaaccagcgggcccaggacctgggcatgaccaacacccacttttccgaccccaacggcctgggcgatgaaaatcattacgcctcggccctggatatggccaagctgggggtggcctgcctgcaaaatcccacggtggcggagattctctccacccggaccattaccctggaggggcggcagctcaccaaccacaataagctcctgtggcagtatgagggctgcaccggcatgaagacgggctatacccggcaggcggggcgcaccctggtgtccagcgcggagcgaaatgggcagaccttggtctgcgtcaccctgaacgaccgggatgactggaacgaccacaaggctctgctggactatggattttctgcgtttccccgacaggtgctggcggaggaaggagaggagctggggcgggtccccttacagggaagcctgctccacatggcctcagtggaagcccgggagacggtggcctatcccctcaagcagggggaggaggtcaccatggaggtagacctgccggaccaggcggaggcgccggtggtgcagggggagatcgccggttctgtccggtttttggtgggcagccgccaggtggggcagacctatctggtctggtcgggcagcgcccgccgggatgtggtgaaggaacggccggtggactctcccctggattttctgccccagagcacaccccccacctatgaggagatgctgtccctcttttccaaggcaggcacagtgagcgagtaaaacgggagggcgcgatggaagatcgtctgcaaaagatactctccgcggcgggagtgtgctcccgccgccgggcggaaacctacatacaacagggccgggtcacagtgaacggccggcccggagtcctgggggaacgggcggacccggaccgggaccaaattgccctggacggcgtgccggtgggccggcggggggaccaccaggtgctgatgctgtacaagccccgaggggtggtgaccaccctgtccgatgagaagggccggcccactgtggcggacctggtccgggattgcggggaacgggtgtggccggtggggcggctggacatggactctgagggcctgctcctgctgaccggcgacggcgccctgacccatgggctgctccacccccggcatcaggtggaaaaggagtatctggtctgggtggagggatttcacccaggcgcggtggaggccctgacccggcccatgaccctaaatgggcagagactgcggccggcccgggtccggctggtccgcccgggtccggggagcgtcctgctctctgtggtgatccatgaggggaaaaaccgccagatccgacggatgtgcgcccactgcggcctgacggtgaagcggctcaagcggattcgggaggggcgcctcctgctggaccgcgatctgcggcccggccagtggcggcctctgacccaggcggaggtcaaggtactgcgggaggaatcttttctgcaagaataagaattttttcttgcaaaaagggagaagtcgcgctataatatccccgaaagaacggcacaaatggggccaactggcggcgctgtgacagaatttccccgggtcagcgggccaggctgggctggcggtgccggaccgacgcggaacaggagggcgatttcatgtcaaaggatattctatctctcatcagcagtaaaatgaacaccttttccaaggggcagaagctcattgccaactacatcctgtcctcctacgacaaggcggcgtttatgacggccagcaagctgggcaagaccgttcacgtcagtgaatccaccgtggtgcgctttgcctcggagctgaagtacgacgggtatcccgccatgcagaaggccctgcaagaaatgattcggaataaactcacctctatccagcgcattgaggtgaccaatgacatcatcggcaaccaggacgtggtctccacggtgatgcagtcggacatggaaaagatccggctgaccatggaggagattgaccgggacagcttccaggcggcggtggatgccattgtcaacgccaaaaagatttacattttgggcacccggtcctcgggctctctggccgggttcatgtccttttactttggcctcatgtttgacaacgtggtccatgtgggggagagtgccaaccaggaaatttttgaccagatcgtccaagtgggccacggggacgtaaccatcggactgtcctttccccggtattcccggcggacggtccgggccatcaactttgcccacgagcggggctccaaggtcatcgccatcaccgacagcgcctccaacagcatggccaaggcggcggactatgtgctgctggccaagagcgacatggcctcctttgtggactccctggtggctcccctgagcctgattaactccctgctggtggccattgcccggagtaagtccgacgtggtggaccactttgagcggctggagcacatctgggaggagtacggcgtattcgtcagcatggaggaagagaaccaatgacgcagacccctgtggtggtggtgggcggcggcgcggcgggaatgatggccgcgctggcggcccgccgggccggtgcggcggtggtgctcctggagcccaacgagaagctgggccgcaagctgtacatcaccggcaaaggccggtgcaacctgaccaacaacacgacccccgagggcgtgctggcgcacgtgacccgaaacgggcgctttctgtacagcgcggtgacccggtttccgccggcggccgtgatggaatattttgaagccttgggcgtccccctgaagacagagcgaggggggcgtgtttttccctgttcagaccgggcggccgacgtgatcgacgccttgttttttgccctgaaaaaggagggcgtggtcctgcgccggggcaaggcggaggaactgcggctggcccaggggcgggtggttggcgtgtccctgggggaggagagccttcccgccggggcggtgatcctggccaccggcgggctgtcctaccccgccaccggctccacgggggacgggtaccggctggcccagtcggccgggcataccatcgtcccccccacgccctctctggttccactggaggaggcgggggacacctgcgcgcagatgcagggactttccttgaaaaatgtgaccctgaccctgaaaaatcaaaagaaaaaagtggtctttcaggagcagggagagatgcttttcacccacttcggcctctccgggccgctggtgctcagtgccagcgcccatgccaactggagcagggatacctacaccgcagtgcttgacctgaagcccgccctggaggaggagaagctggaggcccggatactccgggacatcgcccaggcccccaataaggccttccacaattttttggagggtctgctgccccggcggatggtgccggtgatgggcgcgcgggtggacattgccccggacctgccggtgaacgccctgaccaaggcccagcgccggcggctggtggaggccatgaagcactttgccctccccctggcggggccccggcccatccgggaggccattgtaaccgccggcggcgtcaaaacgggcgaggtggacccggggaccatgatgtccaaaaagacggcggggcttttcttcgcgggagagattttggatctggacgcctatacagggggcttcaacctccagattgcctggtgcaccggccgggcagcgggagagggcgcggcccgatacagcaaggaggaacgggaatgagaccctttcgcagcattgccattgacggcccctccggggcagggaaaagcacgctggccaaggcactggcggcccgtctgggctttttgtatgtggataccggcgccatttaccggacggtggggctgtatgtggcccgacagggaggggactgcggggacccccagcaggtgctgccccggctgccggagcttcaactctccctgacctatggagccgacggccttcagcacatgctgctggcgggggaggacgtgacccaggcgattcgggagaaccaagtctcccggtatgcctcccaggtttccgcctaccctgcggtccgtgccttcctgctggagatgcagcgcaacctggccagaacccatgatgtcatcatggatggccgggacatcggcaccgtggtcctgccccaggcggacctgaaaatttttctcaccgcttccgtggaggagcgggcccgccgccgctgccgggagctgcagccccggggggcccaggtggacctggcgaccatccaggcggagatcgcccagcgggactacgcggacagccaccggtccgcagcaccccttcggaaagcggcggacgcggtggtggtggacacctcccagatggatcgggaggagagccttgcggccctgattaccctggcgaaagagaggttaggcctgtgaccctttacgaatttgcctatattgtcagcaagatgattttcagcattgtcaccttccgcacgccactgaaggcctacggaaaggaaaatattccggccgggggcgcggtgatctgttccaaccatgtgcataattccgatcccttttacatcgtctactcctttcaccgaaaggacaagatatggattatggccaaggaggagatccgtcattaccccgtggtggggcggctgctcaactggctgggctttgtcatctgggtccggcgggggaagtcggatgtgggggccatcaagtctgccctgaaagccctcaaggggaaggagaagctcctgattttccccgagggtacccgccatgaggagatcggggaggggaagaccggagcggctatgatggccattcgcactggggtccccgtgctgccggtgtacattgccccggaacggaccccgttccaccggaccaaggtgtacattggggagccctatcagccctttacagagaaccgccgggccacagcggaggactatgaggcggtgacggaggagatcatggaccacatccgggcggtccgggaccgccgggcggaaatggaggcccggggatgaggaaggtccttttggccaagtccgccggcttttgcttcggggtccgccgggcggtgaagctggcccaggagattgccgagagcggcgcaccctatgtgatgctggggccggtgatccacaatgaccatgtcattgcccagctggcggcccagggggtgggctgcgtgtccagcctggaggaggtgcccccgggctgcggcgtcatcatccgctcccacggggaggggaaggaagtctatgacagactggcggccatgggctgtcccgtggcggatgccacctgtgtgaaggtggccaaaatccatgagattgtgaaggacgccagcgaccgggggcggcaggtcatcatcatcggcgccccggagcaccccgaggtccgggccatcgcaggctggtgtattggtgcgaaaatcttccgaaatgaggcggaattgacggtttttctggaggaatggaaagaaaatccacaaaaacctgtgaccttggtttcacaaactacatcaacggatagaatttggactccatgcagagaaaaagtaaaaaaagagtgtacaaacgccgaaatctttgatacaatatgtaatgctacgtgtatgcggcaatcagaagcgcagagtttggcggagcaatgcgaggcgatgatcgtcatcggtgatcggaaaagctccaacacgacccgtcttgctgagttatgccgggcacactgcccgttggtttaccacatcagccgggctgaggagctcgaccggaggaaggtgagcggggtagcttctgtgggaatcaccgctggcgcgtcgacgccggggtggataataaaggaggtcaaagacaaaatgagcgaggaaatgaacaacgctatggagatcgaagagtccttcgctgatatgctggagaagtcgatcaaaactttaaatacgggagacaaggtcactggtgtcgtcaccggcatcaccgccaccgaggtcaacgtggacctgggcaccaagcacgccggttacatccccatgtcggagctgagcgacgatcccgccgtaaagcccgaggacatcgtgaaggtgggcgacgagatcgagacctatgtcatgcgggtcaacgatgtggaaggggttgccaccctgtccaagaagcgcctggacagcgtgaaaaactgggacaccattgaggctgccgtagaggacaagaccatcctggagggtaccgtgaccgaggtcaacaagggcggtatcgtggtcaatgtcaagggcatccgtgtcttcgtgcccgcctctcagaccggaatgcccagaggggccgacctgtccgagatgatcaaggaccgcgtgaagctgcgtatcaccgaggtcaaccgttcccgccgccgtgtggtgggctccatccgcgctgttcaggcagaggagcgcgctgccaaggccgctgaggtctgggcaaacatcgaagagggcaagaagtatgagggcacggtgaagtctctgacttcctatggtgcctttgtggacatcggcggtgtggacggcatggtccacgtgtccgagctgtcctggagccgcatcaagaaccccgctgaggtggtctccgtgggcgacaaggtcaacgtgtatgtcatctccttcgacccggagaagaagaagatctccctgggtatgaaggaccacaacgaggacccctgggagaagtttacctccacctatgaggttggctccgtggccagcgtccgggtggtgaagctgatgaccttcggtgccttcgcggaaatcgtgcccggtgtggacggcctgatccacatctctcagattgccgaccaccgcattgagaagcccggagacgagctggcggaaggtcagatcgtggacgtgaagatcacggatattgattatgaccgcaagaaggtctccctgtccatccgcgccctgctcaacgacgcccgcgccgctgaggaaggggaagacggcgaggacgcctgagacagcagagaaccggcagaaacaaaacaaagaagggggaactgccgcaatgggtgggttccccttttttgataaaacaaaaagagcgggaagatgcctttttggggcatactatcctcgccaaaacaaagaatggaggacgtcattatggcaaccattaccaaagataccatcgtgggcgatatcctggatatcgcacccgagaccgcgccggcgttcattgacatcggtatgcactgcctgggctgccccgcctcccggaacgagactgtggagcaggcctgcctggtccacgaccagcccgtggaagagctggtggaaaagctcaacgcgatcatcgtggcaaaccggaagtgaaaccaaaaaacgggagcgggttccgctcccgtttttttgtggaagggagaatggaatgagacgattggagctgtcgccgcgcctggccgccatagccgaacaggttccccaaggggcccggctggctgacgtggggaccgaccatgcctatctgcctgcttggctcctgctggcggggcgcatttcaggggcggtggccacggacgtgcgggaggggcccctccagcggggccgggagaccgcccggctctataaggtggaggaccgaatggtcttccgctgctgtgacggtctggcggcggtggagccccaggaggcggacaccgtggtcattgccggcatggggggagagctgatggcccggatcgtagaacgtgccccctggacccgggggtgcacccttctgctccagcccatgagcgcccaggaggtgctccgccagtggctggtgacccatgggtactgcattcagcgggagaccctggtccgggagggagagaagttctacgggattctcacggccacagggggggagagcccggcgtataccctggcagagctctgggcaggccgtcagagacggggagaagtgtccccgcaccggctggcctatttggaggagcagatccgccggcgggaacgggcgctggc

SEQ ID NO: 2242 - DNA, 22619 bp, KLE1738
aaacccccgccgcaaggggagatggaaacagagcggaagcggctggaagagctgcggcagatgagggaggagtggagccaatggcaacagtaaaagatgtgtggaacctgctggaccggaaagcgccgttccgcacgcagatggactttgacaacgcgggctttctggtgggccgcggggaccagcaggtcacccgagtcctggtggctttggacatcaccccagaggtgattcgggaggcggcggagaagggatgccagctgatcctggcccaccacccggtgatctggggaaaggtggggcagatcaccgatgagaccgccaccgggcggaaggtgctggccttgattgagcagggcatcgcggccatctgcgcccacaccaacttggatgcggcggagggaggcgtcaacacggcgctggccctgcggctgggcctgagggaccaggttccgctggcggtggacggcaccgacgaagcgggcagaccctacggcgtgggccgggtggggcagctggaaggcggcccgatgactgtggaccactttgcccgtcgggccaaggagaccctggggctgtcgggcattcgtgttttggatgccggggttcccgtccaacgggtggcagtgggcggcggcgcctgcggcagtatgctgccccaggtccgggccatggggtgtgacaccttcctgactgcggacctgaagcatgacctctacctggaggcccgggaggcggggatgaacctgctggatgcaggacactactccaccgaggcggtggtctgcccggtgattgcccagtgggtgcgggaggcgtttcccgacctttgggtggaagtggcggaaaatcagggagaggttttcgaatatttctaaggagaagccttgtcaagtgggggctttctgtgatagaattgctacgttaaaaatataaagatgggaaccgcttcggctcccatcattcttatgataagaagggaacgatacctatgtcaggacattccaaatggcataatattcagaagaccaagggggctgcggatgccaagcgcagcgccgcctttacgaagatcgccaaggagatcatcgtggcggtgaagaccggtgggtccggggaccccaacaacaactcccgcctggccacggtaatcgccaaggccaaggcggtgaacatgcccaacgacaacatcaagcgcaccatcgacaaggccctgggcgcagggaacacggacaactatgagagcgtggtctatgagggctatggccccaacggcgtggctgttattgtggaggctctcaccgacaaccgccagcgcaccgcccctgaggtccggcacctgctggacaaattcggcaagggcttgggggccaccggctgtgtttcctggtcctttgaccgcaagggcgtgatcatcctggacaatgaggatggggacttggacgaggacaccgtgatgatggatgccctggactgcggcgcagcggactttgagccggaggaggactgcttcaccatctataccgagcccgatgactgcggcaaggtggcctccgccttagaggggaagggctatgtctttgcctccgcccaggtggaaatggtaccccagaactatgtgaagctcactgacgcaggggacattaaaaatatggagaagctcattgacgcgctggaggacaatgacgatgtccagaacgtctaccataactgggagcaggaatgattcctcctgggaaataaccaaatgacaagaaaacccccggcccatgggccgggggtttacgttttatttttctcgctgcgttttttccataaaaggtaggactcatattttttgaggtccgtaagttcctcaggggaaaattgctccagtctgcgccgctgttcgtagaccgggtctatgttggacaggcccaagaggtaatcggatgagacctgataaagtcggcagacgcgcaccaacatctcatgggaaggggcgcttttttcctgttcccagcttcgaatggcaaacacggagacattgagcttacgggccaggtcatcctggttgtctccgtgatcttttcgaatttcagctaagcgttctccaatcatatttatcacctcacccgaacagtatagagaaagaaaacattttttctggataaatcatattattcttgctaatataataattgagtggtatgattgctatcataaggaaatgagggaaaaaagtccccgttttctgcgattctatttaagaaagcaacggctggcggcccccagaagaaaccccatccttttgccgggagagggaggactatggggcggtatcccgttctgtgaaataaccgtacatggcgtagagcaactgtttttcctgctcggtcaggccatccaggtagatggcctggctattttgcagacccagcagatagtcggtggagatatgaaagagctgagccatggcaacaatatattgggcggtgggaatggacagccccatttcccaggcgttgaccgcagaacgggtgacaccaattttcttggccagcgcggactgagatagtccgcaggtatctcgtaaggttcgaattttatcgcaaatcacagtgttcacccctttggtgatattataatttgcgccgttcgatatgaaattatcaagaaaagtatagttttattgacgccgaaagacctgtatgccataatagaaaaacatgtgaaaggggattcctgaaagcaccgaggtgatttgtgggaaaagtctccagcaatgtttggtagtttctgccaatatgggtggattggttgtgagagccctctgcccgtggtagactattgccacgtagtaaagaggtgtttgatatgattgttggctatattcgcatgtgtacgcaggcggaggaccgggaccgggagaaagccctccatcagtggggggcggagaaactctattgggaaaaggacagcagccgaagctgggtccgcccggcctatgaggagatggccgccaccctccagccgggggacaccgtggtggtcagtgagtttcggcagttggccggcagcgcccgggatgttttgatactgctccatcggctgtacagtgccaaggtggagtttgccagcctgcgggagaatttccatacagccacagggcaggggcgggaaacccttcgggtcttgtccgccctggcagaaatggaggaggagcggatgctccgccgccagaaaaatgtggaaaaggccaaggcggccggccgctataaaggccggacgcccctggccattgacgaggagaagtttcgggcggtctgtacccggtggcgggcgggagagatgaccgctgtggcggcgatgaggctgctggggctcaagccgaatacgttttaccgacgggtcaaggatttgggcctgtaagccgccgaaaagatgttacacgaaaaaaagctggacgatccataggatcgtccagctttttgatggaacgaagggagaacttagtccagagagaagaggattcgggtgttggggtcggccatacggaccagcacggaagcgacctccgcccgggtgatgggggcattgggccggaaggtgccggcgtcgtcattgcccgagagaacccctgcccggtagagttgatagatccctttgtcggacttgtacacgtcgggaatggagccgtcgggtacgtcgttgaccgaggggagagcggagctgggaagggccttggccaggatggaggcgaactcctgccgggtgagcggggcattcatatcactgggaagggaggagatgattccctggctgatggcatagtcggagtaggccttgtaccatggactgctgttggcgaaggtgccattgcccgtcaagtacagcttgcgcagccgggcggccagggtaatggtctgggcggcggaaatttgcttgtcgggtttgaatttgttggtttcaatcccatccatcagaccataggagtaggccgcggtcacatagggataataccaggcgcgggaggagacatccttaaaattgttttgataggtcttgctcttgacaaagctgtggccgctggtgtcccatttggccaccagcgtttgtccataggtgcttttgagcttggtgccattggtgaccagttcctttcccacagcggtgtaccagcccaggaaggcggcatttttccgggtgggggtgggcaggtcgtaggtgctgttcttgctgaccagttccgcgccgggggagacgctgccgccgttggcgttgtaggtgatggtgaggtggttttcctttaccgtaaaggtctgataggcggagttggcataggaccagttattggcgttggtggattggactttgatccggtaggtccccgccggcagccgctccatggagtaaggggatttcgtatagaagtagtatcgatagttttcctgccaggagccatcgctgtttttccggtccacatagatattataatgggtggcgaggctgaccggagaccaggagacggagatcaggtccccatccccatagacggaggagagcttccccacttggggcgcagcgggcttggcaggggagctggggaggatggtatccttgccggagagattggccttgaaatagatcaggcccccgatggttccgtcgtactccgacaggagctttttggaggcggcgcctggatcgtagagctgggcatccccgcccaccgtccgggcgatgggaacgaaatggccgctgtttttcacccgggcgatgacatagtagccgctgttgagaagatcgttgatcttggtgaccacgtcggccagcggcgtggagacggagaaaaaggtttgattgacaaagtagaaccggggagaagaagtggaggtgatgcgcccaaaggagagcaatgcgtctttggagcggtctgaactgtgactgatgtagcctttggaatccagccagtcccggaacacaccggggttaaaggtggacggatcataggccccggagtggcacatgaggatggcgatggaggtgaccagacagccggagccggccatggtgtgcaggtccccgagagcggtgttcccccaggcggaatctccctgccgccaggtggtataatcggtgctgtatgttttgccgttgtaggttgccgtcccagccgcccgggccaggggggcggggagaaggctcaacgccagaaccagggccaggacaccggaaagggctcgtttttgtttcacggtggagtacctcctttgcacgaagtcgggagagggaatctttcccatcagtattacatagatttgccaaaatgtccagacaatccagggattttccagaatttagcgtcaaaaggacagaaaacaccccggatcagccccaaagactgatccggggtggagaagaggcggggggattactttaagttgaagaatgcgtctttccccagatactgggccacgtcatccagttcttcctcaatgcggagcagctggttgtatttggccacccggtcggtgcggctgggggccccggttttgatctggccggcgttgagggccacggccaggtcggcgatggtggtgtcctcggtctcgccggagcggtgggagaccacggcggtatagccggcccggttggccatctggatggcgtccagggtttcggtgagggtgccgatttggttgaccttgatgagaatggcattggccacacctttctcaatgccggtcttcaggcgctgggtgttggtgacaaagaggtcgtctcccaccagctgaacccgggaacccagcgtcttggtgagcagggcccagccctcccagtcgttttcccccatgccgtcttccagggagataatggggtaggtgtcagcgaactttttccacatgttcaccagctgctggcgggtcatggttttcttggctttgggcaggtcatagcagccggtttcctcgttgtaccactcggaggtggcggcgtcaatggcgatcataaaatcctcataggggcggtagccggcggcttccacggcggccacaatggccttcagggcatcctcgtcctttttcaggttgggggcgtaaccgccctcgtctcccacgccggcggcgggggtgccgttctccttcagcaccgttttcagggtatggaatacctccgcgcacatgcgcagggcgtccttccagctcttggcccccacaggcatgaccatgaactcctggatgtccacattgttggtggcgtgggcaccgccgttgaggatgttcatcatggggacgggcagggtcttggcgttgactccgcccagataggtatacaggggcaggcccagactctcactggcggccttggcgcaggccagggaggcccccagaatggcgttggcgcccaggcggctcttgttgggggtgccgtccagcgcaatcaggagcttgtcgatggagggctgatccaagacgttcaggccgatgagagcctcggcaatgtctttgtttacatgctccactgcctgggacacgcctttgcccagatagcgtccggcgtcgccgtcccgcagctcacaggcctcatagatgccggtggaggcgccggagggtactgcggcccggcccatggtgccgtcgtccaggtagacctctacctccacggtggggttgccccgggagtccaggatctcccggcccagaacgtcaacgatttcgatcatctgcttcatgttcatacgctccttttgctgtgtttcccataacccgcccctgtggggcggttagttgataataagagttttgccgtccatctcttccggctggttcagccccatcaggtccagcatggtgggggcgatgtctgccagccggccgtcccgcaggcggaccgcggcgcccacaatgcagaaggggaccgggttggtggtgtgggcggtgaagggctggccgttctcatccagcatctggtccgcgttgccgtggtcggcggtgatgagggccacgccgcccaggtccgtggtggcattgaccacccgggccacgcaggtgtccacggtttccacggcctccacggcggcctcaaagacaccggtatgacccaccatgtcacagttggcgaaatttaggataatcacgtcatacttgccgctctcgattcgccggatggcctcctccgtgatggcgggggcgctcatctccggcttgaggtcataggtggctaccttgggggaggggatgaggcaacggtcctccccggggaagacctcctcctgaccgccattgaagaagaaggtcacatgggcatatttttccgtctccgcaatgcgaagctgggtcaggcccagtttgctgagatactcgccgaagatatttttcagcttctcgtgggggaaggccacggagacgttgggcatggtggcgtcgtactctgtggtgcagacgaaatgcagggggagaaacccacgcttgcgcttgagcttatcaaagtcggggtccaccagggcgcgggtcagctcccgggcccggtcggggcggaaattgtagaagatgaccccgtccccggcgttgaggcggccctcccgggtgcagatcaccggctccatgaactcgtcggtgattccctcgtcgtaggaggactgaatggcctccagaggatcatcgaaaaagtgccccgtgccattgaccatggcgtcataggcccgctggagccggttccagcggctgtcccggtccatggcgtagtaccgtcccatcacatcggcgatctgtccaatgcccagggcctgtattttctcctggagttggcggacatagtcccgccccgaggtgggggagacatcccgtccatccaaaaagacgtgaatatagagctgttccaaaccgtgacgtttggccagctccagcagggcatacagatgggtgatgtggctgtggaccccgccgtcggagagcagacccatgagatgcagggcgctgcctgtttccttgcaggcctgaatggcctccaggtaggcggaattctcgaaaaaggtaccgtcctcaatggcgtggctgattttgggcaggtcctggaacaccacgcggccggcaccgatgttggtgtgtcccacctcgctgtttcccatctgcccgtcgggcagccccacgtcaaggccggaggcctccagctggcagaagggatactgggaaaacaggtaatccagctggggggtggcggcggccagaaccgcgttgcctgggatttcctcgcccaaggcgaaaccgtccatgatgataagtgtcgtcggagttttcataaaacctttccctcgctgcccggagccggagctccgggccagtgtcttgtcagtcttggttggcggtctgaatgatttggaggaatttttccgggtccagggcggcggtgccgatgagaccgccatccacatcctcctggtggagaagggcttccgcattggtctcgttcatggagccgccgtactgaatggtggtggaccgggcgatccgggcgccatagagcttgcgcagcacgccccggatggcggcgcagacctctccggcctgctcgggcgtggcggtgttgcctgtgccgatggcccaaatgggctcataagcaatgaccacccggcgcatggcctcagggctgaccccggccagggcggccttcagctggtaggtgatgaactccagggtgacacccagctgccgctgcgccaggtcttcccccacgcagagaatgggccgcaggcctgcggccagggcggcgtgaatttttttgttgatgatgaggtcgctctctccgaagtgggcccggcgctcgctgtggccgatgatcacgtacttcacgtccaggtcggccaacatggcggcggagatctctccggtaaaggggccgctggcctcccagtggaggttctgggctcccaccgccacccggctgtccttgaggagcttgacggcggcgggaatgtccacataggggacgcacaggacgatgctgcaccgcttggaccggggcagggcgcccttcagacgctcggcaaagcgtttggtctccgtggcggttttgtgcatcttccagttgcccgcgatgatggtcttgcgatattttctgttcatgaatccgcgttccctccggcctgttccttgtctgccaggcaggcgatgccggggaggacgaggccttccaggaattccagagaagcgccgccgccggtggagatgtgggagagctgatgggccagacccgtctgttccaccgcggaggcggagtcccccccgcccacgatggtgacagcgtcggcttgctgggccatggcggcggccacggcgcgggtgccctgggcaaaggcggggaactcaaacacgcccatggggccgttccagatgaccgtgccggccccccggatggcgtcggtgaacagttggatggttttggggccaatgtccatgcccatcaggtcttcggggaagttctgggcgtccaccagcacaggcgcggcgtcgggggagaattccttggcggccaggttatccaggggcagcagaaggttcacccccagctgggatgcctggtccagcatctgccgggcgtagtccacgtggtcagcgtccagcagagaggtgccgatggggcggccctgggcggccagaaaggtgtaggacatgccgccgccgatgagaatggtatctgccttctgaagcagatttttgatgacgccgatcttgtcggccaccttggccccgcccaggatggccaccagggggcgcttgggggcttccaaggcagcgcccatgaactggagctccttctccaccagcaggccggccaccgagggcagatagtgggacaccccttctgtggaggcgtgggcccggtgggcggccccgaacgcgtcgaagacaaacagatcagccagcgaggccagttcccgggagaaatcggggtcgttctgctcctcctccaggcggaaacggaggttctctaccagtaccacctgaccaggctggagagcggcgcacttttccttggtgtctggtcccagcacgtcttgggtcagagggacgggaatgcccagcagcttttccaggtggtcccgggcggagaacagggagagctcctttttccactggccgtgggggcggcccatgtgggagagaagaatgaccgcggcattgtgctccagcagatagcggatggtgggcagtgtggacacgatgcgggtgtcatcgtgaatgatcccggtggttttgtcgtggggaacgttgaaatcacagcgcaggaggatctttttcccggatacatcaatgtcccggatggtcttcttgtcataattcatcagaaaaaagccccttcttttcatttttgtcggcgggtcgtccgggttccactccggtccggcggcggttccgcggtgtcgggtcagaaccctgcaagagaggacggcgctgccttccgatctccttccccgcacagttgggggaagcccagctggcggagtgcctcataggtgagaacagcgacagagttggccaggttcaggctgcgggcctccggccgcatggggatgcggaggcaccggtctggatgggcctgccggaaccacaggggcaggccggcggtttccttgccgaaaaagagccagcatccgtcccgaaactgggcctgggcgtaatcccgcggtgccttggtggtggccagccaaaggtccgtaatctcgtttttgtgaaagaggtcctctatgctatcatagacgcgcaggtccaccatgtgccaataatccagccccgcccgcttcactgcccggtcgctgatgtcaaagcccagggggcggaccagatgcagacggctgcgggtggcggcgcaggtgcgggcgatatttcccgtgttcatggggatttccggttccacaagaacgatattcagcatgatatccttcgcctcgatcctgacaaactgtcgtgatgatacagcctgcattttactgcaatacgggaaaaaattcaatataatcccgcaataaaccgataaaaagggaaaaattaagcggtttcctcaaaatggagggagcgtttctggtaaattcagcttgtcgcacaaaagggaagggggaaagaaatgcaggaatcccttcttttttgggaaaatgacggaaagcggccgggtggggagagggccttgtgttttcgcgcggtttccactataatggagcggaaaaaagacaggcggtccgggggcggaacaggcccggccgggcgaacctgatccgggtgtaagcccgaaagaaaggaatggtcaacaccatgaaattaggcatcgtgggcctgcccaacgtgggcaagagcacccttttcaacgccatcaccaacgcgggggcggagtctgccaactaccccttctgtaccattgaccccaatgtgggcatggtcacggtccctgacacccggctggacaagctggccgagatctaccagcccaagaagaagaccccggcggtcatcgagtttgtggacatcgccggcctggtgaagggggcctccaagggggagggcctgggcaacaagttcctggccaacatccgggagaccgacgccattgtccacgtggtgcgctgctttgacaacgacaacatcatccacgtggagggcagctgtgaccccgcccgggatattgccatcatcgacctggagctggtcatggccgacctggagatggtggagcgccggattgacaaggacaccaaagcgggcaagggggacaagaagttcctccactcggcggaggtcttcaagggcctgcgggactggctcaacgaagggaaatccgcccgcagctacccctgtgatgaagagacccgggaaatcctccacacggccgacctgctcaccctgaagccggtgatcttcgccgccaacatggacgaggaggggttcaagcaccacgacgggaacccctattaccaggcggtggtccaggcagcccagacggaagaggcccaggtcatccccatctgcgccaatgtggaggcggacattgccgccatggacccggaggaccgggcgctgtttttggcggatttgggggtggagcagtccggcctggaccggctgatccaggccagctataccctgctgggtctcatttcctacctgacctgcggggaggatgagtgccgggcctggaccatcacccgggggaccaaagcccccaaggccgccggaaaaatccacactgattttgagcggggctttatccgggccgaggtggtctcctttgccgacctggaggcctgcgggggctccatgaccgcggccaaggagaagggcctggtccggtctgaggggaaggaatacgtgatgcaggacggggacgtggtcctgttccggttcaatgtctgagagaaaatccgtgctcatcaccggagcctcccggggcatcggggcggccactgcccgtctgtttgcccggcagggttatggggtgggaatccactaccacactgcccaggccagggcccaggccctggcggaggagctcagggagctgggggtcccggtgggcctgtacccctgcgacgtgtcccgaccgggggaagtgagggagatgacggcggcctttctccgggattttgacaccttggatgtactggtatgcaacgcgggcattgcccggcaggaactgttcacggacatcacccaggcaggctggcgggagatgctgggggtcaacctggacggggtgtttcactgctgccaggcggccctgccccacatgatccatcggaagcagggaaagatcatcaccctctcctccatgtgggggcaggtgggggcctcctgtgaggtggcttactccgccgccaaggcgggggtgatcggcctgacccgggccttggccaaggagctgggcccctcggggatcaccgtcaactgcgtggcgccgggggtcattgacacggagatgaaccgtcagctctcccaagagaccaaggccgccctggcggaggagacccctctggaacgcctgggcaccccggaggatgtggcccaggccatttggtttctggcctccccggcaggggattttttcaccgggcaggtgctctcgcccaatggcgggtatttgatctgaggacaagaatttagaaattgttcatattttccagtagattctgacgggacatcagcgtatgctaaaggggaatggaggtggtatggttggccaatcacaacgcccatacttacttcggcctccaggtgctggggcagctgcctccagacctgcgagaactctgcaccgaggatctaccggtgttccacctgggcctctatggtccggacccgctgattttctccctttggaccaagaaaatctctgatcgtctccacaagcggtggcgggaggagtctctgcctgacttgaccgatgccattcagacgggaagccccacggcccgcagctttgctgccggctatatcctgcaccacatgctggacgacacggttcacccggtgatctatggctggatggaggagggctcctcccatttccggctggagatcgctttggatttgcttctcctggaagaaaagcgccgggccaattcccccaagctgcacaccgagggaaaggggcgcaccgcggccacggcggaatctgtgctcaagcccatgggggcccggcagtatctggccggtctctggcgcatggccgcactcagcaactgtttctgcgggcccggccggcccgcgacaggcggcatccgcgcccgggaaaaggtacaggcccgtgagcttcgggaccggatggaggcgcagattgccccggcggcccaggagctggcgggaattttggtacggacgacaagtagataagggcaagaaaaaccacgccggttctggaggacaaaccagaaccggcgtgattcttttcgtggaaggggggagccatcccattaagaggggcgcatgggcaggcgcagctggcagaggaaggtttccccctggaaaaaggtggcttgcccgccgtgggccgcggcgatctgggccaccaattttaacccggttccgtgggctgggccaccgtcctcctcctggtacagtggtggggcaggggcatcgggggtggtgttttccacccagagcaggcatgccttgcctgtctgccgggcccccaggcggatgacagcccccggggggttgtgccggacgcagttgatgagcaggttgttgagggcccggcgaaggagaaactcgtcggcttccaggctgggcaggggctggtccggcaggtccagcgccagggagaaaccctccgccaaaccgctgttgagaaaatccgcggcggtttggcgcaggaagggggccaggtccagcttggttttccgaagggcctgcatctggcagtccagacgcatggtgaggttcaggtcgttgaccaggtctcggatggtctggctctgccggcggatgatggcggcctggtcccggcgggccgggggcagggcggagtcggcctccagctgtcccgcatagcccatgaccatactcaagggggtacggatgtcgtgggagatgccgttaatccagtcagaccgggcttcatcccgggcctgctggtcctgccggaaccagcggcgcagcagaagggcggccagggccagcacgcagatcagggagagaaagaacaggagcaccccccagacaggcagcaggtggaggatttgctccgagagggagatggtgagcttccaggtgcttcccttgggcgcgcctgccaccagcagaccgtctggacggatgcgggtctggacggggtaatcctccaggtaccaccgggtaaaggcggcgacatccagcaggtcgtactggtcagggacctccgccggcttgttgtactgccacaggacctgaccgtcccgtccgaccagcatgagccagaggtcctgctgtgccaaaaggtcctctcctgtgaagtgatagcggccctcctccagaaccagggactgggagagctttgtcagaggggcgttccagaactgggtgatctgggcggagcggaggaccagggccaggagaccggccaggcagagggtcagaatcaggatggcggagagggccaccaatccggcggccttccagaggtgctttaacttcatggggctgcctcccgcaccagacggtagcccaggccccggacggtgagcaggtgcttggggtgagaggggtcggcctccagcttctcccgtaggcggcggatgtggaccatgagggtgttctcatagcccaccatgggcccctcccacagggcctgacagagggcgtcgatggtgacaatgttgccgtggttctcccagagctttttcagcagggcaaactccttggcggtgagggggacctcccggccatcccgccggagggttcccgtcccccaatggacctccgtgccgcccagccgggcgggctcctcctcggaggcggcgcggtacacccggcggagcactgcatgcagccgcagcagcagctcctgggccagaaagggtttggtgatgtagtcgtcggcgcccagtcccaggccccggagccgggcctcgtcctcatcccgggcggagagaaagagcaccgggacgtccccctgctgccgcagctggcccagcagagagaacccatcgccgtcggggagcatcacgtccaggagaatggcgtcgggatggacctgggcccgctgggttagggcctccctgcagctgccggccaggcagacggcgtagccggcctgggtcaggatttcctgcaccatcatccggagggcgggttcatcgtccaccaccaaaatctgataagccattgaaatacacctcctattgttcttaatagtataacggatttccggggtatttccagccaccttgggaaaaaagtaaggaaatcgtaaggtggccttcatggggctgtaaggcgggcgcggtattctttgccctgtaaggaggtttgcgctatgccgatcattgaaaccagaaacctgtgcaaacgctatggcacggtcatgcgggtgaccaacctggcccttcaggtgccggaggggagcatttacggcttcctggggcccaacggcgcggggaagtccaccacgctgaagatgatcctggggttggtccgccccacccagggggagattcaggtgtttggccagcccatgaaccggggcaaccggattgccgtgctgcgccaggtgggcagtctcattgagagccccagctattacggacacctcaccggggaggagaacctgcggattgtgcagaccctccggggccttcccccaaaagccatccgggaggtgctggagatcgtccggctggaggggcagcgggggaaaaaggtctgccactattccctggggatgaagcagcggctgggcattgccacggccctgctgggctatcccaagctgctgattttggacgagcccaccaacggcctggaccctgcgggcatccaggagatgcgggagctgatccgagacctgcccagccggtttggcatgacggtggtggtctccagccacctgctcagtgagatcgaccagatggccgacaccgtgggcatcatccgggagggggtgctggtgttccaggacaccctggccgccctccatgggcgcagccgccaccatttggccctgcgaaccaccaacaatgcgctggccgcccaggtgctcagggagaagggcatcggctggacggaggagggggactatctggtcctgcccattctcccggacgagcaggcggccgggctgtgccgggctctggtggagggacgcctggggctggtccgcctggaggagcggcagaagagcctggaggacatcttcctggagctcacagggggaaaggaagtgagcctatgaagctgctgcggatggagtttttcaaatgccgccggagaaagattgccctgatctgtctggcctttgtggcggtgcagctggcgtggatgggccgcaccttgacccagatggagccgggggaattggcccagggctggatgtccctgctgtataacctggcggtcatcgacgcggtgatgctgcccctcaccatcagtgccctggccagccggaactgtgagctggagcacaaggggagcacctggaagctctgggagaccgtgaccacgccgcagcggctgtttggggccaagctggcctggggagcgattctggtgggcggcatgctgctgctgcgcacggtgctcctgagcctgttggggctggccgtggggtttccgacccagatcccctggggaaagctgctgctttcctttgccctctgctttggggtgagttttgtgatctatgccttgcagcagggcctgtccctttggtttgtcaaccaggcggtgccgctggcggtggggattttcggcagctttgtggggctgtttgccctgttttttccccagtgggtccagcggtgcgtcatctgggggtactatggggtgctgatccaggcgggcatgaactgggacccggtcacccgggccacggagttttactgggtccagacccggcccctggaattcggcctgctggctctctggatgatcgtcgtgctggcggtgggccggggcctgtttgttcggaaggaggtatgaaaggtgctgcttcgtgcattgcgcagtgagggaatgaaatgccgccggagcccggtgtgggcggtctttctggtcctgccgttgtttcctgcgattatgggaaccctgaactatctgggaaacctggagattctggacaatggatggtacagtctgtggagccagcataccatattttccgccagttttttcatgccggcgcaatttggtgtgttttgtgcctggcagtggcggctggagcacacggatcacaactggaacagcctgatgaccgccccggtgccggtgcgggacctctactggagcaagtttctcctggccgccggtgtggcggtgctggggcaggtctgcattggggtactgtatctgcttagcggccagctggcaggggtgtccggcgggctgccccttcagctggcgggctggatgttcttcggggccttggggggcatggcggtgtgtgcggtgcagcttttcctcagcttggtgatccgctccttcgccccgccggtggccctggggctggtggggggtattgccggcctggtgatgaccagccagggggccggactgtattgcccatattccctgctctgcttgggcatgcgggccaataaccccaacctctccctggaggtgggaccctttgtgctggcctgcggggtctgcatcgccctcttttccttcctgaccatccgctgcatggccgggcgggatgtgaccacgggataacggcaagcgcccctctgatccagaggggcgcttgcacgctgtgatgttaaaatgtgacgccggtatagagccaatccacgcagatggaggttctggcccccagcttagaggagaaggtgcggacctcacacatggaccaaaggctggtgctggggtcctgctgccggagccggatccagtgcatttcttcggactgatcgtacacgatgtcgtctatcacagtcctggtggagattttggtgttgtcgagggtctgtacctccactgcgcccagaccgccgtaaatgctggtccgtcggacatctgccagcacgggggcggcggtgtctttgggccggagggagagccgaatggttcccaccccggagtattccgccgtgaggatcagattttccaggggaacctccagggaactgccggcaaccgagaggtttttattatagaccttcaggttggagcggaggtttgggctgacgatctcctgggtgtcgtcggtgaactttaccttataggtggtgggggtgtcctcttccacagtgattttgggggaggtgccggggtcgccttttggaccggattccccttggggacctacatcacctttctccccctgggggccgatcccaccggtctcgccctggggacctgcctcgcctttctcgccctgggggccggtttctccctggggccctgtgggccccacggggaccacgaaggccagagagatgccggtctctgtgggggtagcggtgacctggggaatgtcaccggcggtgacgctgcccacggacaccgtgggcgtggcgccggtcagaccctggggtccggtggcgcccaccgcgccctgggggccgggttcaccctgttctccttgggggcctgcttctccctggggccctgtgggccccacggggaccacgaaatccagggagattcccgtctctgtggggacggcggtcacctggggatctgccccggcggtgacgctgcctaccgccactgtgggcgtgccgccggcggggccttggggaccggtggccccgggttcaccctggggaccgcgtgcgccggtttctccttgggggccggtctcgccctggggccccgtggggccaatggggaccacgaagctcagggaaacgccggtctctgtggggacggcggtgatctgggggtcctcgccggcggtgacggtgcccaccgaaaccgtgggggaagcgcctgtggggccctggggaccggtttccccctgtgcgccctggggaccctggatgccttgcggacctacttccccttgggggccggtggggccgagcgggaccacaaagtccagggaaatgccggtctccgtggggttggcgatgacctgtgggaggtcgcccagctgcacggtgccgactgccaccgtaggggtctccccccgttccccttggggaccggtctcaccgcgctccccttggattccccgttctccttggggcccctgttcgccctgggggccggggcagcccatttccccctggggtccctggggcccccgcacaccggcatagccctgctcgccctggggtccctgttccccggcggggccccgttctccctgctcaccgcgctctcctctcggaccggtggggcccatggggcctgcatcccctttgggccctacgggtcctcggtctccttgggggcccatgggcccggggtcacctcggggtccctgcggtcctacggcgccagggtctcccttcggtcccatgtcgcccctgaccccttggggtccccgggggccctgcgggcctgccattccccggggaccgatggggccggggcacccggtgtctcccttgatgccctgttctccctggggaccttgttctccccggggaccttgcggtccctggagaccggagaccacttgctcctccgggagagggttggggtagcagtttttgtaatagttgtatccataacaattcatatgagcttcctcccgcgcaaaagaatgagggctgcaaggccaaggctacgatttccctttggaggtggtgtcattgtcatagagccgttgactttgcgttccaaaatagaaagcaatgaccaccgagaatatcgtaagaaaatcctgaccggagacccgattggtgatggtcaggtatccaaagaccagggtgagcagaatggtgacaatgcttttgacgcagagcagattgctcagacgagtgagaaacaaatcctatcttgcctccttttggcatgccatggatcgtggagatcacagaggaatctcgaaccgctgccattctatgcctggagagcgggcttggtgcgtggactgggggagagaggacggctttcccgctctttgcaggggaaaataaaaaaacagtgtgttcttgtaaaataagaacacactgtttttttggcacgccaggagggactcgaacccccaaccctcagaaccggaatctgatgcgctatccattacgctactggcgcatagcaatcttaacttgccaagttattatagcaggggagacgggaattgtaaaggaaaattttgacgaatttcaaaagaaatttttagggagaaattttggaaaaaagacagaaggggacttgctcccggcagggttccgtgatagagtgaactggtaaaattggcgttttggcgcccatggaaaaccgaaaggagaattgaaccgtgagcttttcgttccacgttcccaccaacctggtctttggccagggcgcgatccagaagctgcacaagcagcgtctgccgggcaagcatgccctgatcgtcatttccagcggcaaatccacccgggccaacggctacctggacattgtgcaggaccagctgacccaggccggggtgacctacaccgtgtttgacaagattttggccaaccccgtcctggacaatgtgatggacggcgcggcctgcgcccgggccaacggctgtgactttgtcctgggcctgggcggcggcagcagcatcgacgcggccaaggccattgccatgatggcccccaatgagggcaattactgggactacatgtacggcggcaccggcggcggcaaaaagatgaagaacaagcccctgcccattgtggccattcccaccaccgccggcaccgggacggagctggatgcctggaccgtggtgaccaacgaggaaaccaaggagaagatgagcggcggcaacaagaacaccttccctgtcctctccatcgtggaccctgactttatgctctccgtgccccccaagtttaccgcttaccaggggtttgacgccctcttccactccacggagtcctacatcaacaacaccaataacctgatgcgggacatgctggccctgcgggccattgaggccgtgggccggaacctggccaccgcctgccaggacgggaagaacgtacaggcccgggagcaggtggctttcggcagcagcctgtccggcatggtgatgagcgtggacaatctgtgctccgagcacgccatggagcatcctctgtccgcctattaccacgagatcgcccacggggccgggctcatcatgctcagccgggcctactatacgcactttgtggagcactgcccggagcttcacgaccggtttatcgacatggccaaggccatgggcaagaccgacgccaaggagcccatggactttgtgaccgccctggtggacctgcagaaggcctgtggcgtggacgagctgaagatgtccgactacggcattacgccggaggagttccccaaatttgtggacaacgcccggagcaccatgggcatcctgttcaagctggaccgtctgaagctcacagatgaggacctggtgaaaatttacaccgaatcctatcggtaaaccagctggggcgcatctgtactcccggtaaaaaccgccccttccgccgcagttgtgcgcggcggaaggggcggttttggttattctggccgggggaccaggtcttccatccccagggtggccaggacagcctgggcccgggccacgccctcctgaggcagccgcaggggaatgcggccttgggtatcctggagcagcccctgggctttcaggtcctccagaacctgaaagtcataccccttccagcaccggcggccggcggggtcgtcatggtcctggagggaggtgagatagagcaaagccagggtcagttcctggagctgctttggggatctgtccatgggaagcctcctttcttctggagaaaaggg

SEQ ID NO: 2243 - DNA, 27515 bp, KLE1738
cvggtaccctttgggagaaggcagagaggaaccgtttggtttcccgctttctcctcccgtcaacaaaccacttctcccgcccgcccgagctggtgggcgggccatgaggcgttggtcttggaggccgcaggccaggtaggccgacagaaaacccacgccgcttctacaacagtccagagaaaaggggtgtgggggaaagaaactctttcccccgcggggtccaggggcacagcccctggtgctcttttccccatttctccagagaaatggggccccgcccgggagggccaagttcccgcctgttccaacggcgtgaggaaagccccccgcagcgtcgccggaaaagccaaaaaccatccccgccgagcgccctcacaggcccccgcagggatggtttccgcagaaaaacaagggggatcagtaccccaggtcctcccccaccaggcacaccagggtctctcccaccccgcccagaggccgccacagcaccgacagcccgttgcagatgcgctcggggctgcggcagtcgtaacatcgcagcgtctccccctgggcgcagggggtcttgcggtgcagccgccgggcgttcaggggggcggcgatgttccgggcccgccagagggcctgctggaaggtgggggcgattttgttgcgccccaccaggtagcacaccgtctcgtgggcgccggcggcggcggagattcggttgccggtgccgtcgatgttcaccagctgaccggtctcggccagggcgttgacgctggtgaggtagacctgggccttggcggcctgggccagggtctccgggccgggctgctgccagtgccagtagaccgtgccgcgctgggacagggcctcatacaggcccaggtcccgcagggtcacgctgccgcccatgccgatggttttgccggcaaaccgcgccaccagcgcctccttggccgcctgggccgtgggaaaccactggacggtgaagccggcggcttccagggtcttttgtaaacgggggatatccatagaagggtttctcctttccaaggtaacgtctgccctgatgataccatgggagcgggcagaagggcaaggggcctcacacctcggggagggagaacttcttgcggtagtcctcatagtattggtcaaagctgtgggagcggaccttcttcaagctgatgaggtactcgtgggtgtcaaaggagtccgactccagctcgatcatggccacggcgaggttggagcagtggtcggccacccgctcatagttggtcagaaggtcgttgaagacgaagccctgggtgagctggcagatcccccgctggagccggtccacgtggtggagcttcatctcgtcgcacagggagtcgatgagctcctccaggggctcgatccggtaggccagctccaggtccccggtggtgaaggcggtgatggcgttgtaggtgatctcctggacggcggcgaacatggtgttcagctcccgggtggcctcctcggagaagacgatgttcttttccgcgatctccttggcacactcggcgatgttcatggcgtggtccccgatgcgctccacgtccccgatggcgtggaggaacttggtcacgtccttgttctgctgctcggagagctccttgccggtgagcttaatcagatagctgcccagcttgtcctcatacttgtcgatgatgtcctcccgctgggcgatgaagtgaaactgtttctcctggtaatttccaatcaggtagtaggcgtcctccaggttggccttggcctccagggccatgttgcacagggcctggcggcactgctcaatggccacggcggggtgctcgatgaagcgggcctccagccgggcaaagtcctccttctccgggccggcgggctcggtgtcccggaacagccggcagatctgccgctccagcatgccgatgaagggggtgaggatgagcaccgtggcaaagcggaagagggtgttgaggaaggcgatgctcaccgcgctcatggtcatgtccaggaaggagaaatggagcagggcgttggccccatagaacaggacaccccagatcaccgcccccagcacgtcgatgagcaggtagacaaaggccgtgcgcttgccgttgacgttggcccccagggaggacaggagcaccggcatggccgcccccacggcgatgcccatgacaaggggataggccaccgagaaggtgatgacccccgtggcggccagggcctgcagaatgcccacggcggcggaggcgctctggagcacgcaggtgaagaccaggcccaccagaatgcccagaatggggttggagaaggtggtcagcaggcccaaaaaggtctcgctctcctggaggggggccacggaggagctcatggcctgcatgccgaacatgagcacggcaaagcccaggaggatgtcccccacatggcgcttggtttggtgcttgcagaacatccgcaggatgatgcccgccaccgccacaatccccgtgagggtggaggtggacagcagggagacccagcccgccccgccctccagagaggacaggcagatgatccacccggtgacactggtgcccaggatggcccccatgacgatgccgatggcctgcttgacctgcatcatgccggagttgacaaagcccaccaccatcaccgaggtggccgaggaggactggatgatggcggtgacgccggtgcccagaagcacccccttgagggggctgccggagagcttgtagaggaccagctccaatttgttgcccgccaccttcttcagcccgtcccccatgagggtcatgccgaagaggaagagggccacgccgctgagcagcgcgatgaggttggaaatgcccattcgcctcacgctccttttgtcgcataggatcggatgatatctccatgataaaaaagaaaggttaaatctaatctatggtttctgttaaatctgtgtaaaacgacagggttttgtgggatttgacaaaagggggaaggtccgctgccggggggtctggggctttttccgtccccgccggtctatcccgggccgaaggaacatagacatagaaccaccgaaatcagaaacacccagacggaggagacatactatgaataccctgacaagcatttaccaggacatcgccaagcgcacggcgggggacatctacatcggcgtggtggggcccgcccgaacggggaagtccaccttcatcaagcggtttatggagaccatggttctgcccaacatcaccgacgaataccgccgggagcgggcccgggacgaactgccccagagcggctctggccggacggtgatgaccgccgagcccaagtttgtccccgaggaggcggtggagatcgccatggaggggggcggggccttttccgtccggctcatcgactgcgtgggctacctggtccccggggcggtgggccagctggaggacgacctgccccggatggtccacaccccctggttccccgaggagatccccatggcggaggccgcggagatcggcacccggaaggtcattgccgagcactccaccattggcatcgtggtcaccaccgacggcaccgtcaccgacctgccccgggaggcctacctggaggcggaggcccgggtgatctccgagctcaaggagctgggcaagcccttcctcatcctcctcaactccgcccggccggactccgacggggcccaggccctccgggcccagctggcggaggagtacgacgtgacctgcctggcggtgagctgcctggacctgagccagcgggcggtgacggagatcatccagtcggtgctctttgagttccctgtggaggagctccagctcttcctgccggactgggtggacgccctggccccggaccaccccatcaagggcacggtgttcgaggccatccggggggccatgggggacctccaccgcatccgggatgtgcgcccggtggtggagaaaatggcccagtgcgagctggtcaccggggcggatgtcaccgccatgcgcctgggcagcggcagctgtgaggcccggctggagctcccccgcagtctgttctatgagaccatgtcccagcagacgggcttccccatccgcaacgacggggagctgctgagcctgctgcgggagctggcgggggtgcaggcggcctacaaaaaggtggccgccgccatggaggaggtccgggccaccggctacggcattgtcatccccgatgccggggagctggagctggaggagccggagatcatcaagcaggggggccgctacggggtccgcctccgggccaaggcccccagcatccacatgatccgggcggatatccaggcggaggtctcccccattgtgggcagtgagaagcagtcggaggatatgctgggcttcctcctccaggagttcgagggggagccggagcggatctggcagtccaacatcttcggccggtccttccatgagctcatcaacgaggacctggcctccaagctcaagcacatgcccgaggacgcccgggagaagatgcgtcagaccctggagaagatcatcaacgaggggtcgggcgggctgatctgcattattctgtgacaaggtagccgcgcctcctgcccggtgggtggggggcgcggtttttgctgggggtaggaggcgttgtggggttctgcccctgcgccgttggaacgggcgggaacggagccctcccgggcggggccctatttctttgaagaaataggggaaagaacaccaaggggaaggagattccttccccttggaaccccattctctggtgggaggaatgagggaaggtggttggtcaggtaggggcctggcctgcggcctctaaaaccaacgcctcatggcccgcccaccggctcgggcgggcgggagaagtggtttgttgacgggaggagaaagcgggaaaccgaaaaggttactctccgccttttcccaaagggtatccatccacgtccccagcccgcccagccggtgggcgggccgttacgggcctttcgctgggagggccgcaggccaggtactaagatagaagtacagcctccccctccacaaccccaccagagaagggggtcccgggggaggaacctcctcccccgggggttctttcccccatttcttcccaagaaatggggccccggctgggcaagccaaggttcccgcccgttccaacggcgccggggaagaaccccacaacaccccccgagcacatcccccccccggaatgggcattgatttttccgaccacaacctttataatgtatcccagccaaactcatgctgcggacggggggaaccaagatgattctaacggttgacatcggcaacaccaccatgaccatgggtctgtacaccccggagggcgtgctccagttccggggttccatcaagaccgataagaataaaacccgggatcagattgccattgacctgctggacatgttccagctgtatcaggcggacattcgggatgtgacgggggcggtggtctccagcgtggtccctcccatgaccggggccatggccgacgccatccgccaactcagcggggtgcggcccatgatcgtggggccgggggtgaagaccgggatgaatatcctggccgaggtccacaaccagctgggggcggacattgtggcctcctccgtggcggccctgcaaaagtatccccagcccatcatcgtcatcgacatgggcaccgccaccaccctgtcctacctgggggagagcacgtataaagggtgcgtcatcatccccggggtgcgcatcgccgtggaggctctctccggccgggccgcggagctgccccacatctccctggaggagcccccctccatctttggccgctccaccatcgacgccatgcgctccggggtcctctacggcaacgccgggatgattgacagcatgatccagcggatggaggaggccgcccggccggtggccacggtggtgatgaccgggggcaacgccgccctcatccagaaatactgcaagcgggagatcctcattgacgagaatctgctgctggacgggctgtactatctctaccagaagaacctggaccgccggcggaagcggggggaataaaaggctgcggcctgtcccgtgagggaagcggaaagaaacagccacgatgcgtcgcagccgttgtctcagccgccatggaaaggaggcgttttatggaacggtttcagaagatttacagtcaaggcatagtttccgtcatggaaatctgggtggatacggaaacaggggtccattatctgtttcaccgggacggaaacggggcggggtttacaccgctgctggatcgggaaggaaaacctgtggtaagaccatagcgccccaaatccgtgggaaatgggacccaaggaaggcaagcaggggaaccgtgtcatacgtccccacatataaataaatgagaggacgtcttggaaccaagatggcctcttcttgcggattgtcctgccctcggtttccccagtgcacgccgggaattcaaggggcgccgggcgggtcctgcgggcgggccgctcacatctcctgcccgcctggccggtgaggtctggccccgggttcctaaaaaatagaggcaaaatttgcaacaggacaagaaaacattttcaaaaatcgaaaattttctccttttcctattgcaaatatgcaggattctaactataatgtgtcaccgagaaatgaaaatctatggaatttacattattgggaggcctgctgtttatgaaagcattatccacacttgcccagtctgtccgggcatccaccaccatggccatcgacacgcagtttaagaaaatgcgcgccgagggcatcgacgtcatcggcttcagcgtgggagagccggatttccccaccccggagcacatcaagcaggccggcatccgtgccattgagaacgaccagaccaaatacacccccacccccggcaccctggccctgcgccaggcggtgcgcaagcggctgcaggaggactgggggctggactataccaccgaggagattgtggtcagcgggggcggcaagcccattctctatgtggccctgaagaccctcctgaacccaggggacgaggtcatcctccccgcgccctactgggtgagctattacgagctgattaagatggctggcggcgtccctgtggtggtggagaccaccgaggcctccggcttcaacctgaccccccagcagctccgccaggccatcacccccaagaccaaggccctcatcctcaacagtccctccaaccccaccggtatgatttacagccgggcgcacctggaggccattgcccaggtgtgcgtggaggccgacctctatgtcatcgccgatgagatgtacagcaagctggtctttgacggcaaggagtttgtctccttcccctccctgtcccaggcggtgaaggagcggaccattctggtgagcggtgcctccaagacctacgccatgaccggctggcggatcggattcgccgcggccgggcgggagattgtccaggtgatgagcaactacctcagccacagcctgtcggggacctgctccatcgcccaagccgccgcggaggaggcctttgggggctcccaggcggagattgaggccatgcggcgggcgtttgaggtccgccgggactacctctaccagcgcatgtccgccatccccggggtgcatccggtccggtccgaggccaccttctacatgctgatgaacctggaggagctcatcggcaggaccctctacggggtggagatccgtgacgccgacgactttgccaacgtctttctccgggagggactggtggcggtggtgccctgcaccgggttcggcgcgccccactatgtccggtggtcctttgccgtgtccatggagaacatcaaggagggactggaccggctggagaaattcctgaccaacgcctgagcggagattccatgacagaatgtgacagcgggcttcccgagggggaagcccgctgtttggcggtctggggcggtttgtcccggcactgtcgaaatggacgggagcggctggcgcccgggcggggggcttgtggggtctcccggcgccgttggaacggcaggaacttggccctcccgggcggggccccatttctctggagaaatgggggaaagagcaccaggggctgtgcccctggaccccgtgggggaaagagtttctttcccccacaccccttttctctggactgttgtagaagcggcgtgggttttctgtcggcctacctggcctgcggcctccaagaccaacgcctcatggcccgcccaccagctcgggcgggcgggagaagtggtttgttgacgggaggagaaagcgggaaaccaaacggttcctctctgccttctcccaaagggtacctacccacgtccccagcccgcccagccggtgggcgggccgttacgggcctttcaatgtgagggccgcaggccaggtaaccagcgagaagtacaacttccccccacacaaccccaccagagaagggagtccagagggaagaacctcttccctctggggttctttcccccatttcttcccaagaaatggggccccggccgggcaggcccccgttcccgcccgttccaacggcgtggggaagccccccaaaagaacgctgcccagcgcggccccacgccaaccgcggcaggcccgccctcaaaaagccagccgcatctggtaccacaccgccccgccatgcaccgaggcggacaccccctcgctgacaaacccgaacttggcatagtagggcagcagccgctccttgcaggtgagcaccacccccgcccgcccctggtcccgggcggcctggatggcgtgacggagcagccgcccggcgtatccccggcggcggtggtccgggtgggtgtccacgccaaagatcatcaaccagggcccggcggggtcgtggagggcggtggtctcatacatggcgtcggtgaggtccggggtctggacggtcatgccgttgaccatggccagcagagtgtccccctcccacagcagccagcaggtctgggggcaggcggccaggcggtcccggaaggccgctttcggggcggcctccgccggggggaagcagagggcctccagccgggtcacggcgggcaggtcttggggggcggcggttctgatttccattgataaaatcctcctgacaggtgtttttttcagtatagcacagccgcagggcgggggaaaggggattgtttccctgcctgttttgtgataaaataaccgggttctaatgatccgttgcaacagtccacacaaaggaaagaggagtggtccccatgaaagacacctatgaaagccccttggcctcccgctacgccagccgggagatgctgtatattttttctcccgataaaaaattcaccacctggcgccggctgtggattgccctggcccgggcggagaaggagctgggcctgcccatcacccaggggcagatcgacgagctggagcgggagaaggaccacatcaactatgacctggcccaggagaaggagcgggagctccgccatgacgtgatggcccacatccacgcctacggcgcccagtgccccagtgccatgcccatcctccacctgggggccaccagctgctacgtgggggacaacaccgatatcattttaatgaaagagggcctgaccctcctccgggacaaactggtacgggtcctggcagccctgggccggtttgcccgccagtacaaggccatgcccaccctgggctatacccactatcaggccgcccagctggtcaccgtgggcaagcgggccaccttgtggatgtatgagctcctccaggacctggaggagctggagtaccgcctgtcccatctgcggcttttgggctgtaagggcaccaccggcacccaggccagcttcctggagctgtttgagggggaccaggagaaggtgtggcagctggaccggcggattgcccgggaaatgggctttgcccccgaccaggttcagcccgtctccggccagacctatacccgcaaagtggacgcggccgttctgtccaccctggcggggattgcccagtcggcccataaatttgccaccgacctgcggctgctgtgccacatgaaggaggtggaggagccttttgaggcccaccaggtggggtcctccgccatgccctacaagcgcaaccccatgcgcagcgagcgcatctgcgccctggcccggtacgtcatcgccgacgggctcaacccggccatgaccgcctgcctgcagtggtttgagcgcaccctggacgactcggccaacaagcgcatcgccgtgtcggaggctttcctggccaccgacgccattttgaacctctatgagaacgtggccgccaacctggtggtccaccccaaggtcattgaaaagcacgtgctggaggagctccccttcatggccacggagaacatcctcatggatgcggtgaagcgggggggagaccgtcaggccctccatgagcgcatccgcacccacgccctggccgccggccagcgggtgaagggggaggggaaggacaacgacctgctggagcgcatcgccgctgaccctgcctttggcctgagccggcaggaggttttccgccatctggaccccgccgcctacatcggctgctgcccccagcaggtggagcggttcctggaccagcaggtccggccggtgctggaccgctatcccgacgccctccagggcacaggggcggagatcaccgtgtgatgcccggggcagttccccgtgggaacgtgagatagaacccaaaatccctctccagggcctggccccggggagggattcctgtggaaaagagaagaaaacagagaaagtgagtgtgatataccatggccggatgggtcgccctggaaaaaatggtgatgctggtcctcctcatgctggtgggcttcgccgccgccaaggcccagtgggtggacagcgccttcagccaaaaaaccagccggttggtggccaacgtcttcattgtggccaccattctctcctcggtggtgggggtgcagcccctgctcaccggcggggagatggcggtggtggtggcggcggtgtttgtcctctttgccatcgcgggggtgctgggctgggtctgcgcccggctgctgcccctctcccagggggaccggacggcggcctggctgtcggtgttctttatgaacaacgtctttgtgggcttcccggtggtggaggccctgtttggggagagcgccgttttctgcgcctccctgaccaccctgccctttaacctgctcctgttctccttaggggtcagccggctgcgggcgggccaaggccagggacgggtgaccctgcgggaggtcttttcccccgccctggtgggcaccctggcggccatggtgatcttcctgctccacatccccctgcctgccctggtgggggacaccatcaaaaccctcagcggcgccacggtccccctgtccatgatcgtcattggcatctccctgagccgggtccccatgggccaggccctgcgggacgggaaggcctatgtggtgagcctggtgcggctgctgctgtgcccgctgctggtctggctggtgctggggctgttcctggagggcaccaccctgggggtgctcacggtcatcgccgcctgccccagcggggcgatggtctccatcctcagcatccgctatggggtggatgacacctttgcctcccgggtgaactttctcagcaccattctctgcgcggtgacgctgccggtggtgacctcctttctgctgtgaggaagggggcgtcccgcgccagtgtgggttttctcctgtgccgttggaacgggcaggaacttggccctcccgggcggggccctatttcttggaagaaataggggaaagaacaccaaggggaaggaggttccttccccttggaaccccattttctggtgggaggaacgggggaaggtggttccgtcaggtaggggcctggcctgcggcctccaagaccaacgcctcatggcccgcccaccagcttgggcggacgggagaagtggtttgttgacggaaggaaaaaacgggaacccgaacggttcctctctgccttttcccaaaggatacctgtccacgtccccagcccgcccagccggtgggcgggccgttacgggccttccattgtgagggccgcaggccgggtatcccataagaagtacagcctccccccacccaatcccaccagagaagggagtccagagggaagaacctcttccctctggggttctttcccccatttcttcccaagaaatggggccccggctgggtaagccaagattccccgccgttccaacggcgtagggagaaacccacaagggcccccgcccgggcggcccccgctcccgcctgttccaacggcgcaggagaaaaaccatccttttgcccatccagccacaaccacaccgtcccccacagggacccaaaggaggaatcccctatgctgctctccgcagaacacatcagcctcaacttcggcctcaagccactgctggacgacgtgaccctctacctcagccagggcgacaaggtgggcctgatcggcatcaacggcacgggaaagagtagctttctccgggtcctggccggccagcagccccccgaccagggcagcgtcacccgagaccccaatgttcaggtgtgctttttgccccagaatccccccatggaggcgggggccacggtgctggagcaggtctttgccgggttttccccagacacccgggcccttctggactatgaggccaaggccatgctcacccggctgggcttgacggactttgcccagccggtggggaccctctccggcggccagcgcaagcgggtggccctggcggcggtcctcctccacccggcggatgtgctcattttggacgagcccaccaaccacctggacagcgacatggtcctctggctggaggaccgtctgcggaagttcaacgggggactgatcatggtcacccacgaccgctactttttagagcgggtgtgcaaccggatcacggagctctcccactgccacatccgccactatgaggccaattactccaaatacctggccatcaaaacccagcaggaggagcgggagcaggccgcccagcgcaagcggcagtccatcctccgggtggagtaccagtggatcatgcggggagcccaggcccggcggaccaagaacaaggaccgcattgcccggtacgaggccctcaaggcccagaccggcccggagaccgacggggcggtgcagatggccactctctccagccgcctgggacggaagacggtggagctgcatggggtctccaaggcctttggggaccgggtggttctccagtccttctcctacggggtgggccgggaggaccgggtgggcatcgtggggcgcaacggggcgggaaagtccaccctgctgaacctccttgccgggaagctcgccccggacagcggcaccatcgactggggcgagacggtgcgtatcggctacttctcccaggagggccgggagctggacccggatcagcgggtatacgactttatccacagcatcgccggggaggtaaagacccgggaggggaacttctccgccgcccagatgatggaacggttcctctttcccacccagctccaggggcagcccatcggcaagctctccggcggggagcgccggcggctgtacctgctgtcggtgctcatggaggcccccaacatcctgctgctggacgagcccaccaacgacctggacgtgaccaccctggccattctggagtcctatctggagaccttccccggggcggtgatcgccgtgtcccacgaccggtacttcctggacaagatggcccgggaaattttcgaggtaggggaggggggcgtggtccggcggtacaccggcaactacaccgactacctggaaaagcggacccaggtggccgccagccgggagaaggcccccaaaaagcccgccccgggcagaccccagcggcccaagaagctgaaattcaccttcaaggagcagcgggagtttgacaccattgaggacgacattgccgccctggagaccagcatcggggcgctggaggcccagatggccgcctgcggcagcgactatgtgaagctccaggagcttacggaggagcaggcgcgggagaaggctgccctggaggagaagatggagcggtgggtgtatctcaccgagctggcggagaagatcgcggcacaggaggggtgaggggggacgcccttgggcctgtctgggtagggaccgtggtgggggcctttccctacgccgttggaacggcggggaacggggcctgcccggccggggccccatttcttgggaagaaatgggggaaagaacccccgggggaggaggttcctcccccgggacccccttctctggtggggtggtgtgggggaggctgtacttctcacttattacctggcctgcggccctcccagcgaaaggcccgtaacggcccgcccaccggctgggcgggctggggacgcagatgggtaccctttgggaaaaggcggagaatggccttttcggtttttctctttctcctcccgtcaataaaccacttctcccgcccgcccaagctggtgggcgggccatgaggcgttggtcttagaggccgcaggccaggtaggccaacaggaaacccacgctgcttctacaacagtccagagaaaaggggtgtgggggaaagaaactctttcccctgcgggggtccagggggcaaagccccttggtgttctttcccctatttcttcaaagaaatagggccccggctgggaagccaaggttctcgcccgttccaacggtgtgagaaaaccttgcacccccatccaggcaggctgcccccccaaccccctgcccaaaccaaaaacaccgccgtgccccacaggctccggcggtgttttttttcagcgcggcggaaaaggccccctcagtccccaatctcccgcagcaggttcaccatctccacggcgctcagggcgcagtcatagcccttgttgcccgccttggtgccggcccgctcaatggcctgctcgatggtgtcggtggtgaggacgccgaagagcacgggaatctggctctggagggagaccgtggcgatgcccttggagacctccgcgcagacgtagtcatagtggctggtgctcccccggatcaccgcccccaggcagatcacggcgtcgtactttccgctgtttgccagcttgctggccaccagggggatctcaaaggcgccggggacccaggccaggtggatggcctcttccgggaccccatggcgcttgagtccgtccagggccccgccgatgagcttggcggtgatgaactcgttgaaccgggcggccacaagggccaccttcatgttttgcgcgaccagcgcgccttccaaagttttcatggcagtgtctctccttcatctgtggttgggatggttccgccccttggggcggggaactcagtaactgaggatgtggcccattttcttctgcttggtctggaggtagaacagatcgtgggcggtggcggccatctgaatggggacccgttcctgaatcgccatgccgaagtccgccagctggtagaccttgtccgggttgttggtgagcaggcggagggttttggcccccaggtcccggagaatctgggccccgatgtaatactcccgcaggtccccggcaaagcccagggccaggttggcctccagggtgtccatgccctcgtcctggagggcataggcccggagcttgttgatcaggccaatcccccggccctcctggcgcatgtagaggaggaccccccggccctcggcctcgatctgggccagggcggcggccagctgctggccgcagtcacagcgcagggagccgaaggtgtccccggtgaggcactcggagtggacccggcacagcaggttttggccgtcgccgatctcccccttcaccagggccacatggtgctggccgttgagcttgttgacatagccgtaggccaggaagtccccgtaccgggtgggcattttggtgacggtgacccggtccaccaggacctcgtggcgcttgcggtagttctgcaggtcccggatggtgatgaacttcagcccccactgcttggccttctcctggagggccggggagcgcagcatggtgccatcctcccccatgatctcacagcacaggcccacctcccgcaggccggccaggcgcatgaggtccacggtggcttcggtgtggccgttgcgctccaggaccccgttgtccttggccagcagggggaacatgtggccggggcggcggaagtcctggggtttggcgtcggggtccacgcactttctggcggtgagggcccgctcggcggcggagatgcccgtggtggtgtccacgtggtcgatggagacggtgaaagcggtctcgtggttgtcggtgttccgggtgaccatctgggggaactggagcttctggacgtacccataggacatgggcatgcagatgaggcccttgccgtgggtggccatgaagttgacgttctccgtggtggcaaactctgccgcgcagatgaggtccccctcgttctcccggtcggggtcgtcggtgcagaggatcatcttgccctggcgcaggtcctccagggcctcttcaatggtgttgtactgaaacatggggtcattcctttcccggctcaaaagccgcagcgggttaaaaaatctcgggtgatcccggaagggggcggggcctccgcctgaaggggctggaggagcttttccacatactttcccaggacatcggtttccaaattcacagggtcccccacccgccggtgggccagggtggtgaccgagacggtgtggggaatggcggagatggcgaaggactggccgtccaccctggccaccgtcaggctgatgccatcgatggcgatggagcccttctccaccacgtagcgcagaatctccgggccggcggcgatggtataccagacggcgttgtcgtcccgggtgatccgctggacggtgcccaccccgtccacatggccggccacgatgtggccgccgaagcggccgccggcggccagggcccgctccagattcacccggctgcccggccggaggagcgccagggcggagcggttcaaggtctcatgcatcacgtcggcggtgaagccggcgggggagaaggcggtggcggtgaggcacaccccgttgacagcgatgctgtcgccgatgtggaggtcctccagcaccacctgggcctgaatctccaccacggcgctgtggggccccttgcggatggcctttacggtgcccatttcctccacgataccggtaaacatttacccggtcacctcgctttccaagagaatgtcctcccccagacgggtgagggtaggggaggagagggagagggcctggtccgggtggggaaagccctggccccccaccggggacttggccccctgcccccccaggagcttgggagccagataggcctggaccctgttcaccagccccgcctgcaccagcccccagtggagctgggcgcctccctcggccaggacgctgtccacccccatcttccccagcagggtgaccagggcggccaggtccacgcggccgtcggccccctggggcagggggagaatctggacccccaggtcccggtagggggccagccgcccctcctgggtgacgcaggtggccaggcaggtggggatctccccggcggtctttaccacctgggcggtgagaggggtgcgcaggtgggtgtcacagaccaggcgcagggggttccgccccccctccatccggcaggtgagctgggggtcgtcggccagcaccgtgcccacccccaccagaatggaccggtagcggccgcgctgggtgtggacgtggcggcgggcggcctccccggtgatccactgggaggccccggtgtaggccgccagcttgccatccagggtcatggcgtacttgagcaccacatagggccggccggtctggatgtagtgaaagaacacgtggttcagggcccggcattcctccgccagcacccccacggtcacctggaccccctgggcccgaagctgggccaggccctggccggccaccagggggttggggtccccggagcccaccaccacccgggtgatgccggcctccagaatggcctgggtgcaggggggctgctttccctggtggcagcagggctccagggtgacgtagagggtggagccggcggggtcctcccggcaggcggccagcgccgcccgctcggcgtggaggtctccccaccgggcgtggtacccctggccgatgatccgcccctgcttcaccagcacagcccccaccatggggttggggctggtccagccggcccccttttgggccaggtccaaagccagggccatatagtcctgatctgtcatcttgatcacctccgcgcaagaaaaaacgctctgaagccaatcttcagagcgcacaaaaccagcacagcgatctcctctctctgtccatcaaaaaactctggaatgaggcatcatcccagagcaatccacgacgaacagacgcggagaccccgcgtatgtcatccatcttcttccatccagactatactgtcggttttggaatcacaccaaatcctgccgctgcgcggctcgcggactataccgccgatcgggaatttcaccctgccctgaagatcgctatttcattgtctgtttaacacgttactctctggcgggggaattgtcaagagggggagagagaaaagagaaaaattagaagatattacaggagaaaggagttaaattccagaaaattttatggaaacgatgaaatttgaagggagaattccccaaaactggtttcaaggctgatatagatggcatcgtttcacatggtcgtttaccatgccgactgcctgcatataggcatatatgatcgtactgcctacgaacttaaaaccacgttttttcaaatctttgctgattctgtccgagagaggggtccttgcgggaacctcctcttccgaagtgaaatggttgcggatgggcttcccatccacataggaccatataaatgcatcaaagctgccatattccgcttgtattttgaggaactgctgggcatttgtgaccgctgatttaagctttaagcgattgcggacaattttttcattttgcatcagttcctcaatttttgcgtcgtcatagcaggcgacttttctgcagtcaaactgatcgaaggcctctcggaaggcctctcttttgttcagtatggtcagccacgataaccccgcctgcatcccttccaggatcagcatttcaaacaatttatcgtccgcatggaccgggtttccccattccttgtcgtggtacgcccggtacaggtccgttgttgcccacgcgcaccgttctaccttctcgtttggcatcccagcttacctccccaacgtaaagtgcagtgttctctgtcacgctatcatctattatagatgataaagcattcccccgctccgccgcaataggaatcggcgcggcgaaggcacaaaaaaacggccctttcccagaggaaagcgccgcgggagcggacccgaacagccagggatgacggcggaggaaatcgcaggggggcacaggcaccggcaaacaggaagacgtgcgttgagagagcatacgcggcgccccgccccacgctgccaaccgggtccgctccgtggtcagcgtgttctgaaaagaacggtcctcattgtaggagacagccgggagaaagtcaatggaacccggagaaaaagacgacgaaaatagacagattacagcccagtgaaattgtgggatttcacgcaagcgatttctcccgcaagcttctcggggaaaagagaccagaccgggccctgtccgccggggattttcgggcttttttccaaaaagttgggcaaaccccctatgcaaaccagcgcagttatagtaaaatagccacaacagaatgccgctccgtcccccgggccggggcggtcaggaagcagacccgctccccctggggcgggcaagggaggtacctatggagaaaccaacgtatcagcgcgttctgctgaagatcagcggcgaggctctggccggcgcgccgggccggggcattgatttcgcctttgcccggcaggtatgccaggtggtgcaggactgtgtccgccacggggtccaggtgggcctggtggtgggcggcggcaacttctggcggggggtcaaggacgggggcggccggatggagcgggcccgggccgaccaaatgggcatgctggccaccgtcatcaacagcctggccctccaggacgtgctggagcagctggggcagcccgcccgggttctcacctccattcccatgggcccggtgggggagatccattcccagccggcggctgaccggtacctgcgggaggggaaggtggttctcttcgccgggggcaccggcaacccctatttctccaccgacacggcggcggttctccgggcggcggagatccaggcggacatgatcctcctggccaaaaacatcgacggggtgtacagtgccgaccccaagaaggaccccggcgccgtgaagtacgacgccatcagctatgaccaggtcctggccgaccacctgcaggtgatggacctgacggccacgtccctggccctggagaaccatatccctgtgatgatcttcgccctggcggaccctcagaacatcctccgggcggtgatgggagagagaattggaaccattgtagaggaggagacaaagtcatgaaggaactgtatcaggaatacgacgtgaaaatgcagaagaccatcgaggtggtggtcagcgacttcgccggggtgcgggccggccgggccaacgccgcggtgctggacaagatcaccgtggaatattacggtacggagacccccatccagcaggtggcctccatctccacccccgacgcccggaccctggtgatccagccctgggacggaaccctgctcaaggcggtggagaaggctctgctggcctccgagctgggcatcaacccccagaacgacggcaaggtgatccgcctgatcttcccccagctcaccgaggagcgccggaaggaactgaccaagcaggtgaagaagtacggcgaggggggcaaggtggccatccgcaacatccgccgggatgccatggagaagttcaaggccatgaagaaaaagtccgagctcaccgaggacgacctgaaggagctggaggaggccatgcagaagctcaccgacaagcgttgtaaagagatcgacgacctcaccgccaagaaggaagccgaactcatggccgtgtaaggtgggccatggcgttttggcatagaaaaaaacggccagcggccggggcggagcctgatctgaccaggctgccccggcacatcggcatcatcatggacggcaacggccgctgggccaagaagcgggggctgccccgcaccgccggccacgccgccggggcggagaccttccgcaccatcgcctaccggtgccgggacctggggattccctacctcaccgtctacgccttctccaccgagaactggaaacgtccggtggaggaggtttccgctatcatggacctgctgcgcaagtacctgctggaggccctggagaagatggagaaggacgggttccgcatccggtttttcggggacctggaggccctgcccccggagctgcgcaccctctgcctggagacggaggagaccggcgcggcggtggcgggggccaagtatcagatcaacgtctgcctgaattacggcggacgggatgagatcctccgggccgcccgggcctgggggcgggacgtgctggcgggccgccagggggtggaggacctcaccgacgaggtcttctcccggtacctggacagccgggccgtgcccgaccccgacctcatcatccggcccagcggcgagctgcggctgtccaatttcctgccctggcagtcggcttacgccgagttctattttaccgatgtgctctggcccgatttcagtcccgcggtcctggacgcggccctggtggacttccagcggcgtcagcgcagatttggaggcgtataacgtgagaaatcgtattctggtggcctgtgtgggcgtgcctgtgatcctggtggtcctgtacgttctgcccgcgccctttacccccgccctcatcgccgtgctctccgcggtgggcacctatgaggccctccatgccattggcatgaaccacccccgcatcgccctgtacaccgccatcgtggccctggccatccccttctgggtctactttggggagccccgccagtggggcctgctggtgctgctggtctacctgctggcggtctttctggaggccttcgccagccatctgcgggtgaagatggaccgggtgggtgcgggcttcttctttgcctttgtcatctcctactgcctgtcctccgtggtgcgggtgggggctctggagctgcggaccagctacatcttcctgcccatcctcatccccttcgtggtggatgccggggccatgctggtgggcatgtttctgggcaaacatcccctcaccccccatctctcccccaaaaagacggtggaggggtctgtgggcggcctggtggtgggggtggtcatcgccatcctgtacggggtggtcttccactttattaccaaggtagaggtcaattactacttcctggcggtctacggcatcctgggcggcgtcatcacccaggtgggggacctggctttctcctacgtcaagcgcaaccggaaaatcaaggacttcggccatgtctttcccggccacgggggggtgctggaccgctttgacagcgtgatcttctgcgccccgctcatggagctgctgatcctctggctgccggctttcagcaagggggcgggggcatgagggcgctgtctgttctgggctccaccggctccatcggccggcagaccctggaggtggcggccgcctgcggccaccgggtgctggccctcaccgcccaccacaacattgccctgctggagcagcaggcccggacctttcatcccatcctcgcagcggcagcggacccaaccgccgccgctgctttggctatgcgcctgtcggacacggacattcgtgtgctggcaggggaggagggggtcctggccgccgcccgtctgccccaggcggacacggcggtgaccgccctggtgggcattgccggcctggcccccaccctggccgccatcgacagcggcaagcgcatcgccctggccaacaaggagaccctggtgtgtgccggccccctggtcatggcccgggcccgggagaagggggcggagatcgtcccggtggactcggagcactcggctatttttcagagcctccagggcagctcccccaaggagatccggcgcatcctcctcaccgcctccggcggacccttcttcggctggagccgggaggcactggagggggttaccccggcccgggccctgcagcaccccaactggtccatgggggccaaggtgaccattgactcggccaccctgatgaacaagggcctggagctgctggaggccatgtctctgtttgatgtgcccccggagaagattcaaattttgattcaccgggagagcatactccattcggcggtggaatactgtgacaacagcgtgattgcccagctgggggacccggatatgcgcctgcccatccagtacgccctgtcctggccggaccggacccccggccccgcccggcccctggacctgctgtcggtgggaaagctcacctttgcccagccggacctggagaccttccgctgtctggcgctggccatccgggcggcccgggaggggggaacggcccccgcgattctcaacggtgccaatgaggtggccgtggagaggttcctggcggggaagattggttttttgcagattccccaggtggtggaggctgccctggacaccgttccccgggcggccgcgctgaccctggagagtattcaggccgcggatcaggcggcccggcgggcggcggcccgggcggcggagggctgagccggacccggtgggggatgggatgcggttcctttgccgtgggaagggcggggaacggggtccttccgagcggggcccattgtgggtttttccttacgccgttggaacggcagggaaccttggcctgcccggccggggccccatttcttgggaagaaatgggggaaagaacccccgggggaggaggttcctcccccgggacccccttctctggtggggttgtggagggggaggctgtacttcttacgggatacccggcctgcggccctctctttgtcacgctggtaacggcccgcccaccggctgggcgggctggggacgtggatgggtaccctttgggagaaggcagaaagtaaccgttcgggttcccactttttcctctcgacaataaaccacttctcccgcccgcccgagccggtgggcgggccatgaggcgttggtctttgaggccgcaggccaggtaggccgacagaaaacccacgccgcttctacaacagtccagagaaaaggggtgtgggggaaagaaactctttcccccgcggggtccaggggcacagcccctggtgctctttcccccatttctccagagaaatggggccccggctgggaagccaaagttcctgcccgttccaacggcgccgagaaaaaaccacaacgccccccagggggcaagtctatctctgaggtgaacaatttgcttgtctatatcatcgtcggcatcctcctcttcggcctgctcatcgcggtccacgagggaggacacttcctcaccgccaagctcctgggggtccaggtcaatgagtttgccattggcatgggtcccgccctggtctccttccagcggggggagacccagtattccctccgggcctttcccatcgggggctactgcgccatggagggggaggatgaggagaacgacaacccccgctccttttccaacaaatccccctggcggaagctcatcattctggccgcggggtcggtgatgaacttcattgccggctttgtgctggtggccatcctgttcggcaccgccggtagctatgtggtgccggtggtccgggacttcatggacggcttctcctgcgccggggcggagggactccaggcgggggaccggattgtctcggtgaacggccaccggatttttgtctactccgacctgtccacccagctcagcaccgccaccggggagaccatggacctggtggtggagcggaacggggagaaggtggtcctggatgacctccccctccagccccaggattacaccgtggacggccagacggtgaagatgtacggcatttattttgacgtggaggaggtcaccttcccgggccttatgaagcagagctggaacacctgctggtactttgcccgggcggtctggtcggggctggtgatgctggtctccgggcaggtgggcctggacgatatgtcgggcccggtgggcattgtctcctatctgggggaggcgggcagccaggggggcagcattgtggccgggctggagaatgtgtgctacatcatcgccttgatcgcggtgaacctggccattatgaacctgctgcccatccccgccctggacggcgggcggatcttcctgctgctggtgggggagctctggtttctcctgtcgggcagaaagctcaaccccaagtatgaggcctggctccacggcatcttctttgccttgctgattctgctgatggtggtggtcaccttcagtgacatttggaagctggtgaaataagcatgggaaaacaaattcaggtgggcggcctgccggtggggggcggggccccggtgtccatccagtccatgaccaacacccccacccacgatgtggaggccaccgtggcccagatccgccggctggcggcggccgggtgccagattgtccgggtggcggtgcccaacctggccgcggccaaggcggtgggaaagatcaaggaggccattgacctgcccctggtggtggacattcactttgactaccgcctggccctggagtgcgtggaggcgggggccgacaaggtgcgcatcaaccccggcaacatcggcggagccgaccgggtgaaggcggtggcccgggcctgcgcccggagaaacatccccatccgcatcggggtcaacgggggctccctggaaaagcccattctggccaagtacggcggggtcacgccccaggccatggtggactccgcctttggccacatcgccctgctcaaccggtacgactttgacgacatctgtgtctccctcaaatcctcctcggtccccatcaccatgggggcctatgagctgatgcaccagcaggcggactatcccctccacctgggggtcaccgaggcggggaccacccggatgggaaccctgaagtctgccgccggcatcggggggctgctggccctggggattggggacaccttccgggtgaccctcaccgccgacccggtggaggaggtctacgccgcccgggacatcctcaaggccatcggcctgcgccgggaggggccggacctcatcgcctgccccacctgcggacggaccaaaattgacctgatccccctggcccaggcggtggaggagcggctgaaaaccgtcaccaagcccatcaccgtggcggtgatggggtgcccggtgaacggccccggggaggccgccgccgccgacgtgggcattgccggggggaatgggaagggaatcctgttccgccatggggaagtggtgcggcaggtgccccaggaggagctgctggatgcgctgatggcgctgattgaagagctttgaaccccatcgccgttgggatgggggcggtgtggggttcttcccctacgccgttggaacggcggggaacggtggtttcccagccggggccctatttcttggaagaaataggggaaagaacaccaaggggaaggaggttcctcccccttggaaccccattctctggtggaggaacgggggaaggtggttgggtcggtatgggcctggcctgcggcctccaagaccaacgcctcatggcccgcccaccggctcgggcgggcgggagaagtggtttgttgacgggaggagaaagcgggaaaccaaacggttcctctctgccttctcccaaagggtaccgccccacgttcccagcccgcccagccggtgggcgggccgttacgggcctttcgctgtgagggccgcaggccaggtatcccgtaagaggtacagcctccccccacacaaccccaccagagaagggagtccagagggaagaacctcttccctctggggttctttcccccatttcttcccaagaaatggggccccggctgggaaaccaccgttccccgccgttccaacggcgtaggggaagaa

SEQ ID NO: 2244 - DNA, 19179 bp, KLE1738
tgataataagagattatccttataatatattaaattttatcatagtaaggcagaaaaagccagagctttccaaaaatctttcgttcaagtcaaatggcgttgaatgtgggaaagagcctctgaaatattttgaaagacctctcttgcatttataaacaacagtttgaaaatagtctgctggaggataaaaaggagcagcagcgaatcccaatatcacgcttgccaatttggttgtttcctattattatgatataaaatgatactatattatatcagaggtgagcaagatggatgctgaactgtttgcaaatatgttgtcggacaaaagtatcttagaccttaaaaaattgagatataggtacccgcaagctgatatgaaggaatttgttgcgttactgggaaacggcttttacaagaagctgccactgaaggattttgatggtagaaatttggtctatctggagagtatagcccaggtccatcttaccgcagttaaggtattgctgacccctcaaaacagcaagcagctctacggcatgaaggctatggaagaggagatcctttccacatttactatcgaacagattgctactactcgagacagtgtccataagattctgtctggctatgcccctacgaccgagagcgagaatcgcatctacggaatgaaaaagggcttggagtttatcggagatcccaggcacaagatcaatgaggaaaatatccatcagctttatgcgattgctattggagcgtttttaccaggagagaatcgcctattagccggatacaaatatcgccacgacagtgtttacatcgtgggcaacaaagtgaagcatacgggactcccttggcaaatgctgccagaatacatggggaatctggtgtcgttcatcaatgaagcatcgaccataaatgacctgctgaaagctgcgatcattcatttctatattggctacctgcacccttggtttgatggaaacggaagaatggcacggttactgcatctgtggtacctggtacagcaacggtattcctctgctctgtttgtccctctttctgaatatgtgggaaaaagccgccggggttattacgatgcctacacattggcagaacagaacacccagatcagcgaaattttggatgtgacgcctttcttggtctatttcattgaaaacgtataccataaactggtcaccgcgctgcccgcgcccagtattacggacgcctttcagcgcgcgctggagcaaggcaacgtgacggaaaaagagcaggctctgtggcattttgtccttactgcctatggaagcagcgagttttctaccaagcagctggagaaagccttcgggaatgctgcctatgcgacgatccgtggattcgtcctaaagtttgagaaactgggattgctgcgagcagcaagatatggcaacagaatcaaataccgaatcgaagtgcgagaagcggagtgattttctggaggcggcgaagaccaggcgttcagggcctgcttgatgcatcgtgggttgttgctaatattcgacacttttgatttggaaaggcctaacgattaaagatcactggggatgtacttccttctcttgatactgacaaagccacgggcctggatcacagcaagccccactttttatgtcgccgagttacttcattcatctgaggagagtgtcaaacgtctgtgtttggagacaagaaatggttagttgctgcatgggaaagaatgtttagtgtttccaatcagacaaaagttcagacacgaatgcttcattgtcttttaccactttacttgttgggttgtagtcaacgaggccttttcgcatataggttgcttcaggagcgtttacagactgtctaatgtatgtggagaacatcttagtatcgagtaaatcagtaagaagattggcgatgtctccaatttgcttgctgattctaaatcgagggacaaaccgtgtaaacacgaaaccacggattttcagattaggattaaaatactgttttacactggaaataatattgccaagttgatggattccgctggaggcattgagagctgccattgtaggaatgattacttcaactacgccggcaatctcaacgaaaaacaacagagggagtaccaaaaggtactccctctgtgaatacagtagaaaacgtctttattatgcggacggtttccccgccgtgtaataaggatgtttaggcggaaccggcgggtaagatatcaaatctattatatccccaagtgcatatcaaacgataggaaggcagttcagttggcagagcagatgatttgtaacgaccactgttttttctgcgcctcttcgaggtggataagacccacaccgtgattcacacctgaaagaggcagaaagcaccggagaggaaggtgtaccttctctccggtgctttttcctgtgctcacatcacttgtgttgactgctatcttttccaccgcctgctcctgtatctgctgggtggtgggtgttaagtgtacagggtaaacccaacatcataatgtctcagcgcggatgagatcctcttgacatccactccattttgcagagccacagttgcaaaacgtgtcacaaagtttaggtgtagcaattattgacgctataaccagataccttttcctgacgatactttttctccaccctacagtcaaaggcagcacacaagccgtctgtaatacaaggcagggttcttcctgctctatgtcagcggtgagagcagcttttttagaaacattttcaaagcattatctcactgttcttgaaaacgcttggctaattgtgcaaatgatgaattagggagcacctgcttggacgggataaacaaatatctccacggcttatacccattcgctttacaccaacgagtcgagacatcgcaatattgaatacctcgctttttcttgtcaagcacatcaggatcggtcagcttgttctcgccctttacttccacgagatagcaacagtctgctgtctctaccacaaagtcaggctcatatcgcttgccacggttgtatgtaatgttgaactcattaggtgcaggacgcagccatttcaacacatcatcgtcccgatcaagtaaacgagccagtgtcagttcgctttcatcagaatcaaatttagcttcaggatacacgccctttttaattcccgtgaacagaacagatttgatatgcccctcataattctccttgaaatcatcatacagcccgactttttgcctgcaattcaatttctgcggcaggttgctgtattcgacatcaatgacttcttcctgaaaaaggccgttttcacaatagaagtgcttcatcatctgatcgtatatcttacccgcaatctcccgccggtacatcataacgatattctgcattccgtttataccatagccggtttcatagtggtcgcatacctgtgtgatgagcttaaacaacaatttcgagcagcgctcatagtcaatctccggctttttgtgaagctctgttagaatcactttctcggggtgatagccctcaaaatcaatggcgtcgcccttgattcgctcccggtcactcatgtcctcaagattttgaatcagcagctcgtttttgattggcatgtgggtaaacacactgagatcaagatcaaagtccacaaagatatattcctccacccctgcgtccgttactcgaatacggggaatgggaatgaactttccaatgatcgtcgtgtaggtctgctctgcctcttcctccaaccatgtaaggaaggggttttcattgttcttaaagatctttccccaatcctgattttcttccagcttctgcgtcactgtctgtacaattttcttcttttccgggtgagcaaggacaaaaggtactttcccgttttgtgcaatgtagtttatcgtttccacttgcaaataggcttttgccgtttgcagcagaatgtcgttttcttcgcttgttggcagtcccgtttgcacataagcctgctctaatgtctcattttggtcaatatccagtgagagctgagtatagacgatttcctctggttcgtccagttcttcctctgcctgaatgacattacctgccttgaagatggaatcgcctttttgcgcttcagccagtatatcctgaaacttatcgtgagcggtgagcatcactgcgtccacatctttgtccccggtacgctctccataaggcaggcgaagtccacgccctaccatttgttcccgtaggattttagaagcagcggtgcgaagcggaacaatggtatagaggttgttgacatcccagccctctttcagcatattgacatgaatgacgatttcaacgggattgtcagggctttccacatccagcagcaaacgggtattggcttctgtttcagcgcctttttgcttggagtgaacggtgattgttttgttgcggtacgcgccatttttgaactcgtcagattttatgaaatgctccacccattgtgcatgacgggtatctttgcaaaccacaagcataaagggctttacaaggggtttttcataatttgccgcatagacttccaactttccctttgtccgctcgtggcaggcgacgccatctattagcatcagtttatcaagcttctcgtcaccgaacttgtaaaaatcaatgtcggagcgcgtcacagcaaagggtgtccgggtatagccgtcctcaatggccttggacaggggatattcgtataccacatttttgaaagggacttgttttgcaccttttgttataagggggagccgtcaacgccagccccagcagcgggtacaggtcgttaagcgcttgagcgcctctttccgctcggtagtggtgggactcgtccatgatgagcaccaagtcgggcaggttagaaaggtaccggtagaacgagtcacccagcaactcgttcaccttgcgcatattggcgctctctttgttgaacttgtcgatattataaatgaaaatatgaatatccgaatcatatagggatatacttttgtccctgtaatcatcatcagtgataatctgcagcagtacggggaagcagcccaggccgcggaacacatacttggggctgttgttattgttcaagtcttttttccgcttgtcatagatagtggtgtttggcgcaacaacgaagaaattcttgatattgtgttgcgtatacaggtaagcgatgaacgcacccatcaggcgagtcttgcccacgccggtggcaagggtaaaggtcagtgacatgaactcccgttcaaagtctgagcaagtgggatacatggcgtggacgctgcccagtgctgctttcaggttcatccctttacggagattgaccgaggtaacgatttcctccagaattctcagagaagcagtctggggcttacgcaacgacataacaccgctgatatagtcggtggtgtataacggaaaacgctcactcatcgtcttccacctcctcgtcctcataggccgatgggtgagcgatattcaggctgtaatcgtccttgccaaactcacagcggtcaaggagcatttgtgggattttcttcaccgcaatattcgtatacgctttgtccagtcccttatcataggaacggcaggcaatcaccagacactcgccctcctccataccgctcttgatggcatccagataatcggcggtcaagtgccgggtagtggtaaagaggtcgctattctcattgcccaacgcctgtttccagaagaaatcggcactgggctgataggtaaagccttcatgtaaggctattgccgctgccagcgcgtcggcgctgtaatctgggttgataatcgcctctccgaaagcgacttctttgatgagcatggggggccagctcatagaagtggaagcccagcatttattctattgtcagtgtacttacccgcctcggacggtgccagaagtcatcccggcaggcccggaaagggtaaaattaaaaagtatgccaaaattaaaaggtttacttatggattggcatgaacttttttcagtttacaataggtaattattgtgctggtataatactgcatcatccaatcataccagatttcacgactgtagtcagtcttttgatcggccttattatgtcgtatattatattcattcacaataccaaaaatgagacggtcatgctcattcttagaaacatcgtattcttgattcagtgtttccttcaagtcgtctcttactttttcgaggatatctgcaagaatgttgataggttttttcttagcttccatatctgtatcaaaacgataatacatccttgaagcagattttaactgttctaatacatcttctgacaattcggctccgtcataacttaattgttcttgaagagctttgttgggcatttccataataaagccattagaccgttctaaatagtaaccgtccttataagatcgcagtaaattatttatttgttctgaaaacagagctttttcatcttttacgtcaattttcccagtcgaataatggtaaacacctatgtgcgcatataacatctcaattacagaaaagaggatttcttcagtatagctttcgtaatattctataatagactatatatatttatcctgcaaacacgcgataaaaatatattaggagatggagccatcgttggtggtaatatgcagataatttcatgcgtccatcgatcttcgtgattggcccccttaaacgcaagttcaaaggaaccctttctgttaaaatagtgataaccctgtataaatgaattcaaaagttcttccaacgacaaagagatggtttgagttatcaatccttttcgttcttcatagtatacactcactgtgtttacccccatataattcatcttataattaaatcatctgcccattatcatgcaatgcctgttcaatagtatcagccaatcgtaatatcttgcttttatgatttccagtatagtgatacataaggtatctaatgtctacaacaatgccctgaactctttcgtaattatgatctccgaccttccaatcaccctttgcctcaccaatattaccgtatatcgaatcaaaaccgaacacatttttggcgctgttgtaaggcattaaaaaggcgttataaaccggcacgtcatctccatattcacgtttgaatctttcttgtgtatatatgtattcaccatatgtgatttgcttatttatcgaagacgattcgggcagatgcatgggattaccggtaatgccataacgataatatttggcatctaacacatatattttaccgttatgcaacatgatagaatccggctccaaagcataattctcttttaccttccccttgagataccagcgtgtccgcgggaaaaacttgtacttatcttttattccatacactcggtctatcagtttctcccatacatattcaaaagaatctgtaccaaaataaaactgcttcagatttgtctgctcatcaatatacttcaagacggcaatcatcgccgtaaataaatgcttatttttatcattgttggttcttgccaacttatcattcaacaccgaaagaaacattttggtgttcttttcgattgttggtttaggtggcaaatcaggcgtaaatagccatccaagtttttgaaaactctcatatacacaatacttgtgaatttgtgttatcaaatttttatcgttgggcgacgacactcttacagtgtactctgtgtacactggtgacccatcagattgaataagaggacgctgttttctgatagtttttgcccaatcaatactacctcgatcgctcgtcttaaaaacaggttctttttcagtgtaataggagttttgttccagataatagttgatcacctccatataggcattgatcggaaaatcaaccgattgcggcgcttcaaactttttcattgcaagcacacggtcagacttatccgtaaactcagccaatacagaaatcaaatgcaatatatctctgcggatttcttggtcagtttcaggtaattgatatcccacaggaaaatagaccattgcgttttcagaatccgcctttattccgacgaaacggtctccttcatcgtttttattaatatggcatctgtcaagcaatcttgcgtctaaatccacggtatcaccacctcatgttaatcttcgccgttgttctgcccggtaatagcattaaacattccttctttgaaaaaggcaaaacgttcgtttccggtttcagatgtaaatttttttataacagcttcaagactcttgtaagagcttatttcaaaaatattttcacgagaaaacttaaacgcatcatcccacagatattttatgactttctcagggaaacgtctgttatgatgttttgccacaattcgagcctgttcacttgcgtctacgtcatctgcaaccggatcgtaccacaaatccagttttgaaacaaaataggctcctaagcgtttgtcttctgaggatgtcattcttacattgccatctaaaatttctttattaatagcacgacaaaaagcactccacgtcacttcggtatctaaaattttatcgtttgcgtaaggatgattttcaaatgaattctcaattaaacgcatatgccaacgtctctgaaaggcagtatctaacgtgaacacattctgatcagacgtgttcattgtcccaacaatagacatattagagggaatacgaactttatgctctggatctccgtaaactattgctgcgacattcgcattagtgatggaatactcgctggtacccatagggaaactcgtatcatcagttgtcctatctaaaagttggaatacctcaccaaaaattgctggagcatttccacgattaatttcttcgataatcagaaaatattcaatatctggattgtggtatgccttccaaagcaatctggtaaatggaccgggcgtaaataaataacgtactttgtcatcggccgatactgtcggcaatatctggcctacaaagtcggaatacgtgtaatccggatgaaacacaaggcgctccattcggttttcatcactacaatattcatgttgaatagtgtagcttttaccagaaccgggtacaccataaagcaatacatttgtaccgcctttttttctgtcacagtgatctaaatccacaccatcgtgcccagttccttcatcaactctatccggcgtagtatacccaagcaactgacttaaattgtccattgtattatgaattctacttgtatccattacaggctacctccatataacttttccaagaaatcagcttcaagaacttccgatttaacttccgtgtgtctaccagaatcactgattgaccattcagggcgttgaataacatgaagtagtccagcaaattcaaaatactgaggtatatattgatgcccttttggcttctctattacatttctcatagtgaagtcatattcaccattacgatatctggtgatataatcatccagagcggcctcttcgacatcacaatcatcatgtcgaatacaagtgtttaacagataccattcccatttatccatacgcccgtatttgttcaatgctctcagcgtcgctcttaatggatgtaatttgcttccatcactgtttttgaagtagtaaaagcgtaatgcatcgcaataagcttcctcatataatttcttgatttctgcatagatcttttcttttacatcatcttcgtaattgtcagcaaaccccacctgttcttccagcttagctgcttggtagaccagttttcctctgtccgtcaaaaggttttgtatgtccatctcatttcgactgctaaaggaatcttcatttaaaaagccgaaatttacgcaaacacgttttactgttcgtactgcacctgaagatgatatttgcatttgctccgctaaacgatcttgtattccgtttccccaagacgaatgatccgtgaacgaggaatctgacaagcaatcgatcatgattcggaactgcctatgcaaatctggcccaatatttcgaccggtatagtcccagccacgaagatccatagtccattcctccttttcattacttcttttttaataccaatatttcatcgtatttgatgatgccgccacggttacctcgtggaagatgaagatatctatcacgaataacatatttgaaactaagctcaaatatatatccatttttctctgcaatctcggccaaaacttttgccgtaggaatactctgcccacgaatattactatctccgaccacgattacataccgtccgttctgtttcaattcttcacgtacagcaatcatattttttgccatatcctcgaagtaggtatttacaatggctgcacgttttgcatcaacttcagtgattttttccacaatcgggacaactgtttctgattgcgaagcatagcggtatttatcgtaaaaagattttgaaatttctgtcccaatatacgactgcttgctttttttcaattcttcattcgatgccaaaccaagccacatatcttcaaaacgcaaactacgcacatagtcataagcattaatatatggcggagatgttactgccaaatcgatagtgttttctgcattaattgttctggcattattgctctctaaaatagtgctattacaatggagtggtgcaacggcctcagaaaatccaataatagcctctctatacatattctctactttaaagaacagctctgaagggtcagcaggtgtcttggggtactttgtggatatatacggttttggagaaacctcatcagcattcgaaacctttcgaataatcccagaaaggacaacatataaataatccttgacattctggttgtctgctgcaagtttatcgattgtatacttaaagaacgaaagccacagaattgatttatcacaaaaccatttctcgatattaggaataccgggaatcggatactgaaaactctcgtcgggagacatctcctttattttccttacaacctcatcgagaaaatcaatatcctccttggagtaaactgtagtttttactttgatgagcaatcgggcaaatgggtcaatatcaattgacatagcatttctgcccaaaagcatcgcttctatcgcagtagttcctgatccacaaaacgggtccagcacagtttctccagcctttgaatatgcgttaattgcaaaacggggcacggcagaaatataccttgtcgggtatttattaaacaacctattggttgaggctacaattttagtcttgtcggggatgatttcatatatctgatcctgaatcggattgattggaaaatcatccaatttaattacttccattctggaaacctcatttctctaatttcactatgctctcacgcaagtattttcgtacacgttcagtttttttatattgctgtgagcttgtgataataagcctttccactgcgatttcctgaactttaaatccaattttttcagcaatcattgccaaaaacacatctgtcggaatcacaatgccagcatacgcagaattgctaacaacaattgcacaatgtccgccactcttcagagaatcatatatctgtcgaagtgcttcctccatgtctgcaaaatagccgttaagcatatccggtattttgtttgtccaaagcttctgctgacgcaacaacggaattatttgatcgttcagctctggcaaattaaaactggtatagcgttccggccacgtagcatggcaatgtgatctcaaagatttcatacggatatttttttgatcacttgtggagtttacaaaacccgcaaaccaaagctccaaataataaatcttcgtatagtcaaagcaatttgcatacggcggcgaaaaaagaactaaatctacggtgttcttcgccacatttttttccatcgttgtaacgctttccacatacacttgtggaattgggccgttatcttcaagcgaaaaatcctcaatcatagaagccgctttcttcgaaatacactccattgcgaacttgaatgcacagcccttatcataagttggtggacgtctctttatttttaatccattacctgcttttctgtatagtgcacactcttcaagtgtgcaaatccaagcaaaaaacaataattccttcggcttactctctggtaattcattgatgtactttcttatattgagctgtgccaacaacatttcagactcaaatatacgacgcaaatactcattttcaggaagctcaatattgattgcaatctcaatagtcgatagctcctgtaggagtttttcgaattcctccatattatctttgctataattctcagttttgacctttgtaataaatgctgcaaaaggattaacttcaaaaccaatagacttcattcctttggcctttgcgacagcaacagtagttccggctccacagaatggatcacagacaacggaagacttgttcagtttgtattcattgaagattttctcaaccagaataggagagaatccttccttataattaaaccatctatgtcgagcatacttagcgctgtaaacaaagttacaatcaacatttgtgtacgtagcactattcaactcgttgttcgttacattatatttggcgtcaagagcagcataaaaatttggcaagctattgtagtccatgtagttttaacctcatttctaattaattgcgctctttccacttttgacccattcatccaactcggaacgcttaaatttccacagctttccaaccttgtgtgctgggaccatttctttttttatccagttacgaatcgtaactgtctttatgcctaaatactctgcggcttcatcaatgctaatatagttatcattttcatttttagtcattctgaacacctcgctaaatgtcattgctataaaaattcattctgtattataccacagcagcgtcggatttttaagatatttgctgatatttgtttatatttaactctggtttcatcatattttattagctttcaccttttttcgatggtttctctgagctgttgcgtttctgcaattagcgcaacagtatttttttcgaccgtttgtagttttaacaacaaaacgattattgcatgctggattttcgcacttgcgataaacatctgtgccgggacgtaagtagaacacagaaaaatacaaagcagaaatcaaatttggagctctccaagtaggacccatttttagaacgctgtatttcggtgaaataccagaaagattatggttcatttcttcgtttaaaacaattttagcaactgtaacggcactatttttcattttttcatctaacagtgtagtttgaggaacgtctgaataatattcaatgcctttctcaaaagacacacctccaataacaccaatgtccctcataaaatgaaacaggaaatctattacatatcgtctattcttggagagatttgcgccattacggtatagatatacgatagctttatatcgcatatctaaataccccggatatcgattttcatatatattttctgaaacgacatcgttatattcttcaatatccaattcatatgagccatagatagaatcacgaattgtatacgtatccttttgaaaggcctcctgctgtccatcaatttctgtcagctgtgaggctttatctatttcattggacaaaaaatgtttataagaaacatatagccgtggcaaagtcgacaattcaatagatattttctgacttaaatgtaaatacaaagttagcgaaatcattctttcataatcaatttctggagattcaattttattcatgaatgcgacagttgccttcagtctattaataatctcgatcacgtcttcgaaatataatgactcaaaatttgcatccccaaccttaaagaaggaaccatttgtttcaaaaaagcaaaccatcgcttggatgtcattatctggtagcgacataagttctttcaaaaggaatatgtccttgacccaattagcaagacaacccgcaagaaccgcggggagcttccgcagtatttcgtagaaagtacgcacgaggctatcataccgatggagacctatcaagcagtgcaggccgaaattgcacggcgacgggagctcggtgtttttgcaagctggggcatcaacaccagctgctttacatcaaaaatcaaatgtggtctctgcagtgccagttttgtacgcaacacccggaataattgggccaagaccagccagcttggggagcgttacactttctacggctgcggcacaaacaaacgtaaaggagcacactgttcctccggcacaatacgcgaggaggttctgaaagaagaatgcgccaaagtgctcggcctgccggaatttgatgaggagactttctcggaatgggtcaaaaagattacgattccagctcctggtattatgatcttcgactttactgatggaacctcacttgagcatcactggagccggaatgcaaaaaaggacagctggacagcagaacggcgaaaagcggtcagcgaataccggcgcagtcgggaacccggatggaagtgctataacaccttcacccacttcatcaaatgcgggcactgcggagcgaactatcgtgtccagactcacaagcgtgtggacgggacaattgtacgttcttggtactgctcgtcgccaacagcggcgggctgcttcaaagtcggcatccgagaagttacactcaagacgctcattgctgacgtaatgggcctaccggattttgacgaggagcttttcaatcagcagctggcttacgcaacggtgcccgcagacaatgagattgtctttcactttcgtgacggacacgaggcttcccgaatcttcgtccagaagcgccagatgccacgccagactgaggaacggaagaagcacatgagcgaggtcataaaagcgaaatggagggaacgccatgccaaaaacgactaagaagattaccacgattccggcaacgctgaccagatttacagcaacgccaatcaaccagcagaaaaagcgccgtgtggctggatatgcccgtgtttccacagaccacgatgaccagttcagcagctacgctgcgcaagttgattattacaccaactacattaaaggtcgtgacgattgggagtttgttgaggtctacaccgacgatggaatcacggggacaacggtcaaccgccccgcgttccaacggaccatgcaaatgatcctctgcggagaggtaaatagtcttattgtcacagagttgagccgcctgtcccgcaaccagtcctttgctaacaatttgatagaagtgacgctgccctcgttcaaagtgcggctgttctctctcagcgagggctatgacaacgcgaccaacacaccggctgacgagaatttggccatgttcttcaacctgttcaacgagtattttccccgcatgaccagccagaaaatcaacacggtgatccagatgaaagcagaagtcggtacccggatcgcctccatcccgccctatgggtatcagaaggatccggaggacaagtataaatttcccaccgcgtattttttgttcaaacaggggatttccttatcctttccttagaaacacccggtatcctggtctcatccattacaaaggagtgttttctatgaccgaatcccttcgccccgccgctgcccggcggggcctgaccgacaccgccctcaagggcatcgccgtggtgagcatggtgctggaccacatctattacttcttcggctataccggctgcatccccacctggtgcagcatggtcggccgcctggccgcgcccctgttcctgttctgcctggtggagggctttgtccacaccagcaaccggaaaaagtatttcttccgggtctgggttctcgccgcccccatgggactgctcctgtttttcatgcggtacggcggctggttcacccggccggacggcttttacccggaaaactccatgctgtccacctttgtcctgctgctgctcttttaccagggctttgagtggatcgccagccggcgggcttccaaggtggttttgggcctggctctggtggtgtttctggtgctctggccccagttggccggacggtgcaccctcctgtttccccaaacggccaccgtgttcggggtgttgggctacgcggtgctacccatgatgaacttcaccggggacctgagtctgcccgttattctggtgggcctggccctctacttcgccaagagaagccgcatcgcccaggtgatcgccctcaatgtggtctccttcggctggcactttgtcctggtctatcttcaggtccgcacctggccggattttcagatggttcaaatgttcaccacctactacgaatggatggggggcctcttggccacacccctgctgctgtgttataatggacagcgcggcgcggggtaccgccggttcttttatgctttctaccccgcccatatctacatcctgtacgccctgtcctggctccttctcctggccatgggctgaagaaaggagggtccattatggcccacatcttagtggtggacgacgatgccgacctgcgccagctgctcctcaccgccctggagcgggacgggcaccaggtcactgccctggaccggggcagcgccgtcaccgaggcccattgccgctgggcccactgtattctgctggacgtgatgatgcccggggaggacggctttgccacctgccagcgggtccgtgccctggcagactgtcccattctcttcctcaccgccaaaaccgaggaggccgacgtcatccagggactgggcctgggcggcgatgactacctcaccaagccctttcgcctgggggagctccgggcccgggtcgcggcccacctgcgccggcagcaccgtaccccccagcaccggttccgccggggcggcctggattttgacctgggggagaaggcggtttactggggagagcagccggtgaagctcacccggggggagtacgccatctgcgaatacctggccctgcacagcggccagaccttctccaaggaacagatctacgaggcggtcttcggctttgacgcccccggggaccaagccgctgtcaccgaacacatcaaaaatatccgagccaagctccgcgccctggactgccatcccatcgacaccgtctggggcgtggggtaccggtggaagcgagacctgccatgaaggggaaacagcgcagtctcaatggtctgttctggcggtatctgctcagcaccatggccctgctggccggggtgctcctggcactttggttcgtcctgctccagctgatccgcatgggggcagttctcccggcggacaccggcgcccggaatctggagcggaccaccgtcctcctccaggcccaggagacctttgaccccggggaaatcccattctactatcgctgggcgctggcggacagtagcggcatcctggagagcaacctgtccccgaaagaggagacctgggcccagaaggtcctcgccggcgaggtctcacgccacggatttctctacacaaaatactactggtcggttccactgtccggtgggcgggtctgtctgctccagtatgactacgcggtctgctacgccaatcccaccctccaggagaggctgccggatttccagctcctgttcttcctggtctgcctggggtgcctcgtgctggtggctctctggcggacccatcactataccaagggtctgcgccgggacgcccaggccatcaccctggcctgcaacggggtcgcccagcagacactggacacccccttccccgcccaggcgcaggtccgggaactccaggccgccctcaccgccctggacaccctgcgccgggagctggccgcctccctccaggaccagtgggcaggggagcagcagaagcaggccctgctggccgccctggcccatgatctgaaaacgcccctcaccatcatcagcggcaatgcggagctgctggacgaggacaacctccccccggcccagcaggcctgtgtccaggccatcctccggggggcccgcagcgctgaggactacgtcacccacctccaggccatcaccacggggcttcccccggctgcctctgcccagacggtctcctgtgccgatctggcccaggcctgcgccgctttgggccgggacctgaccgcccccaaggggatcacgttctcctggcagaccgacccccatcccctgccggaccgggcactctccctggaccggaccgcctttctgcgggcagcggaaaacctgctcagcaacggcgtccgctatacccccgccgggcagaccttggactgcggcctgcgcctgaccgcccagcggctgtttctctgggttcaggacagcgggcccggcttctcccccgaggcactggccaaggccggcaagctcttctacaccgaggagcccagccgcccccagggcgggcatctggggatgggcctctattccgccgcccagaccgcccgggcccacggcggcggactatgcctggaaaacacctcccgtgggggccgggccaccctgtggatttctatttcataatatttccgcaatttttccaaaagccgttgcgtttttggaaaaactttcgtcttatggagtggacgcagtccaacacagattccaatgagacggaggctgactatgccatgaactggtggaaacctgccttgggcggcctgctggccgccgggtctctggttcctatcctggcccggcgggccccaggccggaaacaggacgcccgtcctgtcacccgggcgcggctgaccaaactcctgcttaaggccgcccatttgtccccggacagcgaggcggtccagtggatgagcgcacactgcacggcccagcccctggtttggggggacctggccgcgcactggctgcggaaagagggctggctgcacagcgccctctgcgccggcctgctcctgccggaggaccgtcccgccgggcagttttgtcccgacgcccccctgccccgttgggaaggggcccgcatggcggtccgagccttggggctggggtttcccgctgcccaggcggcgacctgttctccgggcttttcagatcaggcacagtttcccgccggcacggcggggtacgccctgacagctgttcagacggggattctcccaggccacaccggcggccgcttccatccc

SEQ ID NO: 2245 - DNA, 19572 bp, KLE1738
acttcgccagcctgcagggcgttccacaccatctgggccgcagtgtcgcgggtcagggcagcggagacatccagaccttccaggcccttgtacaggcccttctgggtggcacggacgttgacattcatgtcccaagcgttgccggtgtagccctcgatgtcagaatcgaagcccaggcagaccagcagcatcttagccagctgggagccggtcacattgccgttggggctgaaccggccgccgcccacaccagacacgatgccctgggacacgcaggactcaatgtacttctccgcccaagcagcgttgggggtgttgcgcacgtcggagaacgtgggggtggcaggtgtgcccagggtgggctcctcgccgccgttcagggccacgcagatcatcttgcagatctcggaccgcttaatgttcccttcgggcttataggacccgtcaggatacccgccgatgatgttcagcgcagagcacgcatcaacggcctcggtgttctcgatcttgtcctgatccgagaacgccgccccggcgcccatgaccatgacagacagcatcacagccacacagagcaccaggctcagaaccttcttctgggggaactccttgccccgcaatgctttgctccgcaatttcccacagatttcccacggcgttcacacggttttttcttgggtctttcctactgctcttcttccttttggatttaattttgccatattattatgaagtactttttgatcgcggtgtgtgtaaatgttcgctgtgacagagatattcgcatgccccatcaattctttggccacgttgattgggactccggcgcgctgaaggtcggtgcagaaggtatgccggagacaatagggcgtcagatccggggcaatggcatgttggagaatttggccgtcccggactttcgcgcccatgtgaaggtccaaagcgtgagcaaaggaattccagagccggcgaaggctgttggcactgcgtatgccgccgttggcggagggaaacacaggcgcagcaccctcgccccggaccgccagcaggcgctctcgcagctcctgccgcatggggatatcccgaatccctgcgggagtcttgggggctttgatggtccgggtcccgctttctacggctttataaacgtggatttcatttcgatcaaagtcaatatcctcccagaacaaggccgccgtctctccaggccgcagacccgtgtacagaatggtcagcacccacagaccggcgggatgggtctgtgccacggccagaatgtgcctgcgttccgccttggtgatgggacgatggctccgcttgacactctccggcaacaggagcccttctgcagggtcataaataatcagccgggaccggcgtgcctgccggaagagctcctgcattaccatacgcagtttggatacatgcgagtatgacatccccgcttgggtattgaggatggtttgcagatgaaggtctcgtacgtcttttaattttaatgtcccaatggcggggccaatatagccgttatacttctcatcatagaggcccaaactcttttgggtgaggccggaaggggctttgtatgtctccttccattggagaaaccattggtccactgtggtgtttccgctggtggcaaattctccccggtttaaggaggccaccagttcggccagcttgtcacatgcctcctgctcggtcttgccccggacttcatagcgccggttttcccatgtgatggtctttcgaatgtacgtgtatttttccatagtaaaaaacctcctgttgtaagctttatcctacaacaggaggcggaatcttgtcatcaatgtttccctctaaattagtatattctgacacatttattcagacaggagcatacggtcattttcaatattgaatttttccaataggtcggagaccgtcaggttctttttctcctctccgcgaatgtccaccaccacacggccggcatccatcataatcaaacggttgccgtactggatggcgtgtttcatgttatgggtcaccatgagggtggtcaaatgatcccgagccacaatttcctcggtcagttgaaggaccttgtccgcagtctttgggtccagcgccgctgtgtgctcatccaacagaaggagcttcggctgattcaaggttgccatcagaagagtcagagcttgccgctgtccaccagagagaagccctactttgctggtcaagcggttttccaggcccaggcccagggcggccaactgcgcccggaagagatcccgctcctggctggtaatacctgggcggagtccacgggatttgccccggcggttggccagcgccaggttttcctcaatgcccatggtggctgcggttcccatcatcgggtcctggaacacccggcccagatatttggcccgtttgtgctcgggaagccgcgtaatgtccacgccattcaggcggatggttccgcgatctgcgggaaagaccccggcaatgaggttcagggtggtggattttcccgcgccgttgccaccgattaccgtgacaaagtctccctcttccagggtgaggtccaggccgtcaatggcccgcttttcgttgacggtgccagcgttgaaaaccttgtaaagtccgttgagttcaagcatgggggacaccctcctttttccctgcggggactgccttgggtttgctgcggaaataccggtttttccaatagggaaccgccaggaagatggccaccaccaaggccgagaagagcttcagatcattgctgtccagccccagggtcaggacaatctgaatcaccacgtaatagatgacagcacccagggagacagacaccagtttcaaggcgaagttctggaaaatacgggagaaaatgacgtcgccaatgatcactgccgccaaaccaatgacaatggcgccccggccggcgttgacatcggcaaatccctggtactgggaatacagggcgctggacagcgccacaatcccgttggagatcatcagtcccaaaaccttgttgcggttgacattgattccctgggcccggctcatgttggggttggcgccggtggcccggatgccgctgcccagctccgttccaaagaaccagtagagcaaagcaatgagaaccgcggtaaacagcagtgtcaccaggatggggttttccaaactgagatgctttacattccgcagggagaccagcagatcatagttgtccgggttgatggcctggttggctttgccgcccatgattcgcagattaatggaaaacagggccagctgggttaaaattcctgccagtatggcggggatacccatggccgtgtgcagcagtccggtgatggcaccggcaatcatccccgcgatgaaggcgcacagcagcgccacccagacattgaccccattggtcatcagcatgatacataccgcgccgccggtgcacatggttccatccaccgtcaagtcggccagatccaagaccttaaaggtgatatagacgccgatggccatgagcccccaaatcaggccctgggccagggcgcccggcagcgcattgagcaaatctgagaaaaaatccacgttgattcctccgtgttcatcgaatgagaaagacaaatcgagaccgggcggaaaaggaggcccctttccgcccgggttccagacaaatggatcggattattctgccgtggtctcgatggcggtgtatccctccggcggggtaatgttcagttcctcgcagacagaaggattatacatcttggtggcagtgggcagagactggatctccatggtgccggggtccttgccgttgaccagaatgtcataggccatctcgccagtcagctggcccagttcgtagtagtcgatagacagagtcgccacgccgcagccagagcagatgccctgttctccagccacaacggggacccctgcgggaaccactacgttgcgaatggcctctgtgcaggaggcggcggtgttgtctgtggggatgtaaatcacgtcactggaagcacaggcggaagtggtaacggaagccacgtcattggagtctgcaaacgcgtactctgtgcaggtatatcccatctcctccagcagaggcttaatgacccccacttggtaagaggagttcggttctgccgagcaatacagcaggccgacggttttcgcatcggggaagagttcctgaatcatatcagcctgcttgtccagaggcgccaggtcggcggtgccggagatattggtgcctgtggtgcccgtccagttgtccattcccagggcagtggcataatccgtgacagaggttcccaaaatggggatatctgccgtaccggcctgagcagcctggagagaagcggtggcgttggccatgatcaagtccacattggaggagacaaagccattgatgatggaagcgcagtttgcagactctccagaggcattttccacttcaaattcaacctctccgccgtccgcggtgatcagctccttcaacttatcctggaatccctgggtggcggaatccaaggcagcatgctgcatctgctggcagatgccgactgtgtaggagcccgcggccgtctgcgtaccgctgccgttttcctctggcgcagtagaatctgcgtttccgcaggcagtcaagctcagcgccatcatgccagccagcacagtggcaaacactttctttttcattgtatgagaccttctttcgaacatggtaaatatgactgccgatttctctcgaaatcgacgttttccatcttaacactttaaagcaatgaggtcaataggaaaaacgaattttttgatataataataagaaaaaaattatgataaagatttccctcatagtatgcacttttgtctttcttaaaaagacaattcgatgggtgtctcatgctttcttctgcctaaaacagagatcctggaaggaggaaatttttgtgggagttccgtgtaaaatccgtgggaaattgcggagcaaagcattgcggggcaaggagtttccccagaagaaggttctgagcctggtgctctgtgtggccgtgatgctgtctgtcatggtcatgggcgccggggcggcgttctcggatcaggacaagatcgagaacactgaggccgttgatgcctgctctgtgctgaacatcatcggcgggtatcctgacgggtcttataagcccgaagggaacattaagcgttctgagatcaccaaaatgatttgtgtggctctgaacggcggcgaggagcccaccctgggcacacctgccacccccacgttctccgacgtgcgcaacacccccaacgctgcttgggcggagaagtacattgagtcctgcgtgtcccagggcatcgtgtccggtgtgggcggcggccggttcagccccaacggcaatgtgactgccagccagctgtccaagatgctgctggtcagcctgggttacgattccgacattgaaggttacaccggcaatgcttgggatatgaatgtcaacgttcgtgctacccaggttggcctgtacaagggcctggaaggtgtggacgtctccgctgcgctgacccgcgacaatgcggcccagatggtatggaatgccctgcaggccaaggaagtcaagtatgaatatactctggtttctgaaaatggccagctggtctccaagcccactctggtggagaaggacatcaccctgctggaggacaagtatgacgcgaccatcaccactggtgttgtgaccaacgttgactacaactccaagggttatacggtgcagatccagaccggcgttgataagacgaatcagccgatctatgttaacctgtccaagctgaccaacgatcccaccgacctggttggaaagtccgtcaaggccatgtacaaagacgccgatgaggtgtacggcatttatgtcaatgccgagaacaccgccactgtggtggaaaccaccctgggtgatctggatctgagcaaaagcgaatataagctggacggcgtcacctataaggtaaagaccgacgacttcggtgctgtcaaggcagttgatgcccttgggaatccattgaaaaatggctcttctgagctgaaaactttggatgctgtgaaaacggatggcacaatcttctccaaagcctccaaggtggttctgattgacaacaccggcgacgagaagatcgacatcgcagtggtgacccctgtggcctttggtgagatcacctatctgaacgccaagaacatcaccgtgaagggcgttatgaccaacgcgaaggtggaagactgcgatatctataaggacgccgccaagggcgaccgggttgctgttgtcaaagacacctatgttgccgacgacagcacggtgattaccaagctggattccgtttccggtaaggtggatgcgactaagactggagaagctcgtattgatggaacttggtatgatacggctgttaccgtggggctggatgacaagggtgagtttttcctgtacaatggctacattgtagatgtggatgccaccggcggctccattgcggatactgcattcattatttccagcagcacctccatggacgttgatggcaattaccaggctaaggttatgatcaatggcgagaccaaggtcgttcctatccacaaagattctccagttaagcctacctcttctgctattgcagataagtacgtcacttacgaggtgaaagacggcgcttacaagttcactgaaattaccagttcggattccggcttggatgaatattctgctgcacaggtcaattcttacaaggatggccgtatctacgcaaatgcctctggtagtggtgatgagtacttgattgatgacgatgccgttgtctatgtcaagtacaatgcagataagtatgcgattctgtccggcaaagatgttgctggctggggtgacaaggttaaagacttcaatagtaacaagtctctggttctgtataagacctctgacactatgaaaaagattgcaggtgctttcattgatcttggcgatgaaaagatgcccgcatccactgtttcctatggagtcatcgtcagtgacgttattagagccaccgatgataagtacgaattcacactgtggaatggcactgacacgattgatgttgtcacttccgattccggattcgcaaaattccaggctgttgagtacgtgaagaacagtgacggtacctatgacatcgatgcggctaagaatggaactaacaacgttggtgctgttcaaggcttcaacctctactccatcatggatcatacctccacggttgtccagatggccaacgatcagaacaccgcaaagaattacaatctcacgaaggacacccaaatcatttacgtcgatacttctgcagacaatgttgaggatatttgtgtaaatggtggttctattgaaaatgcgagccccgcacctgaagggaaatattatcgcaatgcatcctttgtcattgactctggctctgacttggcgttcttgattgtgattacaaacacagatggcgcgtatcctggaagcattaaaaaataatttccaacttattgtggcgccgttgaaaagcccccccgggactaaagtcccggggggcttcttcttgatttttccctgaattgtactataatgaataggatcggtttcttactaaggggggagtgtattgaaacgccagttcctcttcggctgcctgttcatcgccctggcggcggtgatcttttccaccatggaagtcctgctcaaactccccgctgtggcgggggcctttcaccccatgcagatcacgctggagcggttcctggtgggggggatctgtctgctccctgtggcggggtggaccctgcggcggaaggggattcgcctgaccaggcgggacgtggggacctttgctctgacagggcttttttgcgtgccgttgtccatggtcctctatcagctggccatcacccacgggcaggccaacgtggtggcggtgctgttttccggcaatccgatctttgtcacccttctggcctttctccttctccatgaaaccattgcctggaacaaccttttggctctggtcctggaggtgctgggcattggggccattgccgggttgggcggcagtgcggtcagcctttccagcgtggcactggcggtgctggccgccctgtttttcgccgcctacgcggtgctgggcaagcggcagacggcccggaccggcagcctggtggtcacctgcggcagctttctctggggcggtctggagctgggcgcccttctgctgctgggccggacggaggttggaagcgcgctgtttggacagctgggactgaccatgttccaggatgtcccgtttctccaagggctgacggggcagaccctgccctatttcctcttcattggcatcgtcaacaccgccctgggctacgtttttcatatgctggccattgaaaagaccagtgccatccacggcagcctggtctttttcttcaaacccattctggcgcctctgtttgccctggcagtgctgggggaagctgtgacccctcccattctcctgggcattgtctgctttttggccgggagcctggtgagcatcctgcccgacatccttcgggcacgaagggcagggcaaggccgcctggcaggggaggccgccccacaacacgaaggaaaaggaaggtagaatccctatgcagtttacccccattgatctgtccacctggccccgccgggaacactttcattattaccgcaaccagctgccctgcggctactccgtgacggtgcagctggatgtgacccggtttcgggccatgctggagcggaaggggctgaaattttaccccagtttcatctggtgcgtgtcccatacaatcctctcccaccccgcctttcggatgggcgtggacagtgagggccagcctggaacctatgacaggatgcatcccaactacaccgtgtttcacgaggatgaccacaccttttccgacctttggacggaacacaacgagtcctttcctgtgttttaccaggcgttcctgtccgatgtggccacctacggaacccggcatgggatgaaagcccgggccggtcagccggccaacttttactgcatctcctgcgtcccctggctgtcctttaccggctatgcctccacggtccccggggggcagcccaatctgtttccggtgatcacctatggaaaggccgctgaacaccaggggacctggacgatgccctttgccgtgaacatctcccacgccgccgcggacggttggcacaccgcccaatttctgaacgacctgcaggccctgctggacagggtggacctggaggaggtggcccggtgaaccaggctttacaggaggaattccgcgccaaaaccatttccgcccaacaggccgccgccctggtcaagagcggccagcaggtctacctgggctgctgcaccagctatgccagagccatcgccgacgccctggccgcccggtcggaggagctggaggatgtcaccatcgggtgctccaacatcattccgcccatgacggttctggactgcgcccatccccaggcctttcgcatctccacgtattttatggggtatgaggagcggcgggcctggaaagcggggcgggcggacttcacctcggtccatctgggccaggtggaccagtggtgccgggagaccttccatccggacctggccttttttgatgtctccctccccgacgaggagggctacatgagctttggagcctccggctgctgcatgcacccgtttatccaggaggagaccgacaacattgtgctgcagatcaaccgcttctccccctacgtcaccggccagcgcaccaaaatccacatctctcaggccaggcatgtggtgtgggcagatgtggaaaaggagaccattcccggcggcccggcagaggaggaccccatcgttgccgccatgtcccggtacctgctggaccagattcccgacggtgcctgtatccagctgggcattggcggcgtggccaccgctgtgggctacgggctcatgtccaagaatgacctgggctgccacacggagatgatgtccgactccattatggccctgatgaaggccggcgtcatcaacaacagccggcctaagtttatccccgggcggaccgtggtgggcttcgcctttgggtcccgggcactgtatgaatttttggaccacaacgaggacctgttcttcggaccctttcctgtggtgaataacccggtgaacattgcccaaaatgacaatatgatctccatcaacaccgccatgtccatcgacctgtttggccaggtggcggcggagggcatggggacgcggcagttcagcggcaccggcggacagggggattatgtccggggggcccagctggccaaggggggcaaatcctttctggccttctcctccacggtgggcgtgggctcggacggtgcccccaagagccggattgtccccaccttcccgccggcgaccatcgtcaccaccccccggtcggacgtgcagtatgtggtcacagaatatggcgtggtcaacctgaaacccctgaccacccgggaccgcgcccgggcactcatcgacctggcccacccggactgccgggggatgctcaccgcggaggccaagaagctggggctcctttgaccccctgttttccccggggcggcccggcaggggctgcaccgtgcagataagatcataagaattggaggataccaacatgaaactcgcgatcccatacgacaacggccaggtgttccagcactttggcaagacagaggcctttaagatctacgacatcgtagacggaaaggtgggcccctccatggtgatgagcaccaacgggcagggccatggcgccctggccggcctgctgcgggggctgggcatcagcgccgtgatctgcggcggcattggccctggggccattgaggccctgcagtccctggacatcacccccatccccggcatcaccggggacgtggaccaggcggcccaggactttgtggacgggaagctggtccccaacacagaggccctctgcaaccatcaccaccatgacgatggccattcctgcgcttctcacacctgtggaagcggcggctgccacgcccattgagctatcatacggcgcaaaaaacccccggacggacaggaaatgtccgcccgggggttaatttatcccccaaacagcggggtggacagatagcggtcgcccgtgtccggcagcaggacaacgatccgtttgccctggttctccggccgtttcgccagctggatggcagcccacagggcggccccggaggagattcccgccagcagtccctcggtgcggcccagctccctgcccgtggcaaaggcgtcctcatcggtgacggagatcacctcatcgtataccccggtgtccagcaccggagggacaaagcccgcgccgatgccctgaattttgtgggggcctggggtccctttgtgcaggacgggggaacctgccggctccactgccaccacccggatcttggggttctgctgtttcaggtaggtccccaccccggtgatggtgccgccggtgcccaccccggccacgaagagatccaccgcgcccgcggtatctgcccagatctccgggcccgtggtggcctggtggacggcggcgttgaccgggttctcaaattgccgggggagaaagtggttggggatggcggcggccagttcctgtacctttgccagggcgcctttcatccccttggccccctcggtgagcaccagctccgccccgtaggccttcatcagctggcggcgctccacactcatggtctccggcataacaagaatgagacggtatcctctggccgccgccagggccgccagggcaatccccgtgttgccggaggtgggctctatgatcacggtgccgggggtcagcagcccctttgcctccccgtcgtccagcatggccttggccacccggtccttcacggagccggcgggctggaaggcctccaccttggcaagtatacgggcggccagcccgtgcttctgctccaggcgggtcagctccagcaggggtgttttgccgatcaactggtcggcggatgtgaatggggttcccatatagaatgcctccttacatgggttaaatcgagtttattgggaatgttacagggtcgattgggcttccacggcagagaaggcctgctccagatcggctaaaatgtcgtcgatgtgttccgtgccgatggaaaggcgaatggtaccgggacggattccctgggccaacagctcctcttgggggagctgggcatgggtggtggtggcagggtggatgaccaaggatttgacgtccgccacgttggccagcagagagaacagccgcaggtggtcaataaaccgataggccgcaggctgcccgccccggatatcaaaggtaaaaatggagcccccgccccgggggaaatacttctggtacagcgcgtggtccgggtggtcgggcaggctggggtgatttacccgctccaccaggggatggccggccaggtaggtgatcacctgcttggtgttctccccatgacgctccaggcgcagggacaaggtctcggtcccttgcagcagcaggaaggcgttgaacggggagagggccgccccggtgtcccggagcagaatggcccggatataggtggtaagggcggcagagccggcggcctctgcgaagctgacgccatggtagcttgggttgggggcagcgatgggggcatagcgtccgctggccttccagtcaaagcgcccgctctccacgatcacgccccccaggctggtgccgtggccgccgataaacttggtggccgagtggaccaccacatccgccccgtgctcgatggggcggatcaggtaaggggtgccgaaggtgttgtcgatcaccagcggcagcccatgtcggtgggccagggccgcgacggcatccaggtctgggatgtcgctgttgggattgcccagggtctccaggtagatggctttggtgttttcctgaatggcctgctccacctgatccaggtcatggacattcacaaaggtggtggcaatgccgtactggggcagtgtatgggacagcaggttgtacgtgccgccataaagggtgcgctgggcgacaatgtgctctcctgcctgggccagcgcctggatcgtgtaggcaatggcggctgcgccggaggccaccgccagggcggcggttcccccctccaaggcagctattcgcgcctccagcaccccttgggtggcgttggtcagtcggccgtagatgttgcctggttcctccagatggaaccgagccgccgcgtgggcggcgttgtgaaagacataggatgtggtctgataaataggcaccgcccgggcgtccgtggccgggtcggccgtttcctggcccgcatggagctgcagggtttcaaagcgatggaaaggaatatgggacattttgcatctcctcttttcgttgtgtcaatttggaaggacgcttcccggacaatgaaaaagtccgggaagacagcaagctcccggacagaaagaaaaggaggcttccccacaggtcagggaagaaacgcaggcatgccaaacagcctggccctctgttctgtccaggagtacagcattcgtccacagcgaaaattggttcgcagcaaggcattgaaatgaaaccgcatgttcttccctcctttttaatctcactttttttgtgggattttatagtttgtatcatagcatttttgtgagcttatgtcaagggtttctttccatagaatgaaaaaatgctggtgaaaagtaagacacccccaagcccatggcttgggggtgtcttttttggatgtgtcaaggggatcgttcccctctcatgcatcggtgggatggaagcgtactgctcaccaggccatcttgttctgaacgtcaaccacgattagggtgatgcagtcatcgccgctgtcaacataaacagtcacgttatcgtcgtggttggttgcgtcgccgttgaactcgggtgccagctggatttccccgttggtctcgcctgtggcggcatcggaatcgacgaacaggaccgtggtgtccttggcgtcgatcttggcgttgctgccagtcaggtttgtcacagtatctgcaaaggtaatctcaccagaacccttgtcataggtcttcacctgggtggtggtcgcagtcagcttatcaatgtccacggtgccatccccattgctggagtactcgaaaacgctgcccttcttaatgccgccggacagagtcccttcgtacttgtactcagtctcctctgtaccattccaagccttcacaatggtgtaggtggtgccgtcaatcttggaagtgtaagaatcatccaaagcgacggcgtaagtcttatcagaaccgccggggacattcttttcgcccaaatcaacataggcaacgccgatatactgagagttgctcttctcctcggtcaacatacggaccatggaaggagtgatctcatcccactttctcgcagcttctccagtgacaactttgtaatcgtcattcttgtacttgacaaacacagttgcattgtcatcgaaataggcgcgatttacggtctccttgtaggtattgtcggaagcgccagtaaagcccttcacattagaagtccgtacgctgccgtcgatggttgcgtcttccgcgtaatagaagttttcataaccggccatgtctttctgatcagaagcggtggtaatgaaggtcagagtataaacgtccttggacacatcatacgcagccagcttattggaatagcctgcaaagttcttgctatccaatgcctgatcattcccgtcgttcttctcaatgttaacaaccttatcggtgccatccgcaagaatcagacgggcctggtagtatttggaaccaaccgtattgctgttgccgacctcaacaaccagtgccacgtcagaggaacccgctgtcacggtatccactgcataaacatagccatttaccagaaccagtttagcggaagcgttcagcttcggggcagtgacacccgtgttcatggtgtaccaggtgccgtcgatcatgacttcgtcagaacccttggtggaagtaactttcccttccacaacggttgccttctcaatacggcccttgctgtcagcataattgctgcccttggagatcagcgcgtaatctcccttcttcaagccatcgctgataacatagtcatcatcagagtacttcgtgccagcggtgacatagtcagagccaacataggtgatttccttaacctcgaaggtggtaaccttcaggatagagtaatcggatgtgccatcgactgccagcagctcaacctcggaacccttgccataggtagcatttccttcgccatttgttgtcagccaggtcttgatgttgtctgactgcttcacaccatcaacataaacagtattcgtgttagccagatcatacttggtgccgtccagtttggccttagtgccgtccatcttcaggtcagccaaaaggccggtctgtacggtgttcttgcccgtggcatacacaccataaaccacggcgtctttgccattcttgtcgggcttcaccaggacgcggacattctgatacagcaggtcggaatagtccttggaaacgtctgtgtaagaaactgtcccaccattgtacgtaccaccattatacttggcattctcaatggtgatgttataggtgctcttgccattgtcctgctttaccttagtcaaagtaccggtaatggccttggcgtcgtatttgtcctccagcagggtgatcttgtcgtcgttgtcgccgaccaccttgtcctgcacagtgacaatggtctccagcttgccgtcctcgccggtgacgatggtggtcttgtactccacctcataggcgttcatggcattccacaccatctgggccgcattgtcacgggtgatggcggcagaggtatccatgctctccaggccctcgtacaggcccttctgggaagcgcggacgttcacgttggttgcccaggcattgcccacaaactcttcggtgttggcgttgtagcccaggctgaccaacagcatcttggccagctgggtgccggtcacgttgccgttggggctgaaccggccgccgcccacgccggaaatgatgccctgggccacgcaggactcaatgtagccctctgcccaggcggcgctggtgccacgcacgtcgctgaacgtgggggtggtgttggtgctcacattgggctccttaccaccgttcagcgccacgcagatcatcttcgtgatctcggaacgcttaatgttgcgttcgggatgataagaaccatcctcgtacccgccgatgatgttcagcgcaacgcaggcatcaacggcctcggtgttcttgatcttgtcctgatccgagaacgccgccccggcgcccatgaccatgacagacagcatcacagccacacagagcaccaggctcagaaccttcttcaggtttctcataggggtttcctcctttaaatttttttgaacgcatccttcccttgaccatgtccggcacacatactgtggcatgccgttgcggtatctgcgccgggcgcagcagagttggaattgttctacggttactatacgaaaagttggttcatttgtaaagagcgttggagtttttgtaacaaaacggtaatctggttacaaaatggttacaaatctcggtgtgcagattaaaattcccttgaaccacaaaggattgtggcgtattttggcaaagcacaaggtatggttgtgttgaggtgcttgtcgggctatttggttggagaggcaagcttttccggacgaaaataccatggtttgaaaactatgacaaggaatattccttgtcggcaaattgctgcttttgccccaggttcttttccctaaaattttgttggaaacaggcgaaagaaacggacgcgggatacaaaatccgcgtccgttctactttataatatataaagataccgttatgccttgtggtctacctgatacatatactccagcaggtccacggttttggccgagtagccgatctcattgtcataccaggcgaccaccttcacaaagtggtcattcagggagatgcccgctttggcatcaaaaatggcgatatgacggtcccccaagaaatcactggagaccacagcgtcatctgtgtaatccaaaataccctgcataggcccttgggccgcggctttcatagcggcgcaaatctggtcataggtggcaggggtttccagctctgcggtcagatccaccacagagacatccagcgtgggcacccgcagggacatccccgtcaacttgccggacagatcgggaatgaccttccccaccgccttggccgcgccggtggtggaggggatgatattccccgaggccgcccggccgccccgccagtccttcttagaggtgccgtccacggttttttggctgcctgtgatggagtgcaccgtggtcatcagtccctccttgattccaaaggtatcgtggagaaccttggccaccggggccaggcagttggtggtacaggaggcgttggaaacgaagtccatgctcttgtcataggatgtgttgttgacccccatcacgaacatgggtgtgtcatccttggaaggggcggtcagcaacacctttttggccccgccggccagatgtcccttcattttctccgcggtggtgaacttgccggtgctctcaatgatgtactcagcgcccacagaggaccagggaatctcgtggggttcctcgcagtggaacacgcggatccggcggccgtttacaatcagatcgtccccgtcccagctcacctcgccctggtagcggccatgcacactgtcgtacttcaataaatatgccatgtaatcgggggtctggctgtggctgttgatgccaacaaactcgatgtcggggcgctccatgcccaaacgcagcactaaacggccaattcttccgaatccgttaatgcctactttcatacccatatcaccaaaatcctttccgcgtcataatctatttgtttgctgaaagctcagcatagacgcctacattatactccagttttgcccaagagggaagtgctacttttcagcaattgtcccatttgtttggagcagagcgacctttttcgacaaaattcttgtgttcctttccaggatttgctacactgttggtgtgaaaatttcagccccttccgggcatcctaatcctattttcaaggagttgacgctatggatctcatcacgtcccgtctggacctccagttcggcagttttcccgagccggtgattttcctggccggcggccaggccgtgtattccaatgagcccgggcagcagttgttacaaagcgaaacctgtcccctggatctgctggctgccttggcagagcatcccagcgggtcgatggagattgccctggggcaggccacctatcgggtgacggtctccccctttgagatgggggacctcttggttttgcgtcccctgccccagccagaagagaaaaagcaccctttttccaacgcggtctatcggatgcgggagtgcctgtctaacttcactgccgtgcagtggaagatgaaacgggtgctggaggaaaaccatttgatgggagacttcgaccaggatctggccaatcagagccggttgatctttcaaatgcttcgcctcacccggcaggcagagctgacccaggaactcaacgacaaagcttttccccgggaagagggttttgacttggccatggtctgccaggggatggcggatgaaaccacgtggctggcggacctggccggcgtgcggttctcttacagcagcaatgtggagcaccttcccttccagggcagcaaatctctgctgacccaaatgctgctggcgctggtgtccaacggagttcgggccgcgggtaaggagggagaggtggaaatgaaactccatgccgagcatggccggtgcgtgatctctgtacgggacagcggcgtggggattcccgaagatcggatggcgaccctcttttctggagacgccccagaggaaatcccgcggcccggcgagggctccggtttggggctgtataatgcccaacgaatcgcggcccttcacggcggcgtcttggtcgcccagagtggccaggacggcggcgcctgcctggtggtctcgctacccatcgtggtgccaaccagcgtccccgcccgcaacaacccgggttatgataatttgggtggatactcgccggtcctgattgagctcagcgacgtgctcccctggcaggcgtttgccccctcggatacggaagagtaaccccattgtttacaggtcggaatgtctttcctccacggacattccgacctgttttttcttgtgcgccagcgtgggaagacattgggaaatttgtgggaaattgtcgaaaatttctttgtaaaatcgacccaaacgccagaagaaggttctgagcctggtgctctgtgtggctgtgatgctgtctgtcatggtcatgggcgccggggcgg
